United States Patent 8,781,750 (CELL-TYPE-SPECIFIC PATTERNS OF GENE EXPRESSION) - sequence listing, part 27

SEQ ID NO: 36860 - DNA, 837141 bp, Homo sapiens
gaaaggggaacaggagccaggggcaatgaggggtgggcagggtaagcttccttcttgctccgggcaaggcttttagtggaaatgtatagaaggagccaaaattagggagcaatgttttggaggcaaaagccagcctttcccagcatctctgaaaggagcttatcttaacttattgcaacactgaatgatatgcttgaatgttatttgtacgaataaagatatttgcatcatgtcaataccttcaaggaacgctgtgaatgatttctctgttggcccacaagatgaggttattgttgaagacatcaccaattgctatttgtgtgagatctttaagcggtatgaatgggtgacctgagaagaaggctcatgatgaaggaacaaaaccaagggccatcggggcctgggtgtagcagacttcagtttacagagatttgttggagccaagtcctgtgctactctttaagaggactaaactgtccctcaagccagaggacaattcttgataaccctgagcctgagccactaaggactccaacttcctcccagagcccatagatttttcttactcaatggaaaaggttttttgttgtttgggttttttgtttgcttgcttttttgcttttaaacactgagcaattggaactataacttatttttgcaaaactgactcctgtattttgattattttgattattttgatcttaaaagcaaaaagtacttatgcaacactataggtgctctcaaaggatatgctttagtggtcttcaggagaaggaaaatatgtgtatgctttattctgaaagttagtggtgaagaaagaccagcttggtgtgaccgttgtctgatatgaatgatctcaactataattatacgttagtgtttgtgtgtggttgggcacaaattagaaatgctattcatgatgtgatttttatgactttgtcattaagtagggatttgtggtattcctcaaacattccaagaggcaaaccacaaaactctgaatggtgaaagttgtctttattttgaaaaattatagtgagcactggatgttcttattgctggttagctttttgaaaaatctattgccaatgttactaaaaccaaacttggtaacaggttacaacagaggccccctaagctccagaggacagaatctgtgtttcagtcactctaaatccggagcctggcaatgctttgtaaataaatggcaggtgcagacaggggttctagcaatggaatgaaaagcagacagaccctaccacccccactgcccctcaggagtccactattacttcaggttggcacttggatgaatggggcttttacttattatctcagcctaaaaatgaatagcctctcaactcaatctccaaataaaatatcttatacagatttactatgttgcctcactgttttccttagagtataaaatcttttagctaaaatatattgaaagggaaatcaatgaagagggagaactaggagataatgtgttcaccttacttaactggaatgaaagtttttggtttttgtcgtcttttaatagatactgaatttgacctttgtttagcaccctaagtcatagggatagcctaccattctatcgatggtagaaatatagttgttgatccattatgagagataaacttccaaatctaagctgacagtacgggtttataacagcgaaagacagaaacaggtcatctgttggttggcttgtaacctgattacaaaccttctgtttgctttaaaaaaaatgtggcaatatatacacagaatctggtagtgcctcaacctactttgaatactttcatatgagctctggtatccccatcatttagcttccaaaaggaaattactatgcaagttcttagaatatactattgtctttggaacacttcaaatagaagagtggtaaccagaatacctgaagcaggtagatcatctgatggcttacatgaaactgctttcgtatcatctagttattaaaatgtttaccacgttgatgccacatttgtttgaaaacactactaaataccataaacattatgggaggatggctaatgactcatactatttggtaccaggcaagttaaaacagagaaaatgaaaaccggaaactaatatcaagtggttccaatatgaatgatgctgcaaagtcaagatttcatttccaagaaatatttttagcaactctggttaggcagattttcaacatgtttatcatctctggttaagtagattttctactctcagaaacctacagatgtttgctttaaaactgacaaaggggttttggtaggagtggcgtggaacaaatgaagtagtgggttatcttcttcaaaaagctcttaagaggccgggtacggtggctcacgcctgtaatcccagcactttgggaggccaaggcgggcagatcacctgaggtcgggttttaggaacagggcgccaaatctggccataaactggcccaaaaactggccataaacaaaatctctgcagcactgtgacatgttcgtgatggccatgacgctcacgctggaaggctgtgggtttactggaatgagcgcaaggaacacctggcccacccagggcagaaaaccgcttaaggcattcttaaaccacaaacagtagcatgagtgatctgtgcctggacatgttcctgctgcagataactagcaagagccatccctttgttttggcccatccctttatttcccataagtaatacttttagtaaatgttatgactggcttgctgtcaataaatatgtgggtaaatctctgttcgaggctctcagctctgaaggctgtgagatccctgatttcccactccacaatctatatttctgtgtgtgtgtctttaattcctctagcaccgctaggttagggtctccaccaccgagctggtctcggcagtcgggagttcgagatcagcctgaccaacatggagaaacccagtctctactaaaaaaaatacaaaaattagccgggcatggtggcacatgcctgaatcccagctacttgggaggctgaggcaggagaatcgctccaacccaggaggcggaggttgtggtgagccaagatccggccgttgcactccagcctgggcaacaagtgcaaaactccgtctcaaaaaaaaaaaaaaaaaagctcttaagagcacataaacataggaactttgtgaagtctaaggacaaaacaaaaaacaacatcactaacagaccataaaattagaaatcagtcacaaaaagccagtcaaaatatccaagaatttatggttgaagattgaatgaaattgacaaaatatttagacctgaattttatatatgcacatatcaaaacttgcaaaatgtagctgatgtggtcttttgaaggagaagaggtaaaaaataatcagttcaaaaaattatactaaagaggccgggcgcggtggctcacgcctgtaatcccagcacttcgggaggccatggcgggcggatcatgaggtcaggagatcgagaccaacctggctaacacggtgaaaccccgtctctactaaaaatacagaaaaattagccgggcgtggtggcaggcgcctgtagtcccagctactcaggaggctgaggcagtagaatggcgtaaacccaggaggcggaggttgcagtgagccgagatcgcgccactgcactccagcctgggcgatacagcgagactccgtctcaaaaaaaaaaaaaaaaaaaattatgctaaagagtaaactcaaagaaagtagaggaaaagaatgaattaaaaatctgtgtttataaataaaaataaaagtaacggagcaaaaagacgggcattagaaaatagtcatttctgacctctggtcagataaagggaaaaaagcaaaaaattagctatgttaggaatataaatggggacaacactacagataaaatagttttagaagactaaaatttattatatgtatacaagggaatagtatactatttaaaaagaattagataaacatgtaccaaacaagcctcaaaaaatacaactggcagaaatattcctagaaggaatcctttagtcaatatgcacaaagcatttaagcatttcattatttttgtttttttttttttttttgcttttgtttttgtttttttgagacagagtcttgctctgttgcccagactggagtgcagtggtgcaattttggctcacagcaaactctgcctcccaggttcaagtgattctcctgcgtcagcctcccaagtaactgggattacaggtgcacaccaccaagcccggctaatttttgtatttttagtagagacggagtttctctatgctggccaggctggtctctaactcctgacctcaagtgatttgaccgcctcagtttctcaaagtgctgggattacaggtgtgagccactgcacccagccttcattgtacgtctttttgtcactagaggtacattttgttctaacaactaagaccccaaagcatccttttaagctttatcgttttgtaaaatggttaaaaataacattttccaccaatgacacagataaaattttaaaatgtggtggtattattccattcttattttaaggatatacatatatgcaatttgtatgtggatatgattttttgaatggtgaacagaaacttagtggtcaggtagctggatgcggtggctcatgcctgtaatcccagcactttgggaggctaaggcgggtggatcacctgagttcaggagtttgaggccaacctggccaatatggtgaaacccagtctctactaaaaatacaaaaaattagccaggcgcggtggtaggcgcctgtaatcccaagtactcgggaggctgaggcaggagaatcgcttgaacccaggagacggaggttgctgtgagccgagtccgcgccattgcactccagcctgggcaacaagagtgaaactccgcctcaggaaaaaaaagaaagaaagaaaataagaaagacagagagagagagagaggaaggaaggaagagaggaaggaaggaaggaagagagggagggaggaaggaaggaaggaaggaaggaaggaaggaaggaaggaaggaggggaaacttagtggtcagatggcaactaggggaggggaggcagaaggtaatttatttttcatttcatatccttcaactatcagaaattttgtcatatgtgtttatattttccactgtgtttcattgattctaaaatgccttttcttcataaccctgaaattggagtgtttcttacaatcattggtatgtcacatttttttctggcttgtggtaatgggttaaaatgataaattgtaaaatcaatgacgtcttaggaataatgaaaaatagtttaatagtgaatgaagaactatgtaattttaactgttcacatttactcttgggtatgtttccagaggataactgaacggggatagattttaaaaagctttatttaactgggtacttccgcaatttagtgatcaacttctgtgtacaacaaggtactgtcctttgaggatgatgggagaatacagggaagaacgaaatcgcctctgatcgtactttctccacggatgtaagtgtccgggctctagtgggggaatgatactcttcgtgcgaaattcacttttaaaaaaggcttagaaaactgaccaccggctctcagctgcagcttatcaaccacagaactccgaatatgcccgcacatcagtgcgctgggttaagaggagaaggggctgcggctgagctttcctagaaacagctatttggggacccatttcctgttggagtctgaaaggcgcacgcaccagagccagtggcaaagcaacttaagctgcaggctcctcctgcccacccccagccgcgacgcccctgggggcccttagcagactgccaagcgagtgtccccgccctgtgccttgaatttagccaaactcctttaatatcaggcctggcgcggtgattcacgcctgtaatccccgcactttaggaggctgaggcaggaggatcgcttgaggccagcagtgaaattagccggacatggtggcgcgcgcctttctgtggtcccaggtaatccggaggctggggcgaaagggtggcctgagccagggagatcgaggctgcagtgagccgtgttggcgccactgcactccagcctgggcgacagggcaagaccctgcctcaaaaacaaaacaaactgtaatatcgttcaagaacgtgtgaaggacacttggaaagttaccaggccatttctctcctgggcgcccgcggccctagaacgccggcctcaccggcagacgcgcgccctcctcccagatgcgcaggtgaccccggcgggcggcgcgggaaagggaagagctccgcgaggccgcgcgggggggaagcgggagaagccgctcttcctattccactcgcagtctgcgtgtgggggaaacgagtgcccggcgtatgaaacgcctaacttcgcgaaataaagagagacgtataaaagttcaagaattctgtccagactcaagggccctttctcatttaggggcaaccctgtcactacatcataaacttttaaatccgtgatccccacgttacaaaagcagaagtcccttttagacttttagcgaaaactgaactttgccggtgtcccacacggagggagggaggacgggaggccacgccagggctgcggggctgcagggcgtggacgcatcctggccggggcgtccactgtcgacgtctccacatcccaggagggtcgagacggccgcgggaagcagcctgcgagccgtgcggccccattccaaggaccccgccagtgtgagtcactgacagcttcgcgaatcaacggtgcccagaggaaaaaacttctcatttggacttctaggcccggcagtggccggcggccagggccccccagtagggcagggcggggcggggcggggcgcacagagccagaggggcttgcgagcggcggctgagggaccgcggggagggggcgccgagcggctccagcgcagagactctcactgcacgccggagggcgcccttcctcgctcgcgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccaggtgagagatgcacgggaatggggtgcgcgggcggagggacgccgaggggagactgcgggggtcactgttgcgccttctcctcacccctgcctcagtttcctccgaaagccaaactggcatttgggctgagatctggagttttttccagtcacgtttaggtggggcgtgccacccccttcgcgggcccagccgatgcccctttggactcgatcttggagggtgcagcccgcctgccacggggtgttggatatggaggaggatggagcggaagccccctgggggagcctgcagtcctgcgttgcacttgtcattgtgtttctcccaggaccacccccaaaaagaaaagctctcacgttgctccaccaataaacgtttcgatctttaaaatataaagtggcgaaccgctgccgctgaagttttgctttgttggaagtttttttcttgcacattttacaggcgagaaaagtgatgtagagaaaagcccaggcagtcccttggcatgtttagcagagaatcagtaccagcagcccccggcccggccttgtgtccaggaggtgcgcagggtgcgagatatatggtgacaatagcagaggctccgcgtggtggcgggggaggggacatggagaggattttgttgttacctagaacccattccttctaagtgagttgaagagagagatccctccccaggaccgggctccctcgaacactgtgggatcccagtatttcttaacgagatttctgatccactgcaagaaggttgctcccctagaatattttccccactagtagtctatttttaagtatctggccacttgaccaaataaataaatttgattaatttatttggtcaaatattttctgtatccctttccccaagagcagcacagatgagttgtttttagcctgtaaaggcgctaattagaaagtgagaaaagtgtttttgaatttcctaataacaatagtattttataagctttgagccattttttttacgctgaaagaagttctagcgggttttcttgttatcgctaaaagaatgtgcactctatattgctcccacactcaaaaaaaagtgtagacacatcaagattaagaggtgacaaagacatagcatgttctcgcctctctgtctttgttcagggtgagttttgagatgcttttgggaaaactaagagctccagactggggcccagtgtttagcagtaactagcctgcctgcagataagtgagcattgttgccgaaagtgtttgagagaacaccgagaactcctgaaaaattgtttgcgatgagatatgatttcacataccattatgtaatttgcacaatgtagtttgaggacacgctcttgagaatccagtgttttgtttgagatttggatcatggggtggagaacagagcttatagaaatgctgcaccctttctcacagtggcctcccagcaaggtgtgtagcctcattagggagtgaagtcaaagcgtactggtttctgccaagcttcttacatcctcatggcaggagtggtgcatgttaatatggacagtgctggtgtagacagaaaggcaggtggatgaacttggctagtttatcaacactggattctggaaccactttgggagggaaagaagaaaggagtatgatagaggaaaaggagcgcttgctaagtgccatattccatgtcaagccctgggccagaaggaattttcacttggattgtctcatttcaccttgtcaaaacaccttgttaaggtgggtatttatccccttttgctgattctgcaactaagacccagagacagcggctaagcaagtggtggcgggtggggcagggaaggggcagtccacccaccctgggtgcaagcaattaggaataagtggggctttgtctttagaaaatttaaaatcactaataaaatcaacccaagataggtttactttctattaccaccatgcattgacaattctaagcattgtctgtcataaggtagtggtgctgggactctgaggcatccaacagtgcctcccatccttgaaccgccaccgctgtgatagagtttattgtccaggattaccagctctgtgtgccaagaggggcggtgaagccctcccagggctggccctgaccaccaagctgagccttcctccagcacttcccgactttttgttcccactcattttggcatttcctgccttgtcactttgtgtgtgtgtctcattctcccaactaagattataaagttttatttatccccatggtgactaaaacaaatgttcactcagcagatagttgttgagaaatgtgtaaattcatcaaccagtttacattcgtctagacaatttaagtgagatgatatgtgatcattaaaagggccaacatccaagagtaaaaggtgatgtttataaattttatggggctctagagggttaaagtgttcaagaatagctggtggtgactatgacagagagaacttggtgggcaattccacttgctaccctcctactcacagagtcaagcccaattctctggcatggaatgaagtgctcctccccttgcaggagggtccccagcccctctccagccatctcctattactcaccctccagttcacccagccccatcctctagatcctcccttcaaggagctatgctttctctggcttctgtccgcatgccactccctctggccagaatgccctccccatatcccatacccgccacgttcatgtttaattaaaaacagctaccctctgtggagtactgactacagctgacatccttcttagggacgttacaatactatcttatttatttctcacaacagccctttgagtagatgtcatcctcattttactggttataaaacagagacccagaatggttaagtcacaagttgagaaagaggtggaattgggactgggtgcggtggctcatgcctgtaatcccagcactttgggaggccaaagcagggggatcacttgaggccaggagtttgagaccagcctgaccaacatggtgaaaccctgtctctactaaaaatacaaaattagctgggtatggtggtgcacacctgtagtcacagctacttgggaggctgaggcaccagaattgcctgaacctggaaggcagaggttgcagggaactgagattgtgccactgcactccagtctgagcaacagagtgagactctctctcaaaaaaaaaaagaggtggaattgggagttgaccacaggcctgtctctccgaagtgcaggctttctctaacaccccctatagaaaggaagccatctagactcccagcacctcttacagtagagaagtaaccccactgtgctccctagtacagtatggatttacctatttttgataattcatcaaaatatagaagcaaagtctgtgccctatcgccttggtagctcaggcccagcacagggaggtatttagtgagcatttatgcacggactgtggtattctctcatttactttcgctaacagatgataaggcaggctctgaaaagatccctgctcatgaatacactaattaatcagatgttacaagagatattgctagtaaacctaaacagaaagacagaaaactgagcagtggttctaccgtaagcagaccagaaagctctataaagcctgaaagtcagatttcttatgagtcagcaagtaattttctgccctactatctatctatctatctatatctaataatttttagtggctttgcctttatttttatagaacataccagcatagcaggttctcagggtctgggtgcagtggctcacacctgtaatcccagcactttgggaaccctaggccagatgatcgcttgagaccagcctaggcaacatagtaagaccccatctctattaaaaaaaataattaaaaagtagccaggcactgtggtgtgcacctgtagtcccagcacttgggagactgggaggatggcctgacccaggagttcaaggtggcagtgagccatggtcacgtgactacactccagcctgggcaacagagtgggagagacgctgtcttcaaaatatttaataaatgaaaattttaaatttaaattaatcatttaaatttaaaaaataaaataataaaattgaggtagaattcacataacataaaattaaccattttaaagtatacaattcattggtatttagtacatttacagtgtacaatgtacactgtaaacccctacctacttccaaaatcctgtcatttccccgaaaggaaaccagtaagcagtcagatcccattctcccttcccctacccccaggaaccaccagtttgccttttttctctatggatttacctatttttgatatttcatatcaatagaatcatataatatgtggtcttagtgtctggggaacttaactttaggtgggttaaagttgttgttgctgtttttttgagacagggtctaggtgtcttactcaggctggagtgcagaggcacaaatttggctcactgcaacctctgcctcccaggctcaagctatcctcctaactcagcctccagagtagctgggctacaggcacctgccaccacgcctggctaatttttgtatttttagtagagacgagattttatcacactgcccaggctgttctcaaactcctgggatcaagcgatccacctaccttggcctcccaaagtgctggaattctaggcgtgagccaccatgcccagtctttaactagttttcgtgagcacctaggctccccttccattgcggatactcacaaaaacatccttgttagaagagttattaggactcagggccttggtttatttttgactatgatactagtgttgaggactccatagttttaccattcataattttctgtttgtttccttttttgcgatttctttcattctgcctttttctttctcttgcttgtgcctaaaactgtcgtcataaatagctctgtctatatactgagaatttttttctgggcatgagctttcacttccccagataccgtctcccacactgaccttgtcgtggtacttggaggaagccacttaaagggccctgacggtcctatatacattatttgctttcaaaagtaagtggccttttgaaacaacaggagtaatctgcaatttgcccttgaaaacacatttatataactttaggaaaagacattatgtaatctatttatatttcaagtctatgatgaattaaaaatcaggtattatggtattgtagaatagtgtttaccagtacagtattttcctctttcgtaaccaacagtaagaactgtagaaacaacacttcacattctgatatggtagggatgtgtgttttcaataaatatgtgtggacaatcatagtatatatgtaaacatgaaacaaaagttttaccaaacagtgctcacctttactgcattgtatgcattttgatattttccacaaacagtgctcacctttactgcattgtatgcattttgatattttccacactatattctatttttaatgcttattgcaatcttgtgaattgatttcatagccattgctaaatctataacataatttaaaacatattgcagcagctacatgaatattcctatggtagccaaatcaaaggccttattagcttttcaggaagagttctgttttcctggaactgttgtttattattgttcttatcatgtctagaacctaatttatttgagttcagatatacagactgcagaaggacttgggcagggttgggcatggggacagtttttatagtacaactcacagtattttgtacaatacaaagctgtccccatccccagccctggggaggaattggtgatcattgacatccttgactgtgaattagttttcattttagctagatgtcttgttggagagtagagatcagcattcccaagacagagagctcaggacctgtaacttttcttggagaacagacctggagaaatggggaaagccggggaacctgagtagttcccgggcaaggcctgctagcatcctcaccccacgtcaggctctggcctccaggctgctccaagcaagagcccacacactttccttatgtagtcttcatgcctgctgtggcgttgggtacacctgcgtttactttcctgcaacttcccttctcccagcttcctcttaggcttgctttcctatgcttccagaggagtacctgctccaggacatggaatgggaggagaggaggcctctgatattggcagcttcttctgaaccccagtcagtcaagaattctacctttaggttgggcacggtggctcatgcctgtaatcccagcactttgggaggctgaggcgcagatcacttaaggtcaggagttggagaccagcttggccaacatggtgaaaccctgtctctactaaaaatacaaaaattagccgggcatggtggtgcacaactgtcatcccagctactcaggaggctgaggcaggagaatctcttgaacccaggaggcagaggttgcagcaagccaagatcgtgccactgcactccagcctgggagacagagtgagactctgtatcaaaaaaaaaaaaaagaattttgtctttaattctgctttttctgtagcagagatttttgttcacttactgctcttgcatctgctccatctagaacagtgttttaaagatgtatttttctgttttgtccttgaatatctccctgctatctctctcctgtgtgtaaggaccaagttgttggcatgtgtggttggtgtgcagccaaagtcagtaggactccagaattcccaagctttgggcatcatcacgttaagctagccattcacatgtccacatactgcctactgtagctaaaaggatgggcagattcatttgtttggtgacatgcaaagagaaaaagatggtactcttttagaagtaggtcatgaatcacaagtttttaaggagagaatagcgtggagtggtcaaaaggtatgacctttggagctgggcagacctaggttcaaaccctggctcctctacttcatagctgtgtgactttggattagttacttagcctctctgtgcctccatgttgtcatttataaaatggtagttataatgctcatgtcatagaaatgttagaattatatgaactaaggcaagtgaagtatctggcacatagtaggtgctcaaaaagatggtaaggttttttcatacaccaatgcttccatattccagaaaagcttttgaagagttgataccaaataaattatctaaatataagacaatcttcacacaagcatgcaagaacattttccccttcagaactaggacaaaagaaaaaagcaaaaacccttgcccttaacttctagtggcaaataaacatgcatacagtatttgtttgtttttttaacttttattatgggatttttcaaacatacccaaaaatgaacagtatagttactccccatacccatcatccagcttcaacattatttacatgtcaccaatcttgttttatctaaaccctcaagtttcctcctctcccaactgtataattttaaagcaaatcccagatatcatattatgtcattcataaaaacatcagtaagcatccttagagattagaactcttttttccacataaccacaatacaattataatacctaaaaaatgaacatttccttctgtttttttgtttgtttgtttgttttgagacacattcttactctgttgctaaggctggagttcagtagcacaatcatggctcatccacagtctcaacctcctgggctcaagcaatcctcctgcctcagactccaaagtagctgggactacaggcacacaccaccacgaccagctaatttttgtatttattttaatagacataggattttgctgcattgcccaggctggtctggaactcctgggttcaatcagtcctcctgcctcggcttcccgaagtgctggcattacaggcgtgagccaccgtgcccggcctaacaattccttaatatcatctgataatcagtcagtgttcatatttaccttattgtctcataaataccttttaacagttggtttgtttgaatcaggttcaaacaaggtccaccattacattttaatctgtaactgcccccccaccccttttttattgctatttatttgtcaaagaaactaagccatctgtcttagttcttatttgtcaaagaaactaagccatctgtcttttctacatactggatctggctgactgcgtcttcaactcatggatcttaacatgtatgaaatgtttcaattcatttccatcattattcttttgatggtcaaattggtgatcaacatgtcacatctttggtcagtgggagccctttgagattgactccagcgtctttttgacctaaccctgatattctttgaagatgttcaatgttcatcttgtgtatttcctaccccagatctggaactagtcatttctttaagaagccccagttcttttcattggaaaatggtgtttgtttgaatctgagggagtaaaacattccagtaatgctggtgttttccacttgacagagttagtgtgattctgttattttcctgtcctcctcttcatttctctttagcctgtagtgttgtttcaactcttgtgctctgtgtgggaatgtgagcaaagtcctgggacttctgctttgttaactctgaaaaagcatgagccccgaagggcagaactgtgagtcaaaaccatgtgtgtcatggaatgctggtgtggtataaatcccaggatcaaatgcgacattcagagatcctctagtcacccctctgcttccaggacagatctcatcacagtcagaaaacgtgttgcctaactcactaatttttaaaaatcgccacagttaaagagtccgtatttaaactatttaataatttgctgtattcgataacaaaactactctagagcaatttagaagagcctaaattaagtgaaacttagcaaatcgtatgagaactgaattcaggacctctgctgccttttttgtgaaaccatagcttaaccaaaaaaaaaaacagagatgaatgataagagatttgggcaccttcacaagcactttctccttgacctgagttgtgctaggactggaggaaaagcgagatacttaaactcaaatttcagcctaagggtcttgagctagttggaattgtctagtcaccttgcattggttttgtcctttctttgatgctggtatatactacattttttcttttctttttttttccgacattctttaatttcacaaaaaccagaatatcaaacccatagtatcaagaaaaggtaacaccttaggcagcgatatttaaccaagggattatacattcttcctgagctctagcctataaaaatttcatgtttccacaagtataatgttcctgtcggaagtaccgtctgcctgaggcctacccagagaagatgttttttaaaacaagtacttactgcctaagtactaaatacagagtaaagtctagtgacagttttattttcagactaagtgatagtatctgaagagcttagttgtatttattagttttcacattgtgtcagtctctcaggtgtcatcttgattcatgtatgtaagtatgcatgttcatgtccactttttcccctctgtgcatcacaaaagcccataatctggccaggcttccaaaactgcagaggagaattgcattattttaaggttccttggccaggtgcagtggcttatgcctgtaatcccagcactttgggaggctgaggtgggtggatcacttgaggccaggagcatgagactagctggcaagcatggtgaaaccccatctctactaaaaatacaaaaattagctgggcagccgggcgcggtggctcacacctgtaatcctagcactttgggaggccgaggtgggtggatcacgaggtcagaagatagagaccatcctggctaacacggtgaaaccccatttcttctaaaaatacaaaaaattagccgggcgcggtggcaggcacctgtagtcccagctactagggaggctgaggcaagagaatggcgtgaacccgggaggtggagttagcagtgagccgagatagagatagcgccactgcagtccggcctgggcgaaagagcgagactctgtctcaaaaaaaaaaaaaaattagctgggcatggcggtgcgtgcttgtaatcccagctacttgggaggctgaggcaggaggattgcttgaactggggaggcagaggttgcagtgagccaaaatcgcaccactgctctccagcttgggtgacagagcaagactccatctcaaaaaaaaattggttcctctagatcagcatttttgcatatgcatgtttttgtgatattaaagtgccagaaccacaaacaaaaaaaattaaaaataaaaaaaaatgtttaagtgccagaagccattcattcttttctttcagcacccacacactcattgtgatcttgagaacagcctcacatccacagggtctgttggtaccaaggtcaggcttctgtgtgactggggcaaggtgaacacagagtaagttacatgcattgcaaaggtaagagagtgatacttccagaaaagattgtgaattcaaaatttgatttatagctctgaaccctagagctatataatatacaacttgttcattccctcattgtactaaaaaactataaacattgctaagtaggagggaagatgaacctagatttccttttaacttaattaagtgagcaaacaattgggtataaaagcacactacatggaagtgggagaggaaggataatagtaatttcttaaactgcttaatcgttatggtttccaaagtgaatgtatgtcctgtttcacacgggatgctccagttgccagatttgtaggccagacaggaattagaattccattttaatgattctgagcttaattcagagaagttaagtgatccctgaacagagtcaatattagaatacaaatatgtgcctaccacatgcagggcacagggtactggaggttcagagattaacaggaacagttcttacccttaaggatcaatgtagacacaagtgtgtattcacattcatcactggagacattcattccttccctgtgacagatctcctgccaggccaccccttcattgtctggagaccctctcccaactttgcttaggtagcttgacctcaaccctacactaccaggctctgctctgctgtctctgagttggtactactctagctttgctcttcattttggaaatagatgccaacatattgtattttattttctatttctagaatttccacttggtagttctttgctgatatttcctattttcagttcatttctataaaatatttttctttttttttttttttgcacatggttgtaatacattcttcaaaatccttatctgctaattccaacatctgggtcaacttgaggttggtttccgctcactgtctttttacttaagactgggtcacttttttttttttttttttagagacagagtctcactctgttgcccaggctggagtacaatggtgtgatgatacctcactgtagcctcgatctcccaggctcaacttgtcctcccacctgggcttcccaaagtgttgagattacaggtgtgagccaccacacctggcagccccctttttcttttatttgacaaaaaattatatatatttatagtgtataacataatgttttgaaatatgcataacttgtgagatggctaaatcaaacttataacatgtattacctcaaatacttatcattttttgtggtgagaccacttaaagtctactctcttagcaattgtcaagtatacaacacattgttattaactatagtcaccgtattatacaagagatttttctaactaattccttttaacagaaattttgtaccctttgaccaatgtctccccagtctaccctacccacccatccaaccccagcctctactaaccaccattctcttctctgcttccatgagttcaactgttttcgattccacatataagtgaaatcatgctatatttgtctttcggtgcctgccatatttcacttaacattatgccctctcggctcatccatgttgttgcaaatgacagaatttccttcttttttaaggctgaatagtattccactgtgtatatacatcatattttttattcattcattcattcatcagtggatacctagtttgattccataactgggctattataaataattctgcaatgaacatgagattgcagctattgacatcctggtctttttttttttttttttttttttgagatggggtctcgctctgtcggccaggctggagtgcaatggcgcaatctcagctcactgcaacctccgcctcctgcgttcaagcaattctcctgcctcagcctcccgaggagctgggattataggtatgcgctaccaagcctggctaatttttgtaattttagtagagacagggttttgccatgttggccaggctggtctcaaactcctgacctcaggtgatccacccaccttggcctcccaaagtgctgggattacaggcgtgagccaccgtgcccagccagcatcctaattttatttcctttggatgtatgcccagcagtggaattgctgtattatataatagttctatttttagttttagaggaaccttcatactgtttttcgtaatggctatgccaatttaaattcccaccatcagtatagatgggcttcctttccccgtatcctcaccaacacttgttatctgtcatctttttgataatatccattctaacaggtatgaagtgataactcattgtggttttaatgttcatttccctgattagtgatgttgagcattttttcatatacttgttggccatttgtatgtcttcttttgaaaaatgtctattcagatcctttgtccatttttaaatcaggtgatttgttatcttgctgttgagttataggagttccttatatattttggatattaaccctttatcagacgtatggtttgcaaatatttgctttcatttcataaattttctcttcactgttgattgtttcctttgctgtgcagaagctttttactttgatacagtcccagttgtctacttctccttttattgcctgtgcttttatggtcattataaaaaattactgcccagacaatgtcatgaagcttttcctctatgttttctgctagtagttttacagtttcaggtcttatgtgtaaaccattaatccatttaagttggttgttgtatatagtgtgagagaagggggacaagacgtccagagtttatcacttttgtgtatattggttggatctggtgataacgatttggctctatgtccccacccaaatctcaacttgtagctcccataattcccatgtgttgtaggagggacccagtaggagatgattgaatcatggagacgggtctttcctgtgttgttgtcatgatagtaaaatgggtctctcaagatcagatggttttaaaaacaggagtttccctgcacaagctctctctttgcccgctgccatccaagtaagatgtgacttgctcctccttaccttctgctatgattatgaggcctccccagccatgtggaactgtaagtccaataaaccattttcttgtataaattacaggaaaaaagactctggattttgttatattccttcaaagagtgttggtgtttttgctttagcagccaattaatttggttttactcaagcagcagactctttctctcttgagcagaagcttaaatatcacttcagttcttttatctttagcagaggtgcttctcatctttcctacaaatgcatagttcaagggtcagccaaaccctaggacagaagttatactgaaatttagggctccccctctctgactttttcctttccaggattctctcctaactttccagtgactgtgattgccctgaactctgtcctctggttctgtaggccaaaaagactacggattttctatctgggttttagtcaccttttatgttatataggcactgctgttatataggaaaaaccaaactattttccccaaactgttttctcttacccagcacttcactcaatccttctgacaccgtatgtctggagcttgtttctccacataccaagcaaccaattctcctgcagattctccagtggacaccagctgggtatccttgaatataattcaattctggacactatctacctctaatataactcaattctgacactatctatctacctggagatagagtcagattccacagattaagggctcagtttcacaacgctgccttccacttcaaatggcagtcataagtctgggcctccagacttctgaccacactatacattgggagttcctaaggccccctgctcagattcgattaatttgctagcatgattcacagaactcagggaaccactttacttacttttatccattcgttataaagaaaattacagaggatacagatgaacagccacatggtagagatgcatagggcagcgattgtgggaaggagcacagagtttccatgccctctcttgggcactaccttccaggaacctccatgtgttcacctatttttggttgatactccaaaaaccttggttggtctggcatgagtggccaagaacatcggctgctctgctgacctgctcaggaaagaagtagaagaatgactgagatgatgggtaccttgtgactatgttaggagataaccccagggattgtggtttggacccagatatagtgagagatttctacattctcctgtgtaagcaaactaaagactgtagaggaaaactactgtcatggacattggccgtagaattgggagtcctgaatcccattattaatttgcctctaactccaaaacctttaagaaatcccctctggtggcacgtgcctgtaatcccagctactcacgaggctgaggcaggagaattccttgaaccccggaggcggaggttgcggtgagccgagatcgcgccactgtgctccagcctgggcaacagagtgagactgtgtctcagaaaaaaaaagaaagaaaaagaaatcccctctactttttttttttttttaatttctatttatttttattttttgagacggagtctcactctgtcgcccaggttggagtgcagtggtgtgatcttggctcactgcaacctctgctgcccaggttcaagcgattcttctgcctcaggctcccaagtagctgggattacaggtgcatgccaccgcacctggctaatttttgtgtttttagtagagatggggtttcaccatcttggccaggctagtcttgaactcctgaccttgtgatccacccacctcggactcccaaagtgctgggattacagacgtgacccactgtgcccagcctaaatcccctcaactttctatgtggatttttccattgaaaagggacaggtttcatgggatgactgcagactaaatggagaaagtgtgcacatgaaggtatgcggaggaaagagaagtcatggaagctgggagtgatttgtttatatagacagtggctagcgtggaaatcaatgattgatccctttatgtcaagtactcagcctttcctaatgtcttcagggtagatctctgaaaacctatcattcacctttgtccctttgaggggcagagtttaggaagtattgcttatatcaagacaaatgtttcacagtattttgagttggcttattctctaataaagtctatttgtgcattatctgctctttaccacccactctcctagtaagaaaacataaacaaaagtaaaatatgctctctgcttgtcgcttttgccttgttgatgcgttcactttttacatttaaaatttttttaattttatttttcagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctcaaaaaataaaaataaataaaaaataaaaaaataaaagagcaaactatttccaaataccatagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaacaaattagtattatatctttctggtcctggcacactttaagggtttaactgaagagcatttaatgaagaggtgatttacaaaggtgtagacagggttaagggaaccaacggggactggtgaagcaccccccagagactagcaatcaggggaagccattactgccaaggcccaggtacaggagggaacacactgacgcctctccctcaccctctgatctcttgggaggcctccccttgatcctaatcttaacccaatacccagagtgaagtagtccataaagatcagcttcctttgccgtggagaagggatctggaagaacaaatgcaaggaaaaaataaaacaaacagcaccatttctgccaaagacattgagtgattagctctctctctctctctcaatcccttcttaagaaaatttaagcttattgagaatatattcaaatttctgagttatagacatcatgggtagtgtctgcagttcttccctagtgagagagaaattaaatgtcagagcagaaaggaaatccgtaaaatggctgtgctgtcttctctggctgaatgacagtcctttgctgtctagcactccctcaggcagaagggaggaggggaaatttaaagcaaaatgactagtacttctcaaggttgaaaataaaaaaatttttgataaattatttctagagtcatagtcaatgaaaaaattatttcaactaaacaaggattttgttaacatacagaatttttataagttaacacacaagctttttaagtttctaaggcctggacttttcacgtgtgtttcaaggaatagattgagttcaaaaaaccttaaattttgctaacacaaaaattttttttgtccaggcatggtggctcacgcctataatgccaacactttgggagactgaggccagaggatcatttcagaccaggaggttgagaccagcctgagcaacatagtgagacgccatctcaattaaaaaataaataaataattaacctggcacgatggcatgcctgtggtcccagctactcaggaggctgaggtgggaggatcgtctgagcccaagaggttgaggctgcagcgagccatgattgcaccactgcagtccagcctgggcaacagagtgagaccatgtatccaaaaaaaaaaaatgttttttccaccaagctaaaaatagcatttttaaggaaatggaatgcttggctattgaatatacacttggaaaattttaggttatacttctgaatttaagaaattttaaaaactgtttgccgttggcatgtctttgaggaagttgagctacagaagcaagtggaaaaggttaagcagcattgatgaccaagctatttaagtttctggggcctggaccatccattagcagcttatcttcagccaggtgctgtcgtgaaaattaaggggaaaaacagttcaccaatggtaatttcctggcataattagcctgttatgtggctatgccttttgaaactactagaccaaatgtgtgtgaagagtaattgaccacaggataaacctaattgtgttttgtgaaggaggtgtggttaagtgagctgcaatgtgagaagagaggagaaattctctaatgcaattattctcagagttcctgagactctcaggagatctgcaaggtcaaactctcttcaaataccaagatattatttgccttttttggtctgtttctctcataagtggacagatgagttttccagaagctacacaacatgtgaaagtgcaacagattgaatgcagaagcagagacgaaaatctgactgtctcctattacaccagtcattaaagagattgcaaaaatgtaaaacaatgcaactctcctccttaaattattgttttgggaaaaaattttgaaaaatatagtatttattttaacatgtaatgggcttattgtcatttttagctgaaatagatattttcaaaagttctccattttaatgtctaatatggaaaatatcagtagataaaatcattggcagcagggtgcagtagctcacacctgtaataccaacactttgggaggccaagccaggcggatcacgaggccaggagttcgagaccagcctgggcaacataggtaaaccccatctctactaaaaataaaaaacttagctgggtgtggtggtgcacatctgtaatcccagctacttgggaggctgaggcacgagaatcacttgagcctgggaggcgagggttacagtgagtcaagatggcatcactgcactccagcctggacgacagagcagagcaaggctgtctcaaaaaatgaaaaagaaaaaaagtcagtgatgtgctgctaagcaggatctccacaaaaagaaaaaaagcctgatctggcaaactagcatttgccaattttgatggtgtgaatactcccttcttttccagtttcaagctcccaactgtttaacagttggcttgacaaatttcctgaatattgaattcttgtgagcaggtacaagttgactccagcacaccaatggatgcaacccacataaacaaaggctctttgctggtcctcaataattttaagtgtattaaggtgttctgagcaaaagaagtttgaaaaccactgcccttatccaagatgtcccaactttattgacttgaagaaaacagataaactggtaattattataaaagcataaaagcaaacaggggtaaagagttggcttagagctgcaggcaccactctgggtttctggctgtttcagagctgaggggttccaagtcttggagcaagaaactgattcaacatccaggctcagtggctcacgcctattatcccagcactttggaaggctaaggcggatgaatggtttgagcccaggagttcgagaccagcctaggcaaaatggcaaaaccccgtctctacgaaaaatacaaaaattagccgagcgtgatggctcatgcctgtagttccagctacttgggaggctaaggtgggaggatggcttgagcctgggaggcggaggttgcaatgagccaagatggtgccactacacttcagcctgggtgacagagtgagaccctgtcacaaaaagaaaagaaaagatactgattcacgtcatcaggtatggtgtggtccacagaacaggaagctctgtgtgaggtctgattttcagccacctgctgtgtaaaggaaagagagaggtgcttgctgagcaaagtttcagaccagaagaccaagagacaattcagaacagcagcagattctacccatggtggcattcctgtaaagtgaaactcaagcgccaagtttgttgtcatggggactgttgattgcatgctagtcttatggaaacacacggaaaaccagaggtcaaattcagtagcatctcagaattcagataacacagcatgtacagtttcaacccagcaggctgtgtgtttatcacttcaggaaatgactcataagcagtaaggagatgagctttgaaagctgcatctggccagggcacggtggctcaccgctgtaatcccagcactttagtgaggccgaggcgggtggatcacctgaggtcgggagtttgagaccagcctggccaacatgtgaaaccctgtctctactaaaaatacaaaaattagccagatgtggtggcacacacctgtaatcccagctactcaggaggctgaggcaggagaattgcttgaacccaggaggcagaggttgcagtgagccgagattgtgccatccagcctggatgacaagagcgaaactccatctcaaaaaaaaaaaaaagaaaagaaagctgcatctatagtagcctgcatggtggcagggccagtctggctgttttgcctatcttaatgactacatctgcaggtcattttggtgtgctgctatgcgacccatccaaggaagtgaaaacaccacgaagggtgggctgtccaatactgagatgcattcgtgagcaaaaccataatcatttgatatctatttttgttgttttgtttcctatcctgggatatctagttgctcttgaaactagctgacacatattttaaaaaaaacaagacaaataatatattcccatcctccagaagctaactggctttgggatttaatcctaatacttaatgtttagttaggaagcacaaaatttgaagacctcagatttagaattttatcagctctgccttgtaacaagttttagaaactaaatcagttggccaggcctggtggctcatgcctgtaatcctagctttttgggaagccaaggcgggcggatcacctgaggtcagcagttcgagaccaggctggccaacatggtgaaaccctgtctctactaaaaatacaaaaattagtcagacatggtggcacgtgcctgtaatccagctacccgggtggctgaggcaggagaattgctggaacccgggaggcagacgctgcactgagccgagatggcaccactgcactccagcctgggcaacagaacgagactctgtctcaaaaaaaaaaaaaaaagaaaagaaagaaagaaaagaaaagaaactaaatcagttctcaactctggttgcgcatagaatcactggagagcttctaaacaattccagtgccaatctctgggggcgaggcctggacattgatattgttttcaagctcctcagaagattctgatgtgtaaaccagggttgatactaagaaaagaaaaatccctcagcagtctgagctatgtgaggtgtgcaaaatttattaggcccagagagacgggagtagaggacttcagtcacacccccggcacataccctccccctacccaccaccccccatgcctgtgggcaattatttaaagtcattttgttcctggtggtgtggtagctcatgcctgtcatcccaacactttgggaggccgaggcgagaggatcccttgaggtcaggagtttgagaccagactggtcaacatggtggaacccctacactcctaaaaatacaaaaattagccaggcatggcagcatgctcatgaaatcccagctactcggggggctgaggcaggagaattgtttgaacccaggaggccagaaggtagaggttgcagtgagtcaagatggcgccactccagcctgggcaacggagagagactccatctcaaaaaaaaaaaaggcattttgttcctgactagctacattccctgttatcttcatgttcctggaatctgtgatacaaagaacaatgtgtatccaatcaacagcttatgttattttaatgtaaattttgataaacaacttaggaactgcctcttttcctttataaacattcacatgcaactgctgctaatcagattgtatattcaggacaacttgaatatacacttcaatatacactgggttgcagtcctcaagcttggcccaaataaactctctacttatattaattttgactcagcttcttccttttagatcaacaataccactgtttttgaaaagtgcttcttagcttatatactgctggtgggaatgtaaagtattagttcagccattgtggaaagcagtgtggtgatttctcaaataatttaaaacagaattatcattcaacccagcagtcccattattgggtatatacccaaaggaatagaaatcattctaccataaagacatctgcgcacaggtgttcactgcagcactattcacaatagcaaagctatggaatcaacctaaatgcccaccaatgatagactggataaagaaaatgtggtacatataccccatggaatacgatgcagccgtaaaaaagaacaagatcacgttctttgcagcaacatggatagagctggaggccattatcctaagccaactaatgcagaaacagaaaaccaaataccacatgttctcacttataagtgaaactaaacattgagtacacatggacacaaagaggagaacaacagataccagggcctacttgagggtggaggatgagagggagaggactgaaaaaccacctatcgagtactatgcttactaccagggtgatgaaataatctgtacaccaaacccccaagacacacaatttacttatataacaaacctgcacatgtacccctgaacctaaagtaaaagttttttaaaaaagaaaagaaaatagtgtttcttggccaggtgcagtggctcacatctgtaatcccagcactttgggaggtgaagacaggaggattgcttgatgccaggagtttgagagtttgagaccagcctgagcaacatagcaagaccctgctaaaacaaatgtaagaattagctgggtgtggtggcacacgcctgtagtcccagctactcaggaggctgagacaggaggatcctttgagcctaggagttcaaagttacagtgagctgtgatctgtctgcttctcaaactttaacctgcatacaaattaccagagtctgctgcaactggtccgaggctgggtctgcctgtgtaacaacttcccaggtaaagttaaagttgctccttttggactatgctttgaatagcagtgctctcagagatagccccgaggcagaatttggctaggttgcaggtccagggatccagaaaatcaattctcatattcttaaaatcattttctgagacaatttttttttattctgagaaaattggggcaatttttaatgtagtggcagcatatgttcttaatcaaaatttgttgtaggtgatatctatcttgctgtatgcttcctctcctctttctcccttctttggttcttttctagggaaaaagatagcttaaatggctctaatcttatacataaaaccatttcagaagacactgggggtttaaagtggcaactcccattttttaaagatagtgcccggcagatagcggcagcgcctggttaccagaaagcaactgtggatatttttcctgtctctgggtctggctgaaaaatggtgacctcagggaagcactagggtgctacttagcattcaggagcttcagtcttgatggagctggaatgagaagttttgcaaacccaaaggcaaatgagtcagcccagggatcatcatcagaggatccatgattccactgtgcctggggaaaaccaaagattttgttaatcaactctgggaacacatttacagcacattcagtaaacttggagtaaattcgtcattatagaagccctcttacaagttgattgaaaaaactaaatgatgaaagaaaaactacaatttgttagccaacgtgggaaaaaatgttacatctcagcgataatccaatagctgcaatttaaaacaagataacaccggctcgtgtccaattaacaatgatctttttctatgatggctaaaacagctccctaataagtattacagaaggaatggaggaaataaggaaaataatataaataccagaaagggtaagataatgtcggtggacacactttaggaaagcaatttgacaaaatgtcatcatccttacatgttcataacctttgacccagttgtatgacttctgggaatctatcaagaaataattacaaataacatcaaaaaaagtaataggcttctggttgttaatagcagccttatttgcatgttagcagaagacaaaattcctctagatgtgtaattttaaaggacttctccagagactattataccctttaacaatgagacgttttaagtgtatgtaacgacacagagcagtgcttataatgtttaattttttaaaaaataagatgcaatgatatacaagcagtacaaaaccaacaagatggggaaaaatagatctaagtcaaggcaaagactaatgagaaatataccaagatgtttaaacttgcgttttggtaattgggtcattttttttcctttaaagtattttctacttctctctttcctgagtatgtactgcctctctagcaaaaaagcaacccacattaaaacaaaagtaaaataatctgaaaaaacaaacaaatctttctgaccatctcctagccacaattagtattttgtgcctcaatatattattcaagcaggaaataatggtgttaggaaatcatatgattctacatatagttgacatcttcaagattctcccaaaatatcttgtggaactctgaaattctcaaaaacataaaaatatctttagccatggccaggtgcagtatctgacacctgtaatcccagctacttaggaggctgaggcatgaaaatcgcttgaaccctggaggtggaggttgcagtgagcccagcctgggcaacagagcgagactctgtctcaaaaaaaaaaaaaagaaaaaaaaaaaaaaaagtcattagctatactctgaagccagaaatgtttctatttgtccccagcagctaccagaacattcagtacagcattctgtcatcataaccagagcacgactttttactctgatagtctttatacttgtgccaaaagggctattcatttgttttcttctggaattcatatttcctcatcaagcagcaaatattatttttgcaaaacaaaacaaaaactttgactgattttattgcatagttatgttagtcctcttattcttgaaattaatgaatgtgtgtaacccacattctattattcagtattttaaaaatctgattaattatcccataagctctttttaaaacatacttgagctttatttaatttctgcattctttgacccatgttgttggatccttaatttcacttattcattttcttacaattattaaatggtctcttacatggtgagactgaagctggtatccataggcttgttgcttctgtataatgaaggcagcttcagtagtcgattgaaccacccagcagtgactacattcagtgcttctggaaatggagtccacaaaagtcttttgagctgcttgttataatgcaggtttttggtctccatcccggacctaaaaccagaatgtttgggataggacctggatcatctgcatttttaacaagagctgggggtgattcttatgcaaaccaaactttgagaaccatggatctagtttttacatgaaatctctaacctagtaaaccacagtttatttgttaaaatgctaaagtttttcagagttgacctgtatattatcatgtctctcagtaaagttatcggaatattagtattctttagctataaccccctagatattgaccctaaatatctgactatatccactgaaagatttaaccttacaaacaattgtctctatcacttactctgccttgtctctcctctcctctagaaatacaagtcaatgccctgtattcatgtaggatttttattgtattttttttaataggtaacactcatatggttcaaatttcaaaagaacaaaaggatatacagtgaaaaatcaccctttcctttctgtcatctcctggaagacaaccacagttaacagcttcttgagtatggtgttgaatctatttaaaaaacaatctggaaactcattattacttttggtaggaaagctaaaagagagtatacaataagctttttttttttttttgagacggagtcttgctctgctgcccaggctgtagtgcagtggcacaatcttggctcactgcaagctgcccctcccaggctcaagcaattctcctccctcagcctcccaagtagctgggattacaggcatgcgccactatgcctggctaatttttgtatttttaatagagacagagtttcaccttattggccaggctggtctcgaactcctgaccacaagtgatccccccgcctccacctcccaaagtgctgggattacaggcgagagccaccgcgcccacaataagccattttattttttaatggtatctttcagttttaaaaactccttttgatgtaaagatctcagtcagatatttgctgcataacaaactacacaaaaccccacaggcatataacaacaagcatttattgctaatattctgggatagccagctaggtagtcctgctgatgtgtctggggatctattggctgatttaggaaggcctggactgggatgactggggtgacttactgggttccatatgtctctcatcttcaagtacactaatcctggcacattcccatggcaatggccgaggtgttagagataagagaaagcatgctggacatcgggaagtgtaagactgggattggcatgttctcaccacagtcacagtctactgaccaaagcaagacacaggccatcccagttttaaggcgatggaaaaatagacattgcttctttagtgaaaggaatttcaatgtcacatgcaaggccatggctatagggagtgatgaagaatgaggctatcaccaaaatctactgtacataaatgactgaaaattcattacaataataatacttggcttagtgttcaagtattgtacttttataaaactgtccttgttttctgaagatttttcagttgtatatgtatatttatatttttggggcgtggagtctcactctgttgcccaggccggagtgtggtgacacgatctcagctcactgcaacctctgccttccgggttcaagggattcttgtgcctcagtctcccaagtagctgggactacaggctcccgccaccctgcccagctaatttttgtattttcagtagagatggggtttcgctatgttggccaggctggtctcgaactcctgatctcaagcgatccgcccaccttggcctcccaaagtgctgagattacaggcgtgagccactgcacccagtcatttatgtgtatatttctaaggtcaacggaagaattgtgaaaacatctcaaagacctgggacctacacccagccagtcagcatatacctttccactgtcatatgtgaaatgagaaaaacaggtggggtatggtggctcatgtctataattccagcactttggaaggctgagtccagagaattgcttgagctcaggagtttgaggccaacctgggcaacccgtgagaccttgtctctacttttatataaaaataaaagttaaaaaaaaagaaaaagatggataatgactctgggaaacaggaaatagaatgtttcaagttgtaccaaagaaaagtgccattttaattgaaaattttacctcctccagcaggggtgctgatgtactaacaagccactttcagaaaaacagtgtgatcaagtacagttttcattcttttatgtcaacatgttttttgagattatttttcgtattctatactgatttaaatctttgcctttttaaaatcagaatagtcatgcttacaaagtgacccttgaaaggtttatgaaacaaatgtcaggggtgattctggtttctgctttccatttaacttaatttcaattgctatttgcttattttaagaaataaactttgtttcttaagatgacactgactctgatgctatcagtagcctcatcctgatctttaaaaagtaaccttttaactagaattttcaaatactttaatatgcatgtggaattacttagacagttaacatttcttgacccactcgcatttagtcctattggctgataggcagtaactggaaaatgcagcatttctttctgatagacagtgagaagtaagacttcgcgacactcagtgatcaggccatagctcaatgagtctatgcatacagttaggttggaatctgttttagaggtttgagtatgagacgagcgtatcctagctgatacagtttgagctcgtccccatcaaaacatgatccccagtgtggccatgttgagaggcgggtgtattgggaggtgtgtgtgtcatcgggtggatccctcatggatgtctggtgccattctcctggtagtgagttcttgccctccagactagattagttctcctgggaatgttccttcaagagtgggttgttattgttgaattaagtttagcccaaagcggcctccttacatattttaagttggccctaaaggtttctccctacataacaaactgtaaccttactgaatgtgtaaacagactataacctattcttgtgccagtcactaagttttggccaattgaaggcagttagctgttcaaaccgtgttcaaataagccaaacaccgagctgtggccaatccagctgttactgtacctcacttctgttttctctatgtcggtttccttttgctgtgcataaatcttccaccaggcggttctgcgctggagcctctttgaacctatgtgctttaggggctgcccgattcgcaaatcccaaatcgctctttgctcagtgtaactctgttcggtgtaatttgtctaaggttttttcttccatccttataaaaccatgacgctggccgggtgcggtggtggcacttttcgaggccaaggcgggagaatcacatgagatcaggagttcgagaccaggctggccaacatggcgaaaccccgtctctactaaaaatacaaaaaacaaaaaacaaacattagccgggcatggtgatgcgcgcctttaatcccagctactcggaagtctgagacggggaatccgtcaaacccgggaggcggagactgtagtgagccaagattgtgccagagcactccagcctgggtgacacagcaagactccatctcaaaaaaaaatgaaagtaaaaaataaagccacgatgccctcggattttcctctcttctcgtgtgtctgcttcccctttgaccttctccaccatgttatgacgcagcacagaagccttcgccagcagcagaacagatgtcagtactaggcttcttcaacttcccagctggcagaactgtgagctaaataaacgttttctttataaattacccaatctcaggtgttctgttatagtggcacaaactatagactaagacactagcctcaatggaacaggtattgcctttgtaaattgctgaccactgacatcagcactctccataatctgagatacagaaaaatattgtacagcattatctatgcaacataatcctgtagaaattcacctcctcccctttgccctttttctttatgtttgtcactgatacccacaggcatagttcataggaactggtggccctctgagctcagccagaagtcagagagattttcaaatggaaggctatcctgacatggatgtgaagcaactggacatcgttttttttgtttttgtttttgtttttgttttttgaggcacagtctcgctctgtcacccaggctggagtgcagtggcatcattttggctcactgcaacctccacttcctgggttcaagcaattctcctgcttcagcctcccaagtagctgggataacaggtgtgggccaccacgcccggctaatttttgtattttcagtagagacggggtttcgtcatgttggccaggctggtcttgaacccctgacttcaagtgatctgcctgcctcagcctcccaaagtgctgggattacaggcatggaccactgtgcccagccaaaatgttatatatttttattgtgatggtagttacgtagctatatatatatttttcaaaattctttgaatttaaaatgggtgcagtttttgtacataaattttaccccaataaaatggaagtttttaacaaaaaagactcaacatcaccaatcattagggaattgcaaatcaacatcatagtgagatatcacttcacacccattaagatagctattatttaaaaacaactacaatagtgccgggcgcggtggctcacgcctgtaatcccagcactttgggaagccaaggcaggcggatcactaggtcagaagatcaagaccatcctggctaacacggtgaaaccccgtctctactaaaaacacaaaaaagtagctgggcgtggtggtgggcgcctgtagtcccagctacttgggagaatgaggcaggagaatggcatgaacccaggaggcagagcttgcagtgagccgagatcatgccactgcactccagcctgggcgacagagcaagactccgtctcaaaaaacaaacaaacaaaaaaaaaactacaataaaatcacatgttgacaaggatgtggacaaattggaacctttgcacatttctggtgggcatgtacaacagtgcagccactataggaaacaatatgacagttcctcaaaaaattaaatgtagaatcactatatgatccagcaattccacccctaagtatatactcaaaataattgaaagtggaaactcaaaccgatatttgtatatccatgttcataagagcattattcacaatagccaaagggtggaaacaccccaaatgtctaacagtgcgtgaatggataaacaaaatgtgatatacacacacagtgaaacataatttggccacgaaaaagaatacaattttgagacctgccacaacatggatgaaccttgaatatgcatgctaagtgaagtaagccagacacaaaagaataaatattgcaaatttcacttatatgaaaaaccagagtagtcaaatttatagagatgaaaaaatataaggggctgggggagacgagaaggggtagttattgtttaatggatacggagttttagttgagaaagatgaaaaagttctggagatggatggtggaaatgattatacaaccctgtgaatgttcttaatgcccatgacttttacctttaaaatgttaaaatttatgttttgtctatttaccatgatagaaagagagacagaaaggtagaaaaagaaacagaaaaaagaaaaagaaggaaagaaaggaaggaaggaaagaaagatggagggaagaaaggaaggaaggactcccctaatcaactgtgcttgtcttggggcaagacaggacaaatggacagatgactttcagactccactgcccctgcccaagaccccactctgacttctatgtcaatcaacaaatgtcttgttttgggaaatggaaacaatttattctgccaggcacatgggacatgggagaggcttaatgaaaaggcatctggatgaggagctggatctgcagatagatcagtggagaaaagcgcagcacatgcaaaggttccaaggtggggccgtgtttgggtaacttcagcagcctgctgttgcgggaacaaagtacatgtggcaagcaaggtcaggaggtacagctggaaatttagggtagggccagacagagggatcttgagggccacacttaagtttgtttggattttatctcataggtagcagtaaacctttcaacaatgtcaaggtggttattgacttgtgatgtgagttttagaaagatggcagaggagggatgggctggagagggccaaccaggaggcaggggccaggagagggtgagctttaggaggtccctaccattctacagatacctcaagcaaatctgacctgtagttcttggtttatcccagtcaaccacaggtcctctcaaacatcttacactcatattcctttttgagaaacattaaaatctcacactgctttaacatctcatacatttcaaagtaaattacttttgatttaaaacaaatcaaagcaatttctaatgagaatgtttttccaactacactagttagttggaaaatgcagcatttttcagctataccattcctttctcctccctcattctaattcctactcaactgggaatcattgttctacagcaaatctaagaagaagtgttatacataagtccaccctgggctatgaggttcgctttaaacaagtctggtttcattagcgcttccttgggctctcaaagatgctgcaggccctggcatgccccatgctaggaatgacctcccttcacttcgttctggatgtaggagttacccgcatgagcagcatcactacccagctgagttcaatctgctttgaaggttgcctttgccctcattccatcatttccctggtgtgccaggccgaaagggtcacctggggtgtgtgtgaagcacagaggtgcccaggcatctctctggagatgctgattcaggagtctgcagctggcatctggaatctctatgttgagcaagtgctccacgtggttcttgtgacctgacagttttggaaaacatcgtgaagaccctgcctgctctgctggcagctgctgctgtcaccctgagaagaataaaaggttcacggcccagcagatgcccgagcctctttcagggatgaaaccctctttctggatacctctttcaggatgcctgtggagtctgctcctgtgactttccagaagtccacagtcaaaccacatggctttacggttggctcttgtgattctctaaaatgtgtctttgtcacataggtgtgttctttccactttgcctttaaccaagtcagtctctctttatttggccctctttggctcccttaaatatctctgcagtgactacaggtggcgggtgccctgcctgggcctcagtcaagaaggcaaatgcacttgagtataaggaatccctttgagcacatcagaagtgagaccctgtgcttatcccaaagttacttcttcaaacaatgtatgctcagccaagtttcaaggaagaggcaagaatggcttatgagaaggccagctgtgccatgcctataatccgagcactttgaaaggctgaggcaggcggatcacatgaggccaggagctcgagatcagtctggccaacatggcaaaaaccgatcgctactaaaaatacaaaaaaattagctggttgtggtggtgcacacctatcatcccagcaactcaggaggctgaggcagaaggattgcttgagcctgggcggtagaggttgcagtgagccaaggctgaactgcactccagcctatgcgacaaagtgagaccctgtctcagaaaaaaaaaaaaggcttctgaggaggaagataaaccttgtgtttccagaatgcttataggacatttgtaggctgtgttgccatcttttttcttcttggccacaatacgtacaagcccgattatccactgctttctagctcccagcagactcgagttagttgttaagaaggaaccatgctgctggaggcagaggcactacccacatccacatataaaagagagagagacagaagaacaatgaaaagcagagacgagcactcagaaatgtacaagaaaatacaaatacatcgatcaaatagaatgaggttgaaaagtagatccactttcatgagtgtactttttgataaagaaggcattccatattaattgtgaaaggatacaaataaatagcattggctgggtggggtggctcactcttgtaatctcagccctttgggaggcccaggcgggtggatcacttgaggtcaggagttcgagaccagcttggccatcatggtgaaactccatctctagtaaaaatacaaaaaattaggcgggcgcggtggcaggcgcctgtaatcccagttactcgggaggctaaggcagaagaaccacttgaacccaggaggcagaggttgcagtgagccaagatcgtgccactgcactcaagcctgggcaacaaaagcaaaactctgtctcaataaataaataaataaaagcattaaagaattggctatgcattttgggaggagaaaaaattagatccttactttatgctgccacataaattccaggttaattaaaagaggaaaacatgaaaaacaagactccagacaaattaaaaggaaacataagtgaatgtggttataactttgggatagcatagacttccttaagcaaagaagccataaaatggataaatttcactaaataagctttcaaaacatccagctggcaaaaaagaaccataaacaactttcaaaagacaaactatagaatggaagaaactatttctggcatatataacagacaaaatattaatagccataataacataacagtgcctataaataataataagaaagaccaaacctaataatatggaaaatgaatatttttataagatcaggtatgaacaggaatttcactgaatacaaatgactaataatcatatgaaaatatgttcaatctcaacagctaaaatgagttctttttcaccctgattggcaaaaataaaagatttataacatccaatatgggtgaagatatggagaaatggaagctgtcattctcagttgaagagaataaatggatatagccttttcagaaagaaattttattctatcaaaaattttgacttgcattctctaccacccaccaattccactgtcaacatctattccagaaaaacatccagaaaaaataaggaaataagtggcataacaatttcaaagaaagagtttaaattgtcctcaattccagggaatatacagagaaacatcttcatatgcacaaaatggcaagaacgcaaaatatttccttgagcaatgtctgcactaggaaaaaactggaaacctcaatgtccatcagtaaattatggcacatctataagatgagaatgaaaaagaatgagacaatttaatgcatatagagtttatgttgggttgatgaaaatgttttggttataaacagtggtttaatatagatatatacatgtatctatatacaacacaaaaacaaagctacatatttctaaaggtatacatatatatgtacagatacctttaacatggttgggaagaatatacccaaatcactgttatgctttgttatccactaggaaagtgagattcatgggcagggtcaaagggaatgtttgctttaatgtattgggtaaaccttttatgagagaatgtactcaaatgtttacctctatgatttaaattttcatttcaagaaaaacaaaatgcatgtattgacatggaaaattatttattcattctttcaatagtattcactggaaatataaaacaaactcagaagtttcaagggcctgtggtttaaaacaaaccattctatcaccttgctagcaggagcaacaaaggaagttaaaatgactgatgctcattatggtgctgcttagccgtgaagaaaggactaaattatgctccatgtactgtgttggaaaatttcaggagtctaaagtgagtctggggattaataaatgcaacagacactgtcagtgctctgctcacattccttgaacctcactgatttattatcctctggctggtttccaactgcccaaatccatacctgaaggtttttctgaaaccagaaggcttatttcccggacacagttgcactcatcagcagcccaagagtgccagggaatgaacacaccctgctcccctgggagcagcactaataaccctcaggcattggtgtgcaaatccattagctcccatgccccttgagtgagatcttacacagtctcccagagtggccaactaggtgaggctccagtcacccactgtgctaacggggttggtagcatagcctttagtggctgctatcccatctttatcatttccccacttccctagaggtgcttcctgcacgtcccaggtaaactagttgtgttcttccagaggtagagcctgtctcaagatccgcctctggaagaatctacatgaagggtatccaatcctttggcttccctgggccacactggaagaagaaggacagtcttgggccgcacataaaatgcactgacactaacaatagctgatgagcttaaaacaaaattgcaaaaaaaaaaatctcataatgttttaagaaagtttacaaatttgtgttgggccccattcaaagctgccctgggctgtgggttggacaatcttaatctacaccagcgcagaagggtaagcttcagttatgtgaatattcctgcatttgaaacaagactttttttccaatgttactgaaaaatgaggtgtcactatatacacacacacacacacaccccaaaatgcttttctgggctagctttctaccctgctccttgcttcccttccagcctgtcttccaacagttcagctcagagtttatttagggataaccaggtattttcttttgaattctctcagactgcagagttgaacaatctcacaacggccaggtctacagcattcagatgtcacctaagtttctgcaaaatggcctaaaaacctcaaggtcccattactagaaggacttagtgaacctttccaggtggagtttttctgctcttggctgtttggatcctggtccttgggtgttgctagacagcactcagagcctggtggctcctgttactgaattcagttccctcaagagaggctgggctgcagctgctgcagtgggtgggcacccttccagcctccgtccacctcagtcctctgtgccccaggtaggcctctgtggcctcattccttgtgtcatcagtagacggttgacagttgtgactgcaagttgtccaggatcttggcatcttgaacaaagaattggacaaaatgcctagcaaagcaaagagtgaagcaacgaaagaacaaaagcaggaatttattgaaaatgaaagcacactccacagtgtgggagtgcgcggagcagcagctcaagggcccggacacagaatcttcttgggtccaatacccctagaagtttcccattggccacctgatgctcacctcatgtaaataaagtggtagcccacaatcagtctgattggttgcagaaggcagccaaacagaggctgaaatggttacaaaggtcacactcctgtgcaaacatctgattggttgcaaaaagcagctagtcagaggctagggtgaagttacaaagttatacttctatgcaaacgaagacttcgcccaaaatcagtctgattgtggacagcaaccattcagaggctggagtgaagttacaaagttgcaaaccaaggctggacctgcaatcagtctgatttgttgagtacagccaatttcccatctgcggcaactcggcaactcgacactaaaaaggtgagggtttacaaagggagtaggtcattttgttacttaggggtggaaagttagggttttcctttcagtttagttctaggaagtcgacttgaaacagccctagtttccctgtctccagaccccattctcccgcctcagttatacagaccatttaggaaaatggagacatcaattataacattaccagggtagcaaattatcaaatcggacagcgtattacaaacttctatgtagaggttaaagatacttttcaggccaggtgtggtgactcaggcctgtaatcccagctctttgggaggccaaggcaggggaatctcttgagttcaggagtttgaggccagtctgggcaacacagggaaacctaatttctactaaaaataaaaaataattagctgggcctggtggtgtgcacctgtagtcccagctacttgggaggctgaggtagggggaatcacttgagccggggaggtccaggctgctgtgagccgtgatcatgccactgcactccagcactccagcctgggtgacagagcaagaatctgtctgaaatatatatgtatatataatatatatttatacctaatatataaacattattatttaattaatattaattaattatattaatattataaacatatcagtaatattaatatgttaataaatatataaacataaatatatttataaatatataaatatattatcaatgttaatatataattaattataattaatatataattaataatattattaggctgggcgtggtagctcacgcttataatcccagcactttgggaggctgaggcaggtggatcacaagttcaggagttcaagaccagcctggccaatatggtgaaaccccgtctctactaaaaatacaaaaattagctgggtgtggtggctcacgcctgtaatcccagcactttgggaggctgaggtgggaggatcacttgaggtcaggagttcaagaccagcctgaccaacatggtgaaaccccatctctactaaaaatacaaaaattagctgggcgtggtggtggggacctgtaatcccagctacttgggaggctgagggaggagaattgcttgaacctgggaggcggaggttgcagtgagccaagatcatgccactgcactctagcctgggcaacagagcatgactccgtctcaaaaaagaaaaaaaaaaatcttgatttttccttctggacaggctccaatatggctctgtgcagcactgttattggtcctgtcgttactgaaaattctgattttttttttttggaaacggagtcttgcactgtcgcccgggctggagtgcagtggcgcaatctcggctcactgcaacctctgcctcccaggttcaagcgattctccttcctcagcctcccaagtagctgggacgacaggcgcccgccaccatgcccagctaatccagctaaatttttttgtatttttagtagagacggggttttaccttgttggccaggctggtcttgaactcctgacctcatgatctgcttgcctcggccccccaaagtgctgggattacaggcgtgagccaccatgcccggctgaaaattctgatattttgttcatcacagatttttcttgcattacttttcattttttccaatattatattaacatattaattattgctattactcaatctttttagcacttccttaaattttacatcctggtcccaaccctggggctgaaagtaataggtcatcagcacacggctgagttaaaaccatggaggtgatgagattgcatggggaaagaatgcagagcaaaaagagcagaatatcagggccagaatttagggggacatttgtatttaagggtcagtagaagagaaaagagagtcctaaaagggacccatagtccttgaggaaggaggaaaaccagaagaaagggtgtggtaaggaccaagggagacaagtttccaagagaggctatcacatactctagagggctcagataggatgactcccaagcaagggcattggattgcaccaggggacaccaggtgtgacattgtcagcacctttgagagcagcagcatgggaggtagaaatggagaggtctggctgagaggaagctaagaatgtcggcagctccaggtgcctgaactggagggatgacgaggaggtgctgggaaaagacagagatgagttcagattgctgtgtagcttaggatgcaaaagctctgaacaggtttgtgggcaaaaaaagaatgaagaccagaaaaagagggagtattgaagaagtgagaaaatcaagaagaggactgttgctaaaagacaaaaacccagaataaatgccgcttcagcctgaggatggattatctgccttgctcctgccctcaaatgaagctgcccacacaagcctgagccctggaaagtgtctcagaccccagccctctctctggttccgtcctcctcattatcggcttttcaggttctgtgacctctcctaatgctccttttggttcccagccttacctctcaccatcagcccagatacaaggatgagtgacctcgtgcaggaggtgctctcctggcttttgtttatttatttatgtatttatttatcagacaaagtctcactctgtcacccaggctggagtccaatggcacgatctcagctcactgcaacctttgcctcccagattcaagcaattctcctgcctcagcctcctgactagctgggactacaggcacccgccaccacgcccggctaatttttgtatttttagtagagacgaggtttcaccatgttggctaggttggtctcgaactcctgacctcaagtgatccaccctcctcagccttccaaagtgctgggattacaggtatgagccaccgcatctggcctggcctggcttttatttatttatttatttatattttttattattttattttgttattattttatcttttattttgtttcttctggaaattttaccctccctacaccccagaaccaggtggccacattcctaagggggcaacaccctttcctcagcctgctctttgcccggctcctgccttgtagggctgtggggaggttgctcatggtgaattcacccctgagggcattatttctcactagagcacaagacagtagtcatttctctgctgggagtgacagcagcaggggaggggctgtggagccctaacacagagccccaggcaccaagctggagttggaaatggtacttaggacttttctcccgatgcattaagatagaaactccagtaatcccagcactttgggaggccgaggcgggcggatcacgaggtcaggagatcgagaccatcctggctaacatggtgaaaccctgtctctactaaaaataacaaaaaattagccaggccaggtggcgggtgcctgtagtcccagctactcgggaggctgaggcaggagaatggcgtgaaccccgcggggcggaacctgcagtgagccgagatcgcgccactgcactccagcctgggcgacagcgagactccgtctcaaaaaaaaaaaaaaaaagaaaaaaaaaaagaaactccagtacaggaatttcaggtcagcttgactcccaggtgggggctagcaaggccagggcaccaggtggtccaggcgtgaggaaatagtgggggtgggtgacagtggacgtgaaatggttggccaaggggttagatggttggccaaacaagttaggcaatgaagcaggagggattggcaggccaggaagctgggaggcaggaggcaagggttgaagagaggcttcgctgggaagcgggagaggaaaaagaaaagatttgagggctgtggacaaagaaggcaaaagagggctgggcacagtggctcacacctgtaatcctagcactttgggaggccaaggcaggccgatcacttgaggtcaggagttcaaaaccagcctggccaacgtggtgaaaccccatctctactaaaaatacaaaaaaactagtcgggcgtggtggcacatgcctgtaatcccagctacttgggaggctgaggcagaattgcttgaacccgggaggtgaaagttgcagtgagccgagatcatgccaccacactccagcctgggcaacagagcaagattctgtctggaaaaaaaaaaaaaggcaaaaggaagaatgccacgtgccagaagtggagctgtgctatgacaagggtccactgtggccacaggagtgggttaccaaaggggcgttgatgtaaaggtcagtagcagagaagaagccaacaagctgtctggcgtggtaggtgtgtggtacacatgagaggcagtaagagtcatggttaaacattcgttgcacccacagggtccacactttgaatttcatctccatcttgactagttctgtcttcaggtgagccactgaacttccttgacccttggttttctaatttgtaaaatgagaaggacatagtacctgcacttgccacactgttttaaggactaaaatgagaagatatctgtgaaatcttagcacagcacctggcagatggtaaaatacaataaatattgctatcattactgttagtgaatgatatggtttggctgtgtccccaccggaatctcatcttgaatttccacgtgttgtgggagggacccagtgggaggtaattgaattatggggcaggtctttgccgtgctgttctcgtgatagtgaataagtcttacgagatgtgatggttttaaaaacaggagtctcgccaggcacggtgactcatgcctggaatcccagcactttgggaggtcgaggcgggtggatcacctgaagtcaggagtttgagagcagcctggccaacatgttgaaaccccatctctactaaacatacaaaaaattagccaggcatggtggcaggcacctgtaatcccaggtactcaggaggctgagtcaggagaatcacttgaacctgggaggcggaggttgcagtgagctgagatcatgccactgcactccagcctgggcgacagagtgagactctgtctcaaacaaaacaaattaacaaacgaaaaaccaggagtctccctgcataagctctctcattttttgcctgccgccatccacatacaatgtgacttgctcctccttgccctccaccatgactgtgaggcttccccagccacgtgaaactgtaagtctaacctctttcctttgtaaattgcccagtctcaggtatgtctttatcagcagcgtgcaaacagactaatacagtgcatgatagaacaaggaacaccagataaaatttcctgaaaagggccaggcatggtggctcatgtctgtaatcccagcactttgggaggctcaggtggaaggatcacttaagcccaggagttagagaccagtctggccaacatagtgagagcctgattagtatttctaatctaaaaatatttttaattagctgggtgtggtgatgcacacctgtagtccaagctactcaagaggctgagatgcaaggatctcttgagccccagaggatgaggctgcagtgagctgtgattgtgctgctgcaacctagcctgggtgacagagtgagactctttcaaaaacaaaaaaaaaacaaaaacaaaaacagcttgggtgcagtggctcacacctgtaatcccagcactttgggaggcggaggtgcgtggatctcttgaggtcaggagttacagaccagcctggccaacatggtgaaatgtcatctctactaaaaatacaaaaaaattagctgggcatggtggtgtgcgcctgtaatcccagctacttcaggaggctgaggtgggagaatcacttgaacctgggaggcagaggttgcagtgagccgagatcactacactgcactccagcctaggtgacagagtgagactccatctcaaaaagaaagaaagaaaaaaatcctgaaaggatatctaagaaagttatggtggacatttttggttactaggccaacacccattcttctcttttctcttcctaacagttctctaatttttagcaagtgttttgaagttatctcctccccacacagcctgtgtatttcaaggaaggctgacctcatccccaaatgcaggaatgggcctgataaacctaaaagtaatccagccccggcccattggttatccaggaatggggatgtgccctaattcaggccaatgagacaccgaagaggtgtcctaaaaacttctgggaaggacccccacttattttaagagaaagaggtatcctctttttctccagatgttgcattttgtggctgtaaaggctgtgcttttgcagcttttttccagtttcatcttttagaagattgaatccagctacagtcatgattgtcttcaagcctcttggcttcaaataagcacagcgaggccaaggatttccatatcttggtgccccacaaacctgaagaaagagacaggagctatgctgaatgaagacataagcaggtattttcattaattccaaacaaaaagagaagtgaggcgtgagggtcagagtgaaaaatttgggttcagcttcatgggtacctgggggcaagcattaccactgccctcagttctctgccttctcccctctgcagctcatggactgccttctccagcagcaactgaggacagtagtggtattaatgtctccaccagagggttggcagtcattatctctcagaatcctgccttgcatgtacttgcaggatgtagaaagatgagtgacctcagccaccatctagggtacagtcctccttgacaggaagtggtaggggtggattttaacaactcaaggccacaaatatccaattagtgagagatagggccagtggcaacatgtctcctggctttgttctgacatttgctctgttccatgtttgtcttgtaaataaaactgggcctgttttcagagaagctaacccaccttcatgctgacaacaggatttctaccagaattgcttttccgaagcctttttaaaatggtatttttaaatgacacttttggccaggcacagtggctcatgcctgtaatcccaacagtttgggaggccaacgcaggtggatcgcctgaggtcaggagttcgagactagcctgggcaacatgggaaaacctcatctctacaaaaaatacaaaaattagctgggtgtggtggtatgcgtgtgtagtctcagctacatgggaggctgaagtgggaggattgcttgagcccaggaggtggaggttgtagtgaaccattatcatactactgcattccatcctgggcaacagagagagaccttgtcaaaaaacaatcaaaaaaaccacccaataaagaatatgacttatttcatcttcctccatgcttccactcagacttagtaaaattatcttgaaggaaggaaggaaagaaaaaaggatgagagagggaaggaaggagaatagcaacttctgttgggttagaactataaattcctaacagataagacctgggtctgtagatttagtttttgtgatttgggtttttttaaaattattactatatattttctaattggcaaacattttttatatttatggggtataacatgatgttttagggttttctatatataagaccatgttgtttgcaaacaggcaattttacttcttccttctgatttggatgcctcttatttctttctcttatttaattgctcttgctaggacctccagtactatattgaatagaagtgacaagaatgggcatccttctctggtttctgatcttagaggaaaggctttcaacttttcaccagtgaataagatgttaactgtgaacttgtcatatatggactttattgtattgaagtacattccttctatacctatttgttgagaattcttttattatgaaaggatgttggattttgtcaaacactgtttctgcatctatcgagaagattatatggtttttatccttcattctgtcattctgttaatgcagtgtaacatattacattcattaatttacatatgtttaaccatccttgcattccagggatacatttcacttgatcatagtgaactatttttttttttagagatgagggtctcgtcatgttgcccagtctgcgcttgaactcctgagttcaagctattctcccacctcagcctccaaattagccagcactactaattagctagcactacaggcatgtgccactgcacctggccaaatgattcttataatgtgctgttgaatctgatttgcagtattctgttgaggatttttgtgtctatgttcatgagggatattgacctataattttcttttcttttattatatttggctggctttggtatcagggtaatgctcgtaaagtaagtttggaaatattccctcctttttaattttttggaagagtttcagaaatattgattttagttattctttaaatgtttggtagaattcagcagtagagccatcaggtcctggtcttttctttcatgggagatttttattactgatttaatctccttacttattattggtctgttctataagtttagttttatgtaacacttcacatactttgtacttggtaaactctcatggtgtctatttctttgtaaaacaaagaaataacaaagcatcaaaagaatgtaagatcagatccactttgtgacatccacaaggagtactatgtctggctattgtttagattcgtttggaactgatctcttgagttctcagtcactctctacctgatttgtaacaggataaggaatgtttcaagctgcacgtcttacagactcaggccaagcaaaaatactgttaacacagaaaactctgccaagattcatttttaaagccatgagtttccatcccacaaagtgcatattattcagaaggtcattcgttcaagtcagagttcacatggttttcaataaaccactcttcagatgacctaacttaggaaagaatctcattcttggggtcagtttcttttagggaatatttagttagcatttgaatgagctggcttgctctggagaagcagtggcttgactttggcccctgatatggcatggacttgaggttgtgcagggtgtgagtctaaccttttggagacctctgtcaggttctcaggaagggggtacagagtcctgggtctctatcttcttcaagcacaaattgcatccccatccaactaccagttgaaaagacaggacacaggccaggtgcagtggctcacgcctgtaatctcaacactttgggaggccgagccgggtggatcacctgaggtcaggagctcaagactagcctggcctacgtggtgaaaccttgtctctactaaaaatacaaaaaagtatccgggtatggtggcatgtgcctgtaatctcagctactctggaggctgaggcaggagaattgcttgaaccgggaggcagaggttgtggtgagctgagatcgcgccatggcactccagcctgggcaacaagagtgaaactctgtttcaaacatacaacatatatattatcaacatgaaacacgatattcagatattcttacagaaaagtagcaaacctctgctagttcatccatagaccactgctctaattggagagatcagaggccagaagtggtgttgcagagggaatggggggtgagttgaactgcctctccacgggtgagatgtgaggtttgcagcgctggacctgccaggttgtggcaattgggctggaggtaaaagatgcattccaagaaagttccataaaaatatattgtcaggccaggcgctgtggctcacacctgtaatcccagcactttcggaggcagaggaaggtggatcacctgaggtcgggagttcgagaccagcctgaccaacatagagaaaccccatctctactaaaaatacaaaattagccgggagtgttggcgcatgcctgtaatcccagctactactcgggaggctgaggcaggagaatcgcttgaacccaggaggcggaggttgcagtgagctgagatgatggtgccattgcactccaggctgggcaacaaaagtgaaactctgtctaaaaaagaaaaaaaaaaaaaaaatatatatatatatatagagagagagagagagagagagacagacagacagacagacagacagacaactccaacttgatagttgagctagccacggaaaaagcctcactggatcttcactagttcagtccataactggcactcttaaaaactcttgccatcaaaagtatctgaaatgaaaatctaagatatattcctaccactccgagaagtttctgtacaatccctctgtctaacagaccagctagtttctttcatgatcaagcagacatactgaagtcaccaacacagcagaaggcacaaatgtctctttatcaatgtttttcacattatatgtatgattcattaatgagtcatgaaatcaactctgtgagtcacaatgaacatttaaaaacaaaatatatcaggaaaaaatttgaagagatcaaagtaaactcctgagggcagggtcttatttggtttaatatcatctagtaattctatcaaaatgcaaagcataagctgggcactgtagctcacacctgtaatcccaacactttgggaggctgaggtgggcagatcacttgaggccaggagttcgagaccagcctggccaacatggcgaaaccccgtctctacaaaaaatacaaaaaccaaaaactgcaaagcataaagtagacaccctacaaaagttagataataactgaccaaaaagtaaatacatcaaaaatgacctattagcctatagagctatggatcttataatatttatagttcttatattacttatagctgtgatgtaaagaccaactatcgttgatctcaagtaatattctgtgcctaaataatatgaaaacaccaactaatcatcaatctttgaagggaggtaagatacataaaatttatacataactctggaagactaaacattgccttttttttttttttttttggagacagagtcacccaggctggagtgcagtggcatgatcttggctcactgcaacctctgcctcctaggttcaagtgattctcctgcctcagcctcccaagtaacattgtccttttttttcttcttcttttttggagacagagtcttgctttgtcacccaggccagagtgcagtagcacgatctcagctcactgcaacctctgcctcccagattcaagcagttctcctgcctcagcctcctgagtaatactgtccttcttgtatggtcataactatcttattaagacagacttttgttcacataagcatattattagacttgacaatgaaagaggcctatgcagggcaatcaaacaaaaaaataaataaaaagcatccaaatgggaaaagaagtcaaactatctctcttcactgatgatatgattacatacctagagaaccctaaagactgccaaaaggctcctagaactgataagcaacatcagtaaagtttcaggatacaaaatcaatgcacaaaaatcagtagcatttctatacaccaataatgttcgagctgagagccaaatcaagaatgcagtcctatttacaatagccacacacacacaaaatacccaggaatacatctaatcaaggtgagagctctctatcaggagaactacaaaacactgctgaaagaaatcagagatgacacaaacaaatggaaaaacattccatgctcatggattggaagaattaatagcatttaaatgtccatactgcccaaagcaatctacagtttcaacgttattcctatcaaactaccaacatcatttttcacagaattagaaaaaaactattgtaaaattcatatggaatcaaaaaagagcctgaatagctaaagcaatatcctaagcaaagagaacaaagctggaggcattgcattacctgacatcatatactataaggatacagtaaccaaaacagcacggtactggtacagaaacagtatatgcagaccagtggaacagaatagatatcccagaaataaagccacacatctacagccatctgatcttcaacagagtcaataaaaacaagtaatgaggaaagactccctattcaataaacagtgctaggatagctggctagcaacatgcagaatgaaattagacccttacctttcattacacacaaaaattaatgatagatgaaaaatctaaatgtaagaccttaaactataggaatcccagaagaaaacctaggaaacaccattctggacattggccttggggaagaatttttgactaagtcctcaagcaatggcaacaaaaattaacaagcgaagcctaattaaactaaagtgcttctacacagcaaaagaaactatcaacagagtaaacaggcaacttacagaatgtgagaaaatatttgcaaaccgtgcatctgacaaaggtctaatatccaaaatctataaggagccaagcgtggtggcacatgcctgtagtcccagctagttgggaggctgaggcagcaagatcgcttgagctcagtttgaggctgcagtaagctatgatcgtgccactgctccccagcctgggtgacagagcaggaccctgtttcaaaaaaacaaaaatacaatctataaggaacttaaacaattcaataagccaaccccatttaaaagtgggcaagggcatggtggcacatgcctgtagtcccagctactcgggaggctgaggcaggagaatcacttgaactcatgaggcagaggttgtggtgagccaagatcactccattgcactccagcctgggtaacaagagcgaaagtctgtctcaaaaaaaaaagtgggcaaaggactgggcactgtggcacatgcctgtgatcccagcactttgggaggcctaggcaggcggatcacttgaggccaggagtttgagaccagcctggccaacatggcaagacactgtctctactaaaaatacaaaagttagcagggcatggtggtgcatacctgtaatctgagctactggggaggctgaggcgggagaatcgcttgaacacgggaggtggaggtatgggaggtggaggttgtagtcagccaagatcacacactgcactccagcctgggcaacagagtgagtgagactccatctcaaaaaaaaaaaagaaggctgggcacggtggctcacgcctgtaatcctagcactttgggaggccgaggcgggcagatcatgaggtcaggagatcgagaccatcctggctaacacgctgaaaccccgtctgtactaaaaatacaaaaaattagctgggtgtggtggtggtgggcacctgtaatcccagctactcaggaggctgaggcagtagaatggcataaaccaggaggcataggttgcagtgagccaagatcgcgccactgcactccagcctgggcgacaaagcgagactccgtcacagaaaaaaaaaaaaaaagtgggcaaaggacatgaatagacatttctcaaaagaagatatacaagcagccaacaaacatgaaaaaataatgctcaatattacgaataatcagagaaatgcaaataaaaagtgcaatgagatactatctcaccccagtcagaatggctattattaaaaagtcataaaatggccgtgcacagtggctcacacctgtaatcccaacactttgggaggcagaggcgggtggatcacctgaggtcaggagttcaagaccagcctgaccaacatggaaaacccgtctttactaaaaatacaaaattagccgggtgtggtggcacatgcctgtgatcccagctacactggaggctgaggcaggagaattgcttgaacctgggaggtggaggttgtggtgagctgagatcacaccattgcacctccagcctaggccacaaaagcaagactctgtcttaaaaaaaaaaaaaaaaaaaaaatcctaaaataacagatgcttgcaaggctatggagaaaagagaatgcttatacactattagtggggatgtaaattagttgtcactatggaaaaaagtttggagatttctcaaagaacttagaactaccattcaacccagcaatcccattactgggtatacatccagaagaaaataaatcattcttccgtaaagacacatgcactcgtatgttcatcacaccatgattcacagtagcaaaaacatggactcaacctaggtgcccatcaaccgtgcactggataatgaaaatgtggtacaaatacacatatagtattgtgtatatgtggtacatatatgatcttattcttttttatatacacatatactatgcagccataagaaagaatgagatcatgtcctttgcagcaacatggaggaagctgaaggttattatcctaagcgaattaatacaggaacagaaaaccaagtaacacatgctctcacttataagtgtgagctaaacattgggtacacaaggacataaagataggaacaatagacgctgggaactactgggtgggaggaggtagggagagagaagggtgaaaaaacgaactactgaggctgggcgcagtggctcacgcctgtgatcccaacactttgggaggcctaggcaggcggatcatctgaggtcaggagtttgagaccagcctggccaacatggggaaaccccttgtctactgaaaatacaaaaattagccgggcaccgtggcgcgtgccttaggcccagctgcttgggaggctgaggcaagagaatcgcttaagcccaggaggcggaggttgcagtgagccgagattgtgccactgaactccagcgtgggtgacagagtgagactctgtctcaaaaacaacaacaacaacaacaacaacaacaaacactattgggtactacgctcactaactgcatgaggggatcaattgtactccagacctcagcatcatgcactatacccttggaacaaacctgcacacgtactccctaaatctaaagtaaaagttgaaatgatattaaaaaaaaaagaaaaaggggctgtgaatcataatgactttgctaattgacattatttatttctgactggggttgctctctacttgctggtataaatgcttgtatctgtcctgctcttggaaacttgttaggaataggaatactaatttttctatacagagtacagctccaggaagctgtggattaataaatgcttgctctcaaaaataatttgggctgtagcctctaacttacagtaagtatagcccctttatattcctctttttcacctttaaccaccagttaatatgtcagtactgtaactccaaatattcaaagaacctagttaactttgcaaaactgctatgtaaacatggtagcaatagtttgtgtgtatttagcaaaacagagttaaacacagtacttgtatttatgaaaacaaataaaaaggcaaaaaaaaaccccaacaacctatatttatataaaacagattccaattcaagaaggtaaacttagcatgtaggtttgtcattcttcttaagatactaatgaagcgataaagaatttaaaagagtataaatccatagtcacaaagatgatgaggcatgatttgggcatcagcagttgagagatttcaacacatttctgggagatgaaaagagaacatgaattgtagacagagggagtggagtagggggttatgtgtgggagcagactctggaggagtgagacttctccgcccagacagggtgtggactggagtctgcatgagaggagaggaaaacagagaaagggactgaaaataggatgctaaacaccgagattttcaaaatgctgtggataattttttaggacctagaattccttatcatctaaaccaggtatcaaaagtaaaggcagataatgacattttcaaactgccaggattcagcacgtttacttactacatactctttcttaatgaagttccttgaggatgcacttcaataaaaaaaaaaggagcggggagtggagtgggggaggaaattgagaaagaaaaatatgaggcaatgaagaaacaagccaggttgagagctatacaaattataacaaatgtcagatgtcaggccgggcttggtggctcacgcctataatcccagcactttgggagactaaggcaggcagatcgcttgagcccaggagttcgagacaagactgggcaacatggtgaaaccccatctctaccaaaaatacaaaaaaattagccaggttggtggcgcacacctgtagtgccagctgctagggaggctgaagtgggaggatcacatgaactcgggaagttggggctgcagtgagccaagtccagcctggacaacagagaccccatctcaaaaaaacaaacaggccagttgcgtggctcacgcctgtaaacccagcactttgggaggccgaggcgggcagatcatgaggtgcagttcgagaccagcctggccaacatagtgaaaccctgtctcttccaaaaatacaaaaattagctgggcatggtggtgtgtgtttgtagtcccagctactggggaggctgaggcaggaggagtgcttgaacctgggaggcagaggttgcagtgacccaagatcgtgccactgcactccagcctgggcgacagaatgagactcaatctcaaaaaaaaaaaaaaaaaaaaaaaaaaaaaggaatgaaaaacacaaacgagggccgggtgtggtggctcatgtgtgtaatcccagcactttgggaggccgaggcggatggatcacctgagatcaggagttcaagaccagcctagccaacatggtgaaaccccatctctactaaaaatacaaaaaattagctgggcatggtggcgggcgcctgtaattccagctactcaggaggctgaggcaggagaatcgcttgaacccgggaggcagaggttgcagtgagccgaaattgcgccactgcactccagcctctccagcctgggcaacaagagaaaaactccgtctcaaaaaaaaaaaaaaaaaaaaaagaaagaaagaaaaacacaaacgaatgtctgtgggctgcaggaatacttacttgcaagaagaaatatactggattccaggcaatatataaagcaagtaaggaactgaaaaaacaaaaacaaaaaaccaatctggaagaatgtggtggcaaaagcatgtttctttcattaagaaaggtaatgccgcctggcgcagtggctcacacctgtaatcgcagcactttgggaagctgaggcgggcggatcacctgaggttgggagtttgagaccagccctaccaaaatggagaaaccccgtctctactaaaaatacaaaatcagcagggcgtggtggcgcatgcctgtaatcccagctactcgggatgctgaggcaggagagttgcttgaacccgggaggcggaagttgcggtgagccgagatcacgccattgcataccagcctgggcaacaagagctaaactccatctcaaaaaaaaaaagaaaaagaaagaaaggtaatgcctaagctgggcgcggtgttcacgcctgtaatcccagcactttgggaggccgaggcgggtggatcacgaggtcaggagactgagaccatcctggctaacacggtgaaaccccgtctctactaaaaatacaaaaaattagccgggcgtggtggtgggcgcctgtagtcccagctacttgggaggctgaggcaggagaatggcgtgaacccgggaggcggagcttgcagttagctgagatcgcgccactgcactccagcctgggcgacagagcgagactccgtctcaaaaaaaaaaaaaaaaaaaaaaaaaaaaaaagtaaaaagtaaaattttaaagaaaacaaatttcccaagcatttctcagtttgcttttgagaaatgattacggtcatttcctttaagtggttagttcagtgaattatagctttttgttaatttgatttcacagcacagttttgaaaatcaccccaaaaagtactgcatggcttgagctggcttttaacagaataaaattcaattctgctttgaagtctttatgacctcctttacagaaatggtgacattgtggggttctgagcgcaccctgaaatcacaggtcttgtgtgacactgtgaaaattacccagaaccctgggcacccactcctccactacggaagtcaccaatgctggcaaatagcataacgggcttgtggcgccccctactgtccactaggcaaactgcatcaccttcctgagctacgttccagggtgaagttaaaaaagaaatctgcacttggaaagactgcatgaaggcagtgtcaggcacgtgtatttatttacgttctttaatcaatagatatgatttccaaaattatttacataacaatttgggaaatttgaacgtaagatggatattagatgatttgggaatattaagtaattttcaagcctgggaccgacacctgtatgggagctgaggcaggagggtcacttaagtgcagaagttcgagacagacaacacagtgaggcaccgtctctacaaaaagttaaaaaaaaaattaaccaggtgtggtggcaggtgtctggtcccagctacgtaggaggctgaggtgggaggattactagagcctagaggccgaggctgcagtgagtgatgattgtaccactgtatatcagcctggatcagagtgagactctatctctaaataaataatgataattttgttttgttttgtttttttgagatggagtcttgccctgttgcccaggctggagtgcagtggcacgatctcagctcactgcaacctccacctcctgggttcaagcaattttgtctcagcctcccaagtagctgggattacaggcccacaccaccacacctggctaatttttgtatttttagtagagacagggtttcgccatgttggccaggctggtctcaaactccttacctcaagtgatccaatcgcctcggcctccgaaagtgctgggattacaggcatgagccacagctctcggccaatgataataatttttaaaaagcaaacttctactaatgaatatctacatagagtgtccttattttaagagatgcatgctgaagtttttagggataaaatgtcataatatctgcaaccaactgtcaaatggctttaactctcattcagagcgaaagccaaagccctacgatgacctacaaggccacgtttaatcttcaccacccctcttctctgtcctcatctcctcctccaatccctccttctcccagcaccagccacactgaccttttcaatcatctgcatactctggcctcttcacacccacttccctgggcccaagatgcccttctcattagagtctgcattgctggctccctcactgccttcctacctctcttcaagagacttcttttttttttttccttctttttttgtgagacagagtcttactctgtcacccaggctggagggcagtggcaggatcacagctcactgcagccttgaactcctaggctcaagcagatcttcccacctcagcctccgaagtagctgggactgcaggcaccggccaccatgcctggctaatgtttttattttttgtacaggtggaatctgcccatgttgctcaggctggtttcaaaatcctggacaggagatcctcccgcctcaacctccccacatgttgggattacaggtgtgagccaccttgtccggccacaaagatatcttagtgacacttcctggccacaggctaaaatttaatctaccacttacctgcgttgttttctcttcttcgctcttaatacaatttaatgcactaaaatttcacttatcttttttattgtctgtgttgcccaaaacatcagtttacataaaagctttgatagtggttgtgttcattgctgtatccactggacctaaactagtaaccagaatatacttaaaactcatcttatatacaatgagtgaaaaaataaaaagcagtgtgtgggctcaaatttttactcttatagtcaatttgcaaattttgttttagactgtggcatgtacaatgtgtgaaagatgccatctgttgatgattggcagatttgactggtttgtgctctgaattaagaataatttactttttccaatataagctttaagttgagcctttctaagttaaaaaaaaaatcttccatcgtatgtcttttaggtaccattgacatctttccaggctttcacgacaaattcaaaggtcagtgatggctatacaccccctgagatggggtagccgggttatgggtgatttttgtctatctttagtaaacataaaatttcacccaaaattgtttctagaacaaacataaatataagagtaggatattagggccaggcgcagtggctcatgcctataatcctagcacgttgggaggccgaggtgggcggatcacttgaggtcaggagttcaagaccagccctgccatcatggtgaaaccccatctctactaaaaatacaaaaattagccgggcgtggaggcgcgtgcctgtaatcccagctactcgggaggctgaggcaggagaattgcttgaacccgggatgtggaggttgcagtgagccgatattgtgccattgcactccagcctggggtatgacagtgaaacactgtttcaaaaaaaaaaaaaaaaaaaaaaggagtaggatgttagataagttcagggatgataaagccataatgggttaactaggatgggggttgattcgtaagctttgagatcgacttttagaatcaggcatataaatcctgctggatttgaatgctgtgtaggatagagcacaggtctgaaaaaatatgaaaattctaatatctttatgtacctaaaacatagcctcttgcgttttttatttttatttacttatttatttttgagacagagtctcgctctgttgcccaggctggagtgcagtgggacaatcttagcttactgcaacctctgcctcccaggttcaagcgattctcctgcctcaacctcccaaatagctgggattacaggtgcacgccagcagacccagctaattttttgtatttttagtagagacagggtttcactgtcttagccaggatcatctcgatctcctgaccttgtgatccatccaccttggcctcccaaagtgctgagattacaggcgtgagtcacgacacccggccgcctcttgggttatttttaaaatcacagagactaggctagtattcctagcagcaggtagaaggcaaaccctgtccatatggacctctggatgctgacaaataaaaatgcatctctttatcaaccttgtaaaccagcccccttcccattactgtagttggctgagattctcacactgtgagatctccattccatttattcatattactcatttaccaaaagtgtattgggcccaaattgtgtcaggcaaactgaagagaacaaaaatgaatattacacagtgtacagagaaattatgttttaaatttattagaactcgaattgcaaaaagaatcagtaaggttgtccttggtgccatggttaacagtcctttcagataaagatcagatacttccaagttcagttaaaacttactttcggctgggcccagtggctcacgcctgtaatcccagcactttgggaggccaaggcagatggatcacttgaggtcaggagtttgagaccagcctggccaacgtggtgaaactccatctctactaaaaatacaaaaattagtcagtcatggtggcaggcatctgtaatcccagccactcaggaggctgaggtgggaggattgcttgagtccgggaggtggaggttgcagtgagctgagattgcaccattccactccagcctgggcgacagagcaagactctgtctgaaaaaaataataaattaatttcaaaaaaaaaaaaaaaatatatatatatatatatatatatatatatcagaaatagagcatacaatgcagttctgtaatttgcacttaatatattgtgagcatatatgcacattcataactacatatcattaaaaagtaattactcaggctgggcgtggtggctcacgcctgtaatcccagtactttgggaggctgaggcgggaggatcacttgaggtcaggagtccgagaccggcctgaccaacataatgaaaccctgtctctactaaaatacaaaattagtcaggcctggtggcgcattcctgtaatcccagctacttgggaggctgaggcaggagaatcacttgaacccaggaggtggaggttgcagtgaaccaatatcgcaccattgaactccagtctgcgcagcaagagcaaaattcatctaaaaaaaaaaaagtaagtaattactcttgaattgtttaactattgaaaactcctagtttctaagggatatcagcacatgagttcccacctctgttatccaggccatataaatatcattgattgtacacccatagacaaaatagaaagcaaaacaaaaacaaaaatgaggaagtcatagaagagggtagtaacattttagccagagaaaaactactctaaatggaggaagtcagaaaataaggcaatcagcatcatattgcaaatgcaatggagaggtaaggtcatgttacaatgtagcctactaaagaaaaacaaaacaagcaaaacaaaacccctgaagttgaagatgtggttcgtttatttatttatttatttatttatttatttatttatttatttatttattttgagacagagtctcgctctgtcgcccaggctggagtgcagtggcgcgatttcggctcactgcaagctctgcctcccgggttcccccatcttggttggttgaccgcataacaatgaatccatcacagagcccttaaacgggccagtttggataaccagcaggtgttttgaaaagctactgatttaggccaaattagaaggaggggcaatgggttgccttggagaagcaaacaggggcggcagactgaactgtaaatcactctcggctctgggctctctttcttttttcctctttcccatatgggcttccaaccctgggagccatttttagggtgaacaaaggtatctgtggaatgttcatttgtttctattatttgccacaagcagtctttgttgtttttttttttaacttgaatacttaacactccctcttaaaaccaggactcagtataaaaactatgcttcacactgtttgcaagagccaaacattggacactcaaatgtccattaaaaataggatgggggctgggctcagtggcttatgcctgtaatcctaacacttttggaggctgaggcaggtggatcgcttgagctcaggagttggagaccagcttgggcaacacagcaaaactctgactctacaaaaaatgcataagttagctgggcatggtagtgtgcacctgtagtcccagctactcaggaggctgaggcaggagaatcacttgagccagggaggttgaggctacactgagccatgatcacatcacgacactccaaccagggtgatgaagtaagatcctctctcaaaaacaacaaacaaaaatatgggaccaggtgtggttgctcattgtaatcccagcactttgggaggccgaggcaggaggactacttgagcccaggagttaaagaccagcctgggcaacacagggagatcccgtatctacaaaaaataataaattagctgggcatggctgggtgcagtgggtcacgcctgtaatcccagcactttgggaggccaaggaaggcagatcacaaggtcaggagatcgagaccatcctggccaacatggtgaaaccccgtctctactaaaaatacaaaaattagctgggcatggtggtgtgtgcctgtaatcccagctacttggcaggttgaagcaggagaatcccttgaaccagggcgtcggatgttgcagtgagctgagatggcaccattgtactctagcctggtgacagagcgagactccatctaaaaaaaaaaaaaaaaaaattagctgggcatggtagcaggtgactatagtgactatagtcccagctactctggagaatgaggtgggggaattgcttgaacccaggaggttgaggctgcattgagctgagattgtgccactacactccagcctgggcaacagagtgaaactctgtttcaaaaaaaaaaaaaaaaaaagatatggatagggctggtcatgacggcctacactcgtaatcccagtgctttgggaggccaccacggaaggatcacctgaggccaggagtttgaagttccagtgatctatgattgttagaggcctttgaactagagcaactccatcttcagtaggggctgggtaaaataaggctgagtcctactgggctgcattcccagttaggcattctaagtcacaggatgagataggagaccagcacaagatacaggtcataaagactttgctgataaaacaggttgcagtaaggaagccggccaaaacccaccaaaaccaagatggtgatgatcgtccttactgctacactcccattagcaccatgacagtttacaaatgccatggcaacgtcaggaagttaccctatagggtctaaaaaaggggaggcatgaataatccaccccttgtttagcatatcatcaagaaataaccataaaaatgggcaaccagcagcccttggggccgctctgtctgtggagtagccattctttggttactctactttgctaataaacttgctttcacttttctctagggacctgctctgaattctttcttgtgcaaaatccaagaacccgctcttggggtatggatcaggacccccccttcttgtaacatctttttggcaaccacagaagggactatagtgcggtaaacccctgacccaaaggctaactttgggtaagtggtagggtccggtgacatctttctggcaaaccctgaagggatgatactgaagaaatcccctcactcaaaggaaagagattggttgactttggataaattggtggggtacctgggtgaaaaatgggattgggtgagaggcccaacttagaggagttagagtctctcctaagacaaagagggttaaaggctcctctcaataagaggcaaggacacttgaccaacattgggttcaaggcccaacttaggagggttagaggcccctctcagtaaagtccctttcggctaaatatgggtttggcactacaggatgttaactgctactctctatggaataatctgctttgcactctttgctgatgactgtgggtgtcaggattggcatgtacaggattgtgggacatggggagctttttctttcctaaaaggggaaacttgagagctgacaggactgctggaaaagattccttcttgacaggcaagcagccatctgaacttttgagtaatgggcgggtcttactctggtctccctgagctcttcacttttcccaccctgcctcaggcaatgcgctctttctctctctctctctctctctctctccccccgcaaacgggttaaatgaatgctaaaaatcactgtttatcccaggcgtagtggctcacacctgtaatccagcactttgggaggccgaggcgggcagatcgcctgagttcaggagttcgacaccagcctgggcaacacggtgaaaccctgtctctactaaaaatacaaaaaattagccgggcatggtggcaagtgcctgtagtcccagctactcgggaggatgaggcaggagaatcgcttgaacccgggaggcagaggttgcagtgaaccaagatcatgccattgcactccagcctgggcagcagagcgagactccagctcaaaaaacaaacaacaataaaaaacaaaaacaaaaatcactgtttatctcctctgtaaagttttgattaatggaaaaaaggattactgaggctaatcttaaactgtagtgaatctggtgtgctttgtgtatctttctgtattgttctgtcaagatgaggagtaccttaggatagaatgtggacctaggacccctatatgcctgctgttcaagacagcccagcaaactggttagtcatttccttgggagactgaccttgtaaccatgtagctgtgctttctcttttcacaatggtggcctgggttcagggtcctggtaaaaaaaaatgatggtatttccacataatgaaaggttatacagcaatgagaatgaataagctacaactataaaccacaaccggaatgaatctcacaatgtgaggaccaaaagaagccagacaaaaaaagagtacgtagtttacgattctacttgtgtaatgtaaaggtcaaaactttaacaatagacaaaattgggccgggcgtggtggctcatgcctgtaatcccaacgctttgggaggctgaggcaggtggatcacgtgagggtgggagttcgagattagcctggccaacgtggtgaaaccctgtctcaccatgttagccaggcatggtggcagatgcctgtaatccagctactcagaaggctgaggcaggagaatggcttgaacctgggaggtggagggtgcagtgagctgaggtcacgctgctgcactccagcctgggtgacagagcgagaccccatctctcaaaaataaagataaaaaataaaaatagacaaaactaatccagttttaaagttcttgagtgagacagggtcccactctatcacccaggctggagtgcaatggtgtgatcttagctcactgcagccttgcattcctgggctcaagtgatcctcctgcctcagcctcccaagtagctgggactacagtcacacacaaccacaccctactaatttatttaattttttgtggagatgagatctcactgtgttgcccaggctggtctcaaactcctgggctcagggagtccttctacctcaacctccccaaatgctgggattacaggtgtgagctgctgtgccagctaaaaactaatctattattctagaagttagaacagttgttactgttgacgaaaagagtcaaactctgtaaaatatttaaagaggtttactctgagccgaatatgagtgaccatggcccaagagacactctcaagaggtcctgagaaatgtgtccgaggtggttcagttacagcttagttttgtatgttttagggaaacataagacatcaatcaatacatgtgaggcatacattggttcaatctagaaaggcagcacaactcaagtcgggaactgtgcttctaggtgacaggtaggttcaaagattttctgattggcaattggttgaaagagttattacctagagacctggaatcaatagaaaggagggtttgggttaagataaggacttgtggagacttcaaggttcttattatgtagataaagtctcctaggtggccacccttagaggcaagagatggcaaatgttttctatttagaactttaaaaggtgctggtctctcagccagtctcttcaggatcggaaaaagacttggaaagggaaggggattctctatagaaagtaaatttctcccacgagatacagttttgcagagccatttaaaaatacgtcaaagtcgatccttttgtagttcaagagcataatgatcgggcgttcacatgcgtgtgtcagatgtgccaccctcgaaccttgttaggatgttggcacattacctgtctgacataaaaggaaaataataaataaaaatatgtcaaaggaatatattctggggcaaaagatttttattcctttcaggatctgctatctgtcgtgtgatgctatactagaatcaggttggaatttggtattttattgctacaaagaatctgctttgtcagtcataagatctctgttttaatgttaatgctggtcagctgtgcctgaattccaaagggaggagagtataatgaggcatatgagaccctcatacccgggtttgaaatccccttggtggagaggaaggggtctgtttagtcatttgggggaggagcttataatttcatttttggctcacattaccctggtgggaattcgtgactggaagacagcacgagggagtcttccaggattctggtagcattctgattcttgatttgaattctggttctatggatatgaattttataaaaattcatgaaactgcaaacttatcatatgtacactttttttttttcttgagacagagtctcactctatcatccaggctgcagtgcagtggcatagtcttggctcaccgcaaactctgctttgcggattcaagcgattctggtgcctcagactcttgagtagctgggactacaggcgtgcaccaccatgcctggcaaatttttgtagttttagtagagacggggttttgccatgttggccaggctggtcttgaactcctgacctcaagtgatccacatgcttcagcctttcaaagttctgggattaaaggcatgagacactgcacctggctgacatgtacactttttgtaggtatgtgatacttcaataattttacatatattttaaaaattaaataaatgtatgtattttaaaacctagcctcatgtgcatacacacaaaaaaataattacatcatatagaacttcataaagaatgtccaaaatttagaaacacacatacacacacgtgtgcaaacacacacatgcacagttaggagaaagagagatcctggtagtgtgatagaaaaaagaggttcagccaggtgtggtggctcaagcctgtaatccccgcactttgggaggccgaggcgggcggatcacgaggtcaggacaacgagaccgttctggctaacacggtgaaaccccatctctactaaaaatacaaaaaactagccgggcgtggtggcaggtgcctgtagtcccagctacttgggaggctgaggcagaagaatggcgtgaacccgggaagcggagcttgcagtgagcagagatcacgccactgcacttcaacctgggcgacagagcaagactccgtctcaaaaaaaaaaaaaaaagaagaaggttcacatttgtggagtgtgattaaaaaaaaaacaatcctcaacccctagaagatgggaagaaagcaggtttgaggaggaagaagaattagaaagcagtatagtatgactcacccaagaacaatgacaaccagcactgccctttgtcacttggactttgaacaaacagttggtaaaattattttgaggtgtgggtgagtaagggggtgtgccctggggcattacttgctcaaattggtttctgccctgtatgagatcaacacatagatcacacattaactactcccatcccacttgaaaatggcccgtataccatcaggagaaagacctcgaccatttcccatgattattcttgttattctaacatccttcagattgagtgttaagtccatatattatgaaattaatgaatctttccagaatctcaagcagcagttctattataatgtaaatcagaaatctttgagacgctcctttttttttgagacagagtctcgctctgtcgccaggctgcagtgcagtggcacagtctcagctcactgcaacctctgcctcctgggttcaagcgattctcctgcctcagccttccgagtagctgggattacaggtgcccaccaccaagcctggctagtttttgtatttttagtaaagacacggttttgtcatgttgactaggttggtctcgaactcctgacctcaggtgatccacctgcctcagcctcccaaagtgctgggattacaggcatgagccatcgcacctggcctgagaaacttgttaaaaacacagatttcttggggcaaagattcagcaggtgaccggtggatccgaagaatcttcattttaaccagcttcccttgcctttccatctgccataaaagtctggattttagccgggtgtggtggctcacgcctataatcccagcactttgggaggccgaagcaggcggatcacctgaggtcaggagttcgagaccagcctggccaacgtggtgaaactccgtctctactaaaaatacaaaaattagccgggcatggtggcgggtgcctgtaatcccagctactcgggaggctgaggcaggagaatcgcttgaacctaggaggcggaggttgcagtgagccaagatcgcgccattgcactccagcctgggcaacaagagcgaaacttcatctcaaaaaaaaaaaaaaaaaaaaaaaaaaaaggccgggtgcagtggctcacgcctgtaatcccagcactttgggaggccgaggcggttggatcacgaggtcaggagatcgagacaatcctggctaacacgatgaaaccccgtctctactaaaaatacaaaaaattagccgggcgtggtggttggtgcctgtagtcccagctacttgggaggctgaggcaggagaatggcatgaacccaggaggcagagcttgcagtgagccaagatcgcaccactgcactctagcctgggcaacagagtgagactccgtctcaaaagaaaaaaaaaaagtctggattttatctgtgcattttatgtgtcaacttgactggaccacgggatgctcagatatttggttaaacattattctgagtgtaacgctgagggtgtttctggatgaaatgaacatttctataggttgactgagttaagcaaattgccctcccccatgtctgtgggcctcattcaatcgttgaaggcctgaatacaacaaaaaggctgaatataacaacatttgttctctctggctgactgtttttgcgctgggaacattaggcttctgcctttgggcttggacttggactggaatttacatcatttgttcccctgggtctccagcttggcaactgcagatcttgggatttctcaacctccataactacatgagccaattcatttgtatatgtgtatatattggctcaggacagcacacctgacaactctggttcccagctgcagggggaggctacccaagtatctggcagatctccaactatgcatgcacagggtagactccaagcagttcagataaggctaaaataacagaggcttcagctgttcactcaccacgggggaggcaaaattcagaatttgagttcagccaagttaactgcctactaaactaaaaatttgggataagccaggtgcagtggctcacacctgtaatctcagcactttgggaggtcgagacaggcagatgacttgagccgaggagttcaagaccagcctaggcaacatgacaaaacctcatctctacaaaaaaaataagaattagcggggcatagtggtgtgtgcctatagtctcagctacttgggaggctgaggtgggaggatcacttgagcccaagaggcagagatttcagtgagccgagatcatgcccctgcactccagcctgggcaacagagtgagtccctgcctccaaataataataataggtctggcccagtagctcacgcctgtaatcacagcactttgggatgccttagagggcagatcacctgaggtcgggagttcaagaccagcctgaccaacatggagaaatcccatctctaccaaaaatacaaaattagccaaacttggtggcacatgcctgtaatcccagctactcgggaggctgaggcagaagaatcatttgaacctgggaggcggaggttgcagtgagccaagatcgcaccattgtactccagcctgggcaacaagagcgaaactccatctcaaaataaataaatacgtaaaataataataataataaataatttggaatgtcctggctgggtactcagcaggtcactgaatatgcagatatgtgggagaacaagggtaggggagtgagcaggaacctggggagaccaaaaagcagagaaagaactcggacaggtcttgccactgcaacagtcagagtaggaggcaagtgccactgccacagccgccagacacgggcccttgctgctcctggactcttgaccctgccaccctggaaacaatctgtcattctcctgacatgcaggtactaatgccctcaaaagtcaaaaatcctgggtaggaatgtctgattggtgtagccggtatcatatgccagtgccccaactaccaaggagaaggggaaaagaatgtctgtgcgtccttcggctgccagagtagggtacctcctgcaagctcatatttccccaggaagcaggaagcaggaagcaggagcccatgccaggagggccactctattgccaaaaggaaatcacagccaaaaaaaaaacaaaacactctttttttttttttttttgagaaggagtctctctctgtcacccaggctggagtgcaggggtgcgatctcggccactcttttttttttttttttgagaaggagtctctctctgtcacccaggctggagtgcagtggtgcaatctcggctcactgcaagctctgcctcaggggttcgtgccattctcctgcctcagcctcccgagtagctgggactacaggcgcccgccaccacacccggctaagtttttttgtatttttagtagagatggtgtttcactgtgttagccaggatggtctcgatctcctgacctcatgatccacccgcctcggcctcccaaagtgctgggattacaggcatgagccacagcgcttggcctttttttagacagagtctagttctgtcacccaggctggtgtgtgtcatgtgcatccatgtgaagagaccaccaaacaggctttgtgtgagcaataaagctttttaatcacctgggtgcaggtgggctgagtccgaaaagagagtcagcaaagggagttagcagtggggcagttttataggatttgagtaggtagtggaaaattacagtcaaagggggttgttctcttgctggcaggggcgggggtcacaaggtgctcggtggggagctctggagacttattgtccaggaaaaggaatgtcacaaggtaatgtcatcagtcaaggcgggaaccggccattttcacttcttttgtgattcttcagttgcttcaggccatctggatgtatacttgcaggcttgggctcagaagcctgacagtgtgcagtggcacaatctcagctcactgcaacctccgcctcctgggttcaagcaattctcctgcctcagcttcccgagtagctgggactacaggcgcacgccgtcacatctggctatttttttgtcttttagtagagatgaggtttcactgggttgcccaggttggtctcggacacctgagctcaggaaatccaccctcctgggcctcccaaagcgctaggattacaaaaaaatcctctttgactatcctctatttcctttcttttgctctttcttcccttatcttcctcaccaactttttaatctacatacaaaatattctgtgcattgtggagagcagggaattgaaagtgtggttggctgaataatggtcatccagagatagcagtccctaatccctagcacttgtaaatgttgctgtataaggaaaaacgggctttgtgtatgtgactaatttaaggatcttgccatggggagattatcctggattatctgggtggaccatcacaagtgtccttgcacaagccaggcaaagggagattagacgcacagcaagagaggaggcaacgtggccaccaaggcagaaattagaataatacggccacatgtcaaggagagccagcagccaccaggagccggaagggacaagaagcagattctccctagagccttccaaaggcccacagccctgctgacagctcgcttccaccagtgatacagatttcagacttctggcttccagaacagtgagagaatatatttctgttgttttaaactatctagtttatggtaatttgttactgcagtcacaggaaacaaatacgcaatatgaagaagatgtgaaaatattatacctttaaaacaaggcagaaagaaggaagcaaggatgctgagctcatgagtgcaatgttagtcacctagcacacaaaggagtgaaagccagataaaataatccagaaaaccatgtgtctttcgaaaataaatctaggattagaataggacagactgagtaacacagggaaaagtaataactctgttgatccatctaaaccagatatataatctcctgacaaatagagcaggaggtatgaataggaggacattttagttgtttaactggtgaaatgttagggggtggaagggggaaagagtggcacaggctaaatcggctagatgactcagaaaatgaatttgttttcagataattgcttcctaacgtagcaatgatgcagctcttagtcattccaatagcaaacagccattctgatagcaattccacagagacagcaaaccagctagaacaaaagactgctccacccacaacaaggactctggtgggaaaaagttcctagtgaatgaatccaacataattgactctgagctgctcttgtgtcaaagacaggctatgagaaactggcatggatgggaacagcttcagacattggcttcctgttgtgtcttcttgctgctgtgaaatgaggctctaagataaacagagcagaggcacatctggagaggaaggttaccagaagggtgatgtcactagcagcaaatcagaaccccatctttcagcctagcagggatttgaaggatttgtatcatagtatgcaaggggcttccagcactgcatggcctctatctttaatcaaagtcagaagcctacaggcaggagtgggctgagcttctcatgtgtgctcacatcgtgctggtgagccactgaaggcctgataggaggagagtaagactcaaaaactctgcttaaaatccagatgtgtaaatgagacgtactctattaaagaggacaagaatcaaacataggaaaactattataccactaagatgacacaaggcccaagctgaagtgcttagaagtttgtggatatgaattaacatattttttttcttgagttagcatgtgattcctactctttgagaaaggtggctttagccatgagcttgtactgttggtgggacttgctgtttaatcagtcaacaaatcaccaatgggcacagctgtgtgctaaacgccaacaggaatataaaagcacagcatccctgatcttaaagggtttttgcagttctgctgggaaaattaaacaagcaggaaacatcagcattccaatgcagtaaaagcatattgtgtactcttgcctgttgctgctacaggagtttattaattcatccactcaactaatagttattgaatgtctgcttggtgccaagcatgcttctgggatacagcagtgaacaaaccaacaccaaatctctgcctcatagagcttacatagggttggggaaggtcagacgcattggagatatctactagacaccaaggtggagatcagattgatgagggtggagctcagggaagagatctggaccagaattcagaactcagaagatgtaaacaccagagtgggctggagatgcttcagggagcagggaagacttgaatggggcccgtttcacaacagcaacaaaagcctctttcaccagttctctaggccaaggcccaagccctcctggtttatctactgcctcttttccccacttctccttatcagtttcctctttccggcccattttcttcattcccatctgtcttcttcccttccccgtctgcttccttcatctcttccttggatggttcccttcctgcttccttgattctattctcaccccactatgttccataatgaataagaaaaatcaattaagcaaaaaattattctgaccaaagatgataggaaaggaaagaattcttagaggatcaccccttgagagagaattcagtctgtgttaattctttcaatctgagtaaagtcttccaggctcctgagcttgcctttctgtgtgatattgttacaggaaaggggtcccgatccagaccccaagagggggttcttggagtttgcgcaagaaagaattcagattgagtccatagagtaaagtgaaagcaagtttattaggaaagtaaaggaaaaaagaatggctactccatagacagagcagccccgagggctgctggttgccaatttttatgttttttttcttcttatctttttttttttttttttttttaagatggagtttcactcttgttgcccaggctagagtgcaatggcccggtctcggctcactgcaacctccgcgtcccgagttcaagcatttctcctgcctcagcctcccaagtagctgggattacaagcgcccatcaccatgcccagctaatatttgtattttttttagtagagatggggtttcactatgttggccaggctggtcttgaactcccgacctcaggtgatctgcctgtctcgacctcccaaagtgctgagattacaggtgtgagccactgtaactggactggttatttcttgatgatatgctaaacaaggggtggattattcatgcctctcctttttagaccatgtagggtaacttcctgatgttggcatggcatttgtaagctgtcacagcactggtgggagcatagcagtgaggatgaccagaggtcactctcgtggccatcttgatttttggtgggttttggcttcttttttttttttttttttttttttttgagatgttgtttcactcttgttgcccaggctggagtgcaatggtgtgatcccggctcactacaacctccgcctcccaggttcaagcgattctcctgcctcagcctcccgagtagctgggaatacaggcatgtgccaccacgcccggctaattttgtatttttagtagagacagagtttctccatgttggccaggctgctctcgaactcccagcctcaggtaatctgctctccttggcctcccaaagtgctgggattacaggcatgagccaccgcgcctggctggtttcggcttctttactgcaacctgttttatcagcaaggtctttatgacctgtatcttgtgccgacctcatatctcatcctgtgacttagaatgccttaaccatctgggaatgcagcccagttttcagcctcattttacccagcccctattcaagatggagttgctctggtttaactgcctctgacaatattatcagatcctaaaacacaatcttagaaatagctgctctttcaaaacactagacatatattcaaagccatagaaatgtgaatgctgacttcattgttaactgtgcagagagagggaaatgagagaaaatacatgtaaattagcatacttgtgttttcaaagttgtttttattttttattttttttgagacggagtctcactctgtcacccaggctggagtgcagtggcacgatcttggctcactgcaacctccgcctccgggattcaagcgattctcctctctcagcctcccaagtagctgggactacaggtgcttgccaccatgcccagctaattttttgtatttttaatagagatgggttttcaccatgttagccaggatggtcttgatctcctgaccttgtgatctgcctgcctcggcctcccaaagtgctgggattacaagtgtgagccaccattcaaagttgttttaacaatcttataaattcctttttttttttttttttttgagacagagtctcactctgttggccaggctggagtgcagtggtacaaccacgactcactgcagcctcaacttcctgggttcaagtgatcctcccacctcagcctgccaagtagctgggattaattttttctattttttgtagagatgggggtctcactatgttgattgggctggtcccaaactcctgggctcaagcaatcctcctaccttggcctcccaaagtgctgggattataggcatgagcaatggcacccagccttacattctttttgtaagttcaggtgagtttgatcttgtatcataatagtgaaggccctccttttttatgtatctttcttcttttttatttatctttatccctccctccctgtctccctcccttccttgcttccttcctttcctccctccctcccttccttccacggagtctctgtcgcccaggttggagtgcagtgatgcgatctcagctcactgaaacctccacttcccaggttcaaatgattctcctgcctcagcctcccaagtagctgggattacaggtgcccaccaccatgcccggctaatttttgtatttttagtagagacagggtttcactatgttggccaggctggtcttgaactcccaaccgcaagcaatccgcaggcttcagcctcccaaagtgctgggattacagccatgagccacagcacccggcttatcttttttctttaaaataatacaaactcattcaaatatacttggaaaatacggaaaataatagggaaggaaataaaaatcaactatttcatcattcagagatgatgatgattcggatgatttcatcactcagagtgaaatagtttgtgctgcctaaccaaattcaaaatcttggcagtttacaacaacaaacatttattttctccttcatgggcccatggctccactgggtctctgagtgccccgctgggcttggctgggcctgggttcaggctatgagttgggttaggtctgctgcacgtgttttctcatttttctcagatcagtagcttctgggagatattttttctcatggaagaccacaggaatgcaaaggtgtgagcagaaaaacaggaagccttttaaggtcttcacttaaaactagcatgctgtaaattttactcacatttcacgggccaacaccagtcctttggaggctgaggcagaaggattgcttgagcccaggagtttgagaccagcctgagtaacatagcaagaccctgtctctaaaaaaaaaattttttttttttttttagatggagttttgctcttgttgcccaggctggagtgcaatggcgcgatctcggttcaccacaacctctgcctcccaggttcaagtgattctcctgcctcagcctcccgagtagctgggattacaggcatgttccaccacgcctggctaatttttgtatttctagtagagacagagtttctccatgttggtcaggctggtctccacttcctgacctcaggcgatctatctcaacctcccaaagtgctgggattacaggcgtaagccacggcacccggcaaaaaaatttttttaattagccaggtgtggtggtatacacctgtagtaccagctatttgggaggctgaggtgggaggatcacttgagcctaggaggttgagactgcagtgagctatgatcatgcccatgcactccagcctgagtgacagagcaagaccctgtctggtttttctttttcttttttttttttttttcagatggagtcttgctctgttgcccaggctgcagtgcagtggtgcgatctcggctcactgcaacctccgggcccccccgattcaagtgattctcctgcctcagactcccgagtagctaggattataggcgactgccaccatgcctggctaatttttgtactttttgtatttttatatttttagtttcaccatgttggccaggctggtcttgaactcctgacctcatgatccgcccacctcagcctcccaaagtgctgggattacaggcgtgagccaccaagctaggccactgctcacccaattttaccaacaagaagactgagggttagatgatagcttcttaaactttaaagtatctatgcatcactggtggatcttgttaaaattcagatcctgattcaggaggtctggggtgaggcctggcccacttggaagtaaaaggctagaaggtctaagtcatttgcctcaaggtcaccccactggtaaagttcagtgccaggttttcaacctagcttcagtctgactctaaaacctgtacttttatcatctctcagagaccctgctccaagatctcttgcaactctaaaattccaattctggtgccagattaattggagaaatgcaaataaaataacagcaagcatgttctcgtgtcccagctgctcccagtggagtagtggatggagatgcttggttactttctcaggtcaaaggaggcttctgggcaaggcaggagcaagcttctgtacttttgttttgttttttaagatatggggtcttgctattttgcccaggctggtcttgagctcctcggctcaagcaatcctcctgccttggcctcccaaagtgctgggactatgggtgtgaaccaccacacacagcctgtactttcataactatatgacactcaaaagaattccttctttggcctagaaagccaaaccgacccactagtggtacaactcaaagacctgcctcagagctgcagcaaacgtataaagaagtcattataaaaatagcaaccacaggtcgggcgtggtggctcatacctgtaatcccagcactttgggaggccgaggcaggtggatcatctgaggtcagaagttccagaccagcctagccaacatggtgaaaccccgtctctactaaaaatacaaaaattagctggcagtggtggcgggcgcctatagtcccagctactcgggaggctgaggcaggagaatcacttgaaccctggaggtgaaggttggagtgagccgagattgcaccattgcactccagcctgggcaacaagagtgaacaaaacttcgtctcaaaaaaaaaaaaaaagcaaccgcatattgtgcccttaactgtgtgctaggcacttattaaattttcatgatagccctatgaggtaggactgttatcattatctttaccctcaaataaggaaacagaggttaaataacttacccaatgtacagctagagaaaagcagaggcagcattgactaccagagccagggttttacgtagacatatgttctatgtagcgctgttttcaattaatcattccagctgattatgaaaaaggatggcagccttgggacaaagggtttctatacactcccacgcccagtaaaatcccccatcagacatgatgacttacatatatggaatcatatatgaaatggctggtcctcttctctaatcttcttctgagaaaaacatctgccaaatagcaaaataagatacagtctcatggccaggcacagtggctcacgcctgtaatcccagcactttgggaggccgaggcaggcagatcacctgaggtcagcagttcgagaccagcctggccaacatggtaaaaccctgtctctactaaaaacacaaaaaaattagccaggcatggtggcaggctcctgtaatcccagctactcatgagactgaggcaagagaatcgcttgaacccgggaggtggaggttgcagtgagccgagatcacaccattgcactccagaaaagagcgagactctgtctcaaaaaagaatttaaaagtaaataaataaaaataaagatacagtctcagaaattatggattaactaatatagttggttcaactcaattcctccctgttcattctttttttttttttttttgagatggagtctggctctgtcccccaggctggagtgcagcggcgtgatctcggctcactgcaagctccgcctcccaggttcacgccattctcctgcctcagcctccagagtagctgggactacaggcgcccgccaccacgcccggctaattttttgtatttttagtagagacggggtttcactgtgttagccaggatgttcttgatctcctgacctcgtgatccgcccgcctcggcctcccaaagtgctgggattacaggcgtgagccaccgcgcccagcccaattcctccctgttcattctaagcctactatttgctcatgatccatgccttctagttaattgaactgtcatttaagagacaatttatggccaggtggagcagctgaagcttgtaatcccagagctttgggaggctgaggcgggaggatttggtgagtccaggagtttgagaccagcaagagcaacatagcaaggccctgtctctacaaaaatttttttaaaaaatcagccgggtgtggtggcatgtgacttggtcccaactactcaggaggttgaggcgggaggatcgcttgagcccaggagttcgaggttgcagtgggctataatcacaccactacactccagcctgagcaacagagtgaaaccctgtctctttaaaaaaacaacaaaaaaagatcatttatatatatgacctaataagaaaatacaccacaatacttcataaagtagaatctcatatcaaaggatcaaaggcctaatctgtgacgataataacagctagcatttgttgatcataatttatgtccttctttttttgttgttgttctttttaaaagtttttttcattaaaaaaaattttaacttaaagagatagggtctccttatgttggccaggttggtactgtcttctcatgctcccccacctacctggcctcaagcgatcttcctacctcatcctcccaaagtcctgggattacaggcactgtcataatctatgtcctttggacacattatctcatttaatcttcccaacaaccttatgaaggaagttattaggaaaactgggtttgaaccaggcagtctgaccccagcccttacataccactgtcctaaccccacacagagctttacttcctctctctgaaaccagtcctccgtgctgtgcaccctctgatggggggaaggtgtgcattgtttggagttataaagagaggcctaggcggctgggcgcggtggctcacgcctgtaatcccagcactttgggaggccgaggcaggcggatcacaaggtcaggagatcgagaacatcctggctaacacggtgaaaccccgtctccactaaaaatacaaaaaattagctgggcatggtggaggactcctgtagtcccagctactctggaggctgaggcaggagaatggtgtgaacccaggaggcggagcttgcagtgagctgggatcgcgccactgcactgcactccagcctgggcgacagagccagactccgtctcaaaaaaaaaaaaaaaaaaaagagagaggcctaatgaagaaatggtagctgatggaccttggaccaataaatcaggcaccaacttatctttatcaactgctgggtacagtaccagaacattataaatagacaataaatgcttagtgagcccaaatatcttgtttaattaagagttaactattgaaggtggtcttgtgtgtgtagaaatgaggggcagggcatgctggttggagggcatgttgcagcacatctttgccaagaatgagctcagcctgtcctggagagtcagcttgtcaacaatagagaattcattcagttgttcagcaaacaggttttgagcatctacaatgtgccaggtactgtgttacgggttaaggatataaagatgaataagacacaacccctgacttcaaatgcttcatggtcttaagaggtttggtgaggaggggcagacaggcacagatggaaacaaagacatgtgccatgcaggcttataaatgacttttaaagggtctagagaaagagctgaggatgaagagagaaaaagctgatgggggaagggagagagaagttggccattgacaatcaggaccctagaagcagtgagacacagaggacaaggaggtcagtgtgagagtgttggtgtaggtgggggagcatgagaagaccatgggcagaagagaccagctagggcattgcagacccaggtaaagcgccgctggactccttgtacatgcacactcagtccccaaatagatgcctttagacatgatcctctggtaagattaaaaaggcagctgttttccgtgtttcaggcaacaacttctaggaaacacttatgcatttgcctttctttcttttttttttttttttgagacggaatttcactcttgttgcccaagctggagtgcaatggtgcgatctcggctcactgcaacctccacttcctgggttcaagcgattctcctgcctcagcctcccgagtagctgggattagaggcacacaccaccacccccggctaattttttggatttttagtagaaacggggtttcaccctgttagccaggctggtctcaaactcctgacctcaggtgatctgcccgccttggcctcccaaagttctgggattacgggcgtgagccatcacacccagctgcctttgcctttctttttaactcctagtgacctagttattgaaaggagcaggaaaaatggtcacacccctaacattcctgcataaagtatttttaatatcagaagtaatccagtaaatcttcatggagtgtctaccatggaccaggcaggggccaaggagctgaggatacagctgtgaacagaacccctgacttcatggagtttacattcaagtggggccacaggcagccaaaaaaccccaatagatacacagcatgtgagggagtgacatacaacataagtaaaggaaagaaagcagggtaaggagagagaatgaggctggggaggggatattctgtatgggtggtacctgtaatcccagcattttgggaggccaaggtaaaaggatcacttgagtccaggagttcaaaaccagcttgggcaacatagtaagaccctgtctgtacaaaaatttaaaaataaaaaaaaaataaataaatgaaaagaccactctgatggagtgacagtggagccaagacctgaaggggtgagaagttagcagatggcttgtagaagaagaaattaaagtgcttgatgtattttagaagttacaagtaggcctgtgtggctggagagagcatggaagggaagagtgggaggagaggagcacagagggccggaagttaatcctgcaggggacctttggcttttgctctgagttagacgtgagccttggagagtttgcacagaaatgggccaaggtctggtttaccttcttaaggataactcaggcttctctgtgagggctggaatgcaggagacagggttgggcaaaaggaaaccagctgagaggctattgagaactgggaaagggaggctggtgttttgggtgagggtgggagcaagaggaaattgcaaaagtttatcttgttccggaaatattttgaaggtagagccaaaaggatttgctgatgggttggatgggagagaaagtgagtagtcaggatgacatgccttccaagccttttggccagacaagctgggatggctgccagttattaagaccgggaagacttcttgagaagaacctctttgaggatggaattcaaaagcttggctttggacacattagtttgagatgactattaggatatacaatatcctaattgtactggggacagtagttatcaaagtaaagatagtaaagatagtaattaaagttacaggactggatgagatcacctagagagtggtcacaggtagaaaagatatctgaccctcagggctctccagtgtgtggaggaggaggctgcaaaatagattgacaaggagcagccaaggagggaggaggagagtccagagacagcagtattctagaagccaaccgctgccgagaggggagcaagacagacactgaaggttaactgttgcatttggcatgatagatagagtagtggggatggacgcctggtgtccctatcagcatttgatgggaaaaaaatgggaggggatgaggagatagcaagagcagacatctcatttaaggagttttgtataaagtgcagtcaagaaaggccgggcgtggtggctcacgcctttgtaatcccaacactttgggaggctgaggtgggcagatcacgaggtcaggagttcaagaccagcagcctggccaacatagtgaaacttcgtctctcctaaaaatacaaaaaaaaaattagccagaaatgagtgacaaatgtaatcaaagttttacctgaagagacctgaagagaataaaacaatagcttccatatattgagaacttgtgagatgcttccatatattgagaacttgtggctgagcgcagtggctcacgcctgtaatcccggcactttgggaggtccaggcaggcagatcatgaggtcaggagttcaagaccagcctggcaaacatggcgaaaccccatctctactaaaaatacaaaaattagccgggcatggtggtgggtccctgtaatcccagctactcgggaggctgaggcaggagaatcacttgaaccaggaggttgaggttgctgtgagctgagatcacgccattgccctccagcctgggcaacagagcaagactccgtctcaacaaaaaaaaattgaattggggctgggtgtggtgggtcatacctgtaatctcagcactttagaaggctaaggcaggaggattgcttcagtccaggagtttgagacgagcctgggcaacatagtgagacccccaatctctacgaaagattaaaaattagactggatgcagtggctcacacctgtaatctcagcactttggggggccaaggcaggaggatagcttgagcctaggagtttgagaccagcctgggtaacatagtgagaccctgtctctatttaaaaaaaatttttttaattaataaaaaataaaataaaaattaggtgggcatggtggcacatgtctgtagtcccagctactccagaggctgaagtaggagtattccttgagtccaagaaatcaagactgcaatgaatcgtgatcatgccactgcactccaccctgggtgacagagtgagaccctgtcttaaaaaaaaaaaaaagaaaaaagaaatgggatgggagagggatcaagaaggaagtcattatttcatagttttaggcaatagacaatggaaaaccagtaggggaagaaattgaccctgcagaggagaggagtgaggcttgctagagtgatgtcctgaagtcattgagagtgggtggaagtgggtgcacatgtagcatgaggcgggcttagatgggtgcactggcagttcactcattgtcaaaacagggagggcagggtacatcgtggacacctctgttgggggaacatgtggacattctcttctgaccgcttcccattccttcctgctttgtctgtatgttgtcatgctgctgtttgcatcaactttaagatgcatctttttcatattttaacgtcaacatggtgaaactggaataaatcttaaaatcaatggaatgtcaggctgggtgtggtggctcacacctgtaatctgagcactttgggaggcagaggtgggtgaatcacgaagtcaggagatcgagaccatcctggctaacatggtgaaaccccgtctctactaaaaatacaaaaaattagccaggcgtggtggcgggcgcctgtagtcccagctacttgggagactgaggcaggagaatggtgtgaacctgggaggcggagcttgcagtgagccgagatcgcaccactgcattccagcctgggcggcagagtgagactccgtctcaaaaacaaaaaacaaaacaaaacaaaacaaaacaaaaaaatcaatggaatgtctaagtgttggtatttatttcttccaggtgctacatacaatgcagaaggctttttgtcaaaggtaacttggatatagtgaaccgtggaatgttgttactttggctccaactagagccctctgttgcagcgggcaaagtggggtcctgcagatgctgttcactttgacagttgggaagagaagccaacatctttataatagtaacaaactttgggctagggctctctctttattacacatacattcaccccaagcctctgcagacagctcccaggtgtctggggaggccagagaggggaggccggccctctgcccaccagctctcccaagagtgtgggacaccctctgcccactctcacaagagtgtgggagaccaaggacaaggcgatacttggcccacacctgaaactggacagaaactcctgactcagaggccaagccttcggccaagtcaataagagctgggcccctgtgtggtgaacacatcctgtgtggtgacgacaaggagaagtccaagggtctgagaatgggagcagtgtcacggcattgctggtggggttacttctccagcattgtcgactgttagtaggtgtgactttttacttcttggatgcgtgggaatgactttttacttcctggaggcgtgaggatggagctcagacccttttctgtggtctgaatctgggaatggttcgggaggttccctttgtccatttgttcataagacaaatagttgggtacttaccacacgctgtgctaagcactggatacgcaattataagcaaacccagaccgagcctctgctctcagagcttttatctagtcatggagatgcattaatgaaataataacagtaaaaggtttctttttttttttttttgagacggattgtcactcttattgcccaatctggagtgcaatggcccgatcttggctcactgcaacctccgcctcccgggttcaagcgatcctcctgcctcagcctcccaagtagctgggactacaggcatgtgccaccacgaccggctaattttgtattcttagtagagatggggtttctccatgttggtcaggctggtctcgaactccagacctcagctaatctgcccacctcggcctcccaaagggctgggattacaggcgtgagccaccacacctggccacaataataggttttaaaaacctactttaatgaaactgtgtgccagaccctgttttaggcaccctacaaatattaactcctgttattagtataataatctaagaactgctagatgcagtggctcactcctgtaatcccagcactttgggaggctgaggcgggtggattacctgaggtcaggagttcaagaccagcctgggcaacatggtgaaaccccatctctactaaaaatacaaaaattagctgggcgcggtggcatgtgcctgtaatcccagttacttgggaggctgaggcaggagaatcgcttgagcctgggaggtggaggttgcagttaaccaagattatgccattgcactccagcctgggtgacagagcaagactctgtctcaaaataaagaaaaaaaaaaaaaaacctaagaactaggtatgattaatatcaaccctgatttacagataaaaaaaactgaggcacagagaggcaaatttgcccaaggtcacacagctcataaacaatggagttgagattccaacccaagcagttttgcccaggagtcccagctcttagccagtgtggctaagttgcctttgttattctgtccaactcagttattctgatataaaactccctttgaggatggaaatgactgtcaatggaaaaaaaaaacaacaaaagcttttaaagatttaaagttagttttattcagaagtcttactgagggctatagaccaaggcctgtagcccaggagcagttctatgagactgctggggcacagtatctcagcccatggcccatatacaggcggtgggggttcaatatgttcaaagtcacatgagacttgctcagaagttgcattcaagcagaatcacattgacgtttcggtgtaagagcacaactggttatagattacagaggcatcatcactgaccttgtcagaggttatcttatgtgtaggcaaagacaaacactgcggtcatttatcttttaaggaatatagtgactcaggcaagagatgtcctgttttgtcttctaagcatctttccagagagctgtgtgtagacacagagtcaggagcttcgagaaattaagcaagcagaaatgagcaaacatgacttcttaacatttgctactttgtctcatatgactcaccaaggaagaagggattttagcatctgacaagccagctgtagctttgaagactgtttagggagcctgctgggcactgagtaataagcaatttgcatcgcacttctgtagtatcttgcatcttggtttctcttcccatcctcctcttcatagctccctcctcttttggctcatccaccgctaacttagtctttgatgcttttactttgacccccaggactttcctgttggagtgagcaggtcggttttctttgagctgtgcagcagcagtctccttggctaaactcaatccagcacaggaccactcccaagaaaggagctgctcaatatgggcagagaggtggggagtgatggggggtagagactgaaaatcagatgttaagaatagaagcaggccgggtgcggtggctcaagcctgtaatcccagcactttgggaggccgaggcgggcggatcacgaggtcgggagatcgagatcatcctggctaacacggcgaaaccccgtctctactaaaaatacaaaaaaattagccgggcgtggtggcgggcgcctgtagtcccagctactctggaggctgaggcaggagaatggcgtgaacccgggaggcggagcttgcagtgagccgagatcgcaccactgcacttcagcctgggcgatagagcaaggctctgtctcaaaaaaaaaaaaaaaaaaaaaaaaaaaaaaaaaaaaaaaaaggaaaagaaaagaatagaagcattagctgggtgttgtggtgcatacctcaaggttgaggtgggggattcacttgagtccaggattttgaggctgcagtggactataacatgccactatactctattaaaaataaaaaataacaattaaaaaaaaaaagaataggagtagctctagaccaaggttgtgtatcctggccaatgaaatagagtctttacacaacctgtcttttccacaggctaagttcagtgggccccgagctattcaaaactcaacacttttgcaataaaaataaaagttcctttagtaccttccacgttaccaagcccatttagagttctgatctcctttggcttcaacaacaaccctgggaggtattcctgggagaacacagaggtctcccagtcttcaaagctacacacttcacttgtcagacactaaaattcctcactctttggtgagtcatttgcatttctaaagtgagtttcctttcagaatagctgggctgaaatgtggttgtaagtgactgggcattagagctggcagaacacaacagagactgtatgcactttcaactccagactcttccacgacctctttctacctctcagacgaggtagtgcctggctgcaatttttcaagaaccaaaacttgaatgactgccatcattaggctctaaagtcaaaaattggcctgaattctccccccaaagaaataagcacctaatatttttcttcgtatgctgaaaattcagggaagctctgataacacaaccatttagcgttacatgcaagaaatgcttccacttaaggtcaagagtttggcatctgcttcctgaagccccttctgaatcatgttatttctaacaagaagatatgaattgtctatatttcataagatatagtgaagattaagtgagagttgttagtccattcattgtgttccccatacctgttaaaattttttccttccaaaattattatgctctctgtattagaccaattatagaagcagctgaggacttgagaagtattgtaaatagaacaaattttggctttagctgggaaaggaacagagattcagtcccttcttattgagtccagaattggtggtggatctggattcaggaaatcaggcagatgttggagccatttcactccctgcccccacccctggcccagcatacacagcaaagctccaaagacccagggtgcgttctgcaggcagttccttcatatgctaatgaacagttacaaaagctgaacagcaggaccaaactggtttctgtgggcccaagcagctgggaattactgccctacccttcttcccagagatttcacagaccctccttcttccacattcccaccagctgtccttaaattgccaggaacccacctgttttaactcatctctctcggcctgtgtggccctcagttatctttcttatcatatcccgacactctgagttctacaagcccctctgcctctgcttcctctccttaccaccccttctcacaggcctttgtctttccttcaggtgccccagggattccaggcaaacaacagcgtctgaccagccccatcagtactaagcactcttgagggggtcccagtggcagagcccatagcccgttagccttttgaatattcacaatgttcttagaaggcaggtaacatatccccattttataagagaaaacagggccaggcgcggtggttcatggctgtaatcctagcgctttgggaggccgaggcaggtggattgcctgagctcaggagttcgagaccagcctgggcaatatggtgaaaccccatctctactaaaaaaaagaaaaaaaaattatccgggcgtcgtggtgcatgcctgtaatcctggctactaaggaggctgaggcaggagaatcgcttgaacccaggaggcagaggttgcagtgagccgagatcacgccattgcactccagcgtgggtgacagagtgagactctgtctcaaaaacaaaaaacaaaaaaaaaagaaaaaacaggcacccaaagaaatgaagtaacttaatcaggatcataagtgacaagagccagcattcaatccagtcggacgctgcccaagcccttcctcctaatcacaacaactaccttctagaggcaggagacatttctaattggtggagggatgaggcaactctgaagtctgaaggaaaacagcatccgtgagagaaccaagatgcagaaccagttggtggaatccacagatctggccctgctgggtcacaggttctcaccctagtttccctccctgcctaaatcttgctgaggcttgtccttgatgctaactacatgtagctttcacacgcaggattgagagcatgcactggtctcaattcctcctttgacatccatgcctggttttcgtaggtgcatctgtctcacgtacctggagtcattgtgttaaactctaagatcctgggcttttaggaagtggctctgatctttgtctctctcaccctgatgttttatgaggatgatggcctaacagggtcctgccaggttgcagagggaagacctttaaacaagatgacttgtttaaatactatatggttggccgggcgcagtggctcacgcctgtaatcccagcactttgggagggcgggtggatcacttgaggtcaggagttcaagaccagcctggccaacatggtgaaactctgtctctactaaaaatacaaagcccctgtggtcccagctagttgggaggctgaggcacaagaattgcttgaacctgggaggtggaggttgcagtgagctgagatcacaccactgtactccagcctgagcaacagagcaagaccctgtctcaaaaaaaataaaaaataaaaaaaacaatatggtatatttaagattggctattataatatgctcttcactgtggttagtaacagcaataataataatcacctgcatttgtgtcatgcttttatggtttccaaagaacttttatgcacattttctttttttaattttcattatatttttaattctgtaatagatactaagtctcagactatttcttcttcatttaatttagcaataacttaatcagactaggaagaaatatttcaagggataggtggatttgcttaataaaaaattatgtttattttaaaagctctcagtgattattatcaaaccgtacagtagtccgagactgcagaaacaaatgtatgcgtcacaatatgtttatctctgtgttaccaaaacaataaaaacatgaaataatctggatattttacaagagtaaattaaaatctattgagaagatgaaatattctgctgcaattgaaaatggtgctatggaagaataagcatttggggaaatgttcactttgttgttgagtggggaaaaccaagtcacaaaaaaggaatgcaaatatcaatctgattttttattatttgtttatgttgggataaagtctcgctctgttgcccaggctggagtaaagtggtgtgatcacagctcactacagccttgagctcctgggctcaagtgatcttcccacctcagcctcttgagtagctgggattacaggcgcgtgccgccactccggctaagttttgtatttttagtagagacaaggtttcatcgtgttggtcaggctggccttgaactcctaacctggtgatacgccagcctcggcctcccaaagtgctaggattacaggcgtgagccaccacgcccggcccatttattcttaactctacctgcatgtcactgaggttggtggttggaaggatgacctttctatgacaagaaaaggaatcaatcaggtagaagttgtgttgcaggacttatctttagttcagctaaagacaggttctttgttccatggccatgaaaatccgggctcgcagacaatttgaatagtcagtaagatggggttttattgggtgaaaaggaagaaaagggggaaacagggattctcgcaaggccagagtccctgctacagagcttcccgcctagccctttgaatcccagtttccacacaggaagaggaagggccatgctcctccctgctgcaaacttctcgaagcttcatctcattgggcaggctggttggagtttcttccacctggctgtctcagttgtaggtggaagaaatagaaaggggaaaatggggagagtaggagggtgcaatcctaccactacagctacttatgtgggcatctcagcccctgcagatcaacctttcccatctctttaattagcatgtggcataatgactactctccacacctcagcccatcatgtacttatttcattaagtaatcgctagcacatatgctgtcgcctgactcttcatgaggggcgaggtgccagttctgcaccctagagcagtatcatttttcagaaggtgagattgctattgtggctgcatttcccatgatgtcatgactaactctctgtctacacatgtcccagtgacacatcacccagccacaattccagccccagtttgaaagtcttcataactcttttccttaaaaatatttctcgcctctccctctccccctccccctccccctctccctctccccacggtctccctctccctctctttccagggtctccctctgatgcccagccgaagctggactgtactgctgccatctcggctcactgcaacctccccgcctgattctcctgcctcagcctgcagagtgcctgccattgcaggcacgcgccgccacgcctgactggttttcgtatttttttggtggagatggggtttcgctgtgttggccgggctagtctccagctcctaaccgcgagtgatccgccagcctcggcctccggaggtgccgggattgcagacggtgtctggttcaatcagtgctcaatggtgcccaggctggaatgcagtggcgtgatctcggctcgctacaacctccacctcccagccacctgccttggcctcccaaagtgccgagagtgcagcctctgcccggccgccaccccgtctgggaagtgaggagcgtctctgcctggccgcctatcgtctgggacgtgaggagcccctctgcgtggctgcccagtctggaaagtgaggagcgtctctgcccggtcgccatcccatctaggaagtgaggagcgcctcttcccggccgccatcccatctaggaagtgaggagcatctctgcctggccgcccttcttctgagatgtggggagcgcctttgccccaccgccctgtctgggatgtgaggagcgcctctgccaggccgcgaccccgtctgggaggtgaggagcgtctctgcccagccgccccgtctgagaagggaggagaccctccgcccggcaaccgccccgtctcagaagtgaggagcccttccacccggcagtcaccccgtctgggacgtgaggagcgtctccgccaggcagccaccccgtccgggagggaggtgggggtcagcccccaccaggccagccgccccgtccgggagggaggtggggggggatcagccccctgcccggccagccgccccgtccgggaggaaggtgggggggccagccccccgcccggctagccgccccgtctgggaggtgaggggcgcctctgctcagccgcccctactgggaagtgaggaacccctctacccggccagccgctccgtccgggagggaggtgggggggtcagaccggccagccgccccgtccgggagggaggtgggggggtcagccccccgcccggccagccgcctcgtccgggaggtgaggggcgcctctgcccggccacccctactgggaagtgaggagcccctctgcccggccagccgccccgtccgggagggaggtgggggggtcagccccccgcctggccagccgccacgtccgggagggagttaggggggtcagccccctgcccagccagccccctcgtcccggggggtgaggggcgcctctgccgggccgcccctactgggaagtgaggagcccctctgcccggccagccgccccgtccgggagggaggtggggggggtcagccccccgcccggccagctgcctcgtccgggaggtgaggggcgcctctgcccggccgcccctactgggaagtgaggagcccctctgcccggccaccaccccgtctgggaggtgtacccaacagctcattgagaaccggccatgatgacaatggcggttttgtggaatagaaaggggggaaatgtggggaaaagattgagaaatcggatggttgccgtgtctgtgtggaaagaagtagacatgggagacttttcattttgttctgtactaagaaaaattcttctgccttgggatcctgttgatctgtgaccttacctccaaccctgtgctctctgaaacaggtgctgtgtccactcagggttaaatggattaagggtggtgcaagatgtgctttgttaaacagatgcttgaaggcagcatgctcgttaagagtcatcaccactccctaatctcaagtacccggggacacaaacactgaggaaggccgcagggtcctctgcctaggaaatccagagacctttgttcacttgtttatctgctgaccttccctccactattgtcctatgaccctgccaaatccccctctgtgagaaacacccaagaatgatcaataaaaaaaaataataataattaaaaaaaatatttctcacctgggcgtggtggctcacgcctgtaatcctagtactttgggaggctgaggtaggcagatcatgaggtcaggagttcgagaccagactggccaacatggtgaaacgccgtctcttccaaaaatacaaaaattagcagggcgtggtggcacacgcctgtagtcccagctattcaggcagacagctgaggcaatagaatagcttgaaccgggaggtggaggttgcagtgagccgagattgtgccactgcactccagcccgggtgacagagcgagactctgtctcaaaaaataaaaataataaataaataaaattcccattttttgatcaaatgaaaaaaaaaatctacaaagtagaaaaccccaaaaaccataacactagataatagttgaccactaatgcctgaaatgattatcatgagcgattatttctttgggtctagaaggcctttgtgtagatgagcgaccactatgaccaattcactccttgcctaccatccagacaccttagcctcactgccaacaagctaagagatgctggctgagtaagggcctactctggcttataaggacccctgcagctccagtgatttataattctaagtaaactaacactttaaagagatgagtcaagagctgcttgatggaaaatcactccaggcaaaggatactgagtgcaaaggaatgacgggggcatacatggctggagcaggatgatgatatgaatcacaggcgataacatcaaggaggtggtgtgtgtgtgtggatggggaagaggggacaggatgtgtaaacctttgatagattttggttttcactcagagggaagtggaaagcactttagtatttttgttttcttttcctttttttgttcttggagcaaaaaatggagtgttgctcttgttgcccaggctggagtgcaatggtgccatctcggctcaccacaacctccgcctcccaggttcaagtgattgaacagcctcccgagtagctgggattccaggtgcccgacaccacacatggctaaattcttttgtatttttagtagagacagggtttggccatgttggccaggctggtctcaaactcctgatctcaggtgatctgcctgcctcggcctcccaaagtgctaggattacaggcatgagccactgtacccagcctaattttcattttataattttttttttttttgagacagagtcttgctctgttgcccaggctggagtgcagtggcacaatctctggtcactgcaacctccgcctccaggactcaagcgattgtcctgcctcagcctccggagtagctgggattataagcctgtgccaccacgtctggctaatttttagtagagatggggtttcaccatgttggccaggctggtctcgaactcctgacctcaagtgatctgcctgccttggcttcccaaagtgctgggattacaggtgtgagccagtgtgcctggccaaataattttaattttttagagacagggtctcacttggttgctcaggctagagtgcagtggcacaatcacagctcactgcagcctggagctcctgggcttaagtgatccctctgcccagccacctgcatagctgggactataggtgcatacaaccacccctgggcaatttttttgtagaaatagggtctcaatatattgcccaggctgatctcaaactcctaggctcaaccaatccttctgccttggcctcccaaatttctgggattataagcatgagccactgcacctagcctgactccaagacttgatttgagcaattggaaggatggagttgtaatttaaggagagggggaagactgtgaaaagggcagtggaggtgtaatgaatcaggaagttagttttggacttatgcttgatatgcctgtagaaacatccaaggggggattttgaatagctagatgaatatgctatatgtctggattggggaaatcaggagtagaaatagaaatttgggagctgtcaacatatagatcgtatttaaaaccatgggagtgaatgaggtcaccaaaggaatgagtgtatactttgagaagaaaagaagtctgctgggcgcagtggctcatgcctgtaatcccaacagtttgggaatccaaggtgggaggattgcttgagcccaggtgttcaagaccagcctgggcaacatagtgagaacctgtctctacaagaaataaaaaagtattagccaggcctggtggtgtgtgcctgtagtcccagctactcagggcctgaggtgagaggattgcttaagcctgggaggttgaggctgcagtgagccatgatcgtgccactgcactccagcctgggcagcagagtaaaatcctgtctcaaaaaaaaaaaaaagaaaagaagtccaaagactaagctaggggcactcactccagaatatagtggtcaggagggtaggtgggaactagcaaagaacccacttctgagttgctaatgcgacagatggagaatcaagagaagagtgggcctggaagccaagtgaatagagcattccagaaagagggagaaatcaatcgtgtccaattctacagctaggctgagtaactgagaaaggactgaaagaggaccataggacttaccatgtggatttcattactaaccttgtccagagtgagtgctcaatgaatcagtgaataaatgagtgtaactttctccaactatatttgattaggacccagtaacttgggactttgtttctccaggaagagtttgacaaattatttgaatgaaataccttttccctcaatgtctaaactcctctttggaattgtaggtggtggaagattgcagaaggttcctaatctctggaagccaggcagtctagttgcctgtggtcatttctttgtactgttccacacagccatacaatactccaatcccttcagggcgaaggagtcatcaacacctgaaaaacaaatactatactcccaaaattacagaaaaacacctgcaaactgactcaagtgagtttagttcatttagtcaggctgggggaagaaaccacatttttgagataattaactcatagcattgttcaataaagtcttttattggaaattgtgatgattcaaggcatattcccataaaatacagtgaaaatttaaatcgaaagcagctggaccctgatgtattgttctctgaaagaggaagattccaccttaaaggcagtcattctatagcagttcccatttcttaggtgcttactatataccagaaacggtactaagaagtgctttatggacatttagcaaagtgaatcctcacaaccaccctacgagagaggtactagtatcattcccagatgatagatgtaatattaataagctacagatgaggaaatggatgcttgaaaagtttgaagggacatcttaggaatcagttatctcccctggggagggaccttcaggaatggcctgatccctatcaggagagctgtccgctgttcaggatgtcaaaggttcctgttctgcttctagaagtcagcttttcctgggaggaaaagtgggcatgggctgaggtgagagctggggtgcaggtggagtatgaagactcctcagagaaaggaaataaacaaaaaatatttattgagcttctaccatgtatcaaacccagtcactagtcactattttatcctcagacagacacctataaacctttaaaccacgtgtgtgtgtatatatatatatattataagaaagcttagagaggataagtaaacttgggatcacacagatgtcaacaaggggagaagcctgtccgggtgtggtggctcattcctgtaatcccagcactttgggaggctgagtggggaggatcacatgaagccaggagttccagaccagactggacaagatagggagaccccacttctattttctaatagaaattaaaataaaaaataaagaaaatttctttatacattgagctgaaattaaaccccactgtggcttccaccaatttttgctctctggagcaactcaaaacacatctaaatcctcttctacaagcgaatcctttaaatatttgaaaatacctatgtctctcttctgtgctcttctggtaccaatagtttaaatgggtaacagtagactttgttttattcaatcttttaaaaagcaaataaaaagtaagacatgctgggtgcggtggctcacgcctgtaatcgcagcactttgggaggcggaggtgggctgatcacgaggtcaggagttcgagactagccagaccaacatggtgaaaccccgcctctactaaaaatacaaaaattagccagatgtggtgcacgcctgtaactccagctactcgggaggctgcggccagagaattgcttgaacccaggagacaaagtttgcagtgagccgagatcacgccactgcactccagcctgggagacagagcgagactccgtctcaaaaacaaaaagtaagacattaccaatatgatgccaaccctcatgcactcatccccaaccccacacttctcttctcccaccccttctatctgcttttgtatttatttagcctatgggatcccaatgcagaggagccctggtggacgcatttatagtgcagcgatgaatagaagacagtgatagtcttatactggagttgaaatgtgataaacatttatacactgtgtttataagtcgtgtaactctggccaatttatctggtctttctaagctcactttcctcgtctgtaaaatgggaagaataatcatacttattgcgctggttgttatggggattaagcaagataattctctaaagctttggcacttggcgctgaaagtagccattccatgtcttctttcccgccccgcctcttgtgctccccaccgctttcgtgatgtccgcagttgcccacctgcctctacaataaaaaacgcatccctcctcctgcagggtccaccgcaccgggaagccctgtctgtatcagttaccaaccacaattgcagtgagtacgaatcgtggctttcccacagtcaggaaaggcaagggagaccgacgacccgcttctctaggagtaagtaaagattaaaggtagttcgcggtatagcctaggcagggattaacccgtggtcccagcgctcctgctatttgcattccaaagcagacacctcatgcgctcaaccccgcccgcaggcggctcccgcagtctaagggacctggcgcgagtccgggaagcggagggcgcagctgcgcagggaagggggccgggggcgggaccagggcgcgcgttccggtcccggggcgtggcctcccgcaggtgagtacgctgctccttcggtttccctgaaacctaacccgccctggggaggcgcgcagcagaggctccgattcggggcaggtgagaggctgactttctctcggtgcgtccagtggagctctgagtttcgaatcggcggcggcggattccccgcgcgcccggcgtcggggcttccaggaggatgcggagccccagcgcggcgtggctgctgggggccgccatcctgctagcagcctctctctcctgcagtggcaccatccaaggtgagaaacctggccaaggagggctcttatctctgaggagctggggtcctgggcacgctgggcagacggtgggatccgggcaggtgtgcgaaggctgttctgctgccggcacccatctctacgaatcccttagcctccccttggtggctttgatgtgaggtctctgcgccaaggaggcacccaggtgggacatgcgggagcagctgaagtcagcggagccgggcagaggcagagatttccccaaagaccccacttcccgtagaggctgtcatgctgggcacctccaggccccagcgtgggttcggggaaagggagggaaggaaggagtagctgtgtctaaagggtacgcagaggacctagtcccctccccgggcttggttgctttgtaaacactaagtcattaagagctttttgccaactccggagacttcctccgctggccccgcggggccggtggggttagcgagctgattgcgcagggcagggcggagtgggtgggaacccgcggcccgggagccttctaggttgttttttgcgtccctctccaactgctggaagcctttcttcgggttctggcccctgcgttcgagacccacccgggtcccgctgctcctggcacccacagtggaaggcccggggtatgaaagtcagggccggtccctgatgggttctggtggtaatgagcgctcaggcccgttgggcgccacgaggatttacgagcggaactttttggaccctgccttatatttgaccagttgaccctctgggcctggggttccgggactttcctagtgtgccacccggagcggccactggctgccacccaggtctgcaggccagaggctggctggcctgggaacagagcagcacttgcgcccggccgtcgcgttccttggatgtgctgctccgggtgtgctcgaacttgtattgctgggagtgtgttcttccgggcccagcaggcctcgctgtggccgtgggggatgtttgacctgcgatcgcgccactgtgatcctaaccgaggcccctctgtttggggcagcctgggtagcaaagggagcttttaatttccctcagaaatgcgcatttctcacttttatcctcctcttcataaagacgaagtaaaagagcaagtcacagtgggttggaattagatggaagaatgtgattcttttccctctgcagttagggaaaagggtgttaatggtgtaagcttgaaaactgtgcaccgctggtatatttttttttcttaatcagcatcagaataaaggcatttagttccaggaagtattgaaaactgtaatggacacctctcctctatgtcctttaaagttggaaacttaaaattcaggagcaaaggttagtatgtgcaaactttaaaaaaatacatgttggtatagctgattcaacatctttatgattcagagatccctgtaggaagcatgccccgattatttgtcttgttcttgtttactactcttgggggattgggagatccctggattataaggcgaacttgatttaacaataaggaaaaatcaggttacttgttaactatagccacttaatattgcaccttgttcctcatcctccccccaccatacttttattcccttgcaaagtaactttcccaaagggttagtgaagtaacactgacaattgatttaggcagatggagctttcctcccaccttaaaactaaattgattttaataagaaatacagtgttagcaaagcttttctgccctcagggtgggtctttgctcactcgctttttagccggtccttctgcgtgcccctcaggtggctgcagggccgatttggggtttgattttcttcccaaagcctcactccaaaagactgcctcatagaaacgaactcagccgagatcacaaccttctcagggtacaggtgaaggacactgaattgaggaggcaaggcaaggaaaacacttggaaatcagggcttctctttccctttacaatagtaattgataattatttgggtaaacatgcttaatatgtgtcctcactgcatcgttaactcctggaggcagggggccctaccatcctttccatcacgtctagcatagtctcatcacctacgggacctcagtaaatagcaaatgaatgaagtgaggagtcttgcccagagtaccctggctggtccatgtggtgttcatttcagtcagcttctctctgccacttacttatttttttccaccatgttacaggcctaggtcattccatttatcttttggagactggaacttctgttttctttataattggtttggtggtttttttttgtttttttggttttttgggttttttttttttttgactctcattcggttgcccaggcttgagtgcagtggtgcaattttggctcattgcaacctccacctctcccgggctcaaggaagtctcctgctgcagcctcccgagtagctgggacgacaggcacgcaccaccacccccagctaatttttgtatttttagtagagacagggtttcaccatattggtcaggctgatctcaaactcctgacctcaggtgatccacccaccttcagcctcccaaagtgctgggattacaggcatgagctactgcgccctacctataattgttttttaaattataaaaacaatatgtgatcactcgagggaaaaatgagccaaaacaaaaaaaggaaacatttaattaaatcaccctgaacttcagtaccaaagtagccaccgctaatatttcggcttatatattttcccactctttattacatccatgcacaaaatatgtattcacaaatacagaaaatatgtttgtgcaagtatgggattatataagcacatcagtatcatgtcaatacatataaaacatttttaatgactccaaaatgttacagaaggatgcatcaattttaaaattagtcctttgttgatagacatgtggtatttccattttttttttccccctgagatagaatctcactctgttgcccaggctgtagtgcagtggcacgatctcggctcactgcaacctctgcctcccaggtttaagtgattctcatgcctcagcctctggagtagctgggactacaggcgcacaccaccacatccaactaatttttgtgtttttggtataaacggggtttcgccacgttggccaggctgatcttgaactcctgacctcaagtgatccacctgcctcagcctcccaaagtgctgggattataggcatgagccaccgtgcctggccaaagttttgtaatatgacagaacactgcaatgaactggaagataggactttaaatttgatccttttgcttgctttgtagttactaaataaccttgatagatgatgttttagtaaatctgtatttgactttcttatggttttattagcttggcaagtgttgaagaaaacagttcattctgaaagaacacttctgaaaatgtactaaaagtttagctagggaggggcaccccacaattgaaacctttatttttcagtctgtgctcccaaagattgggagcaaaaaaggacatttggggtgaggggatcatagagaagagagggtgaaaggaagagaactaatgcaagtaaagtgcttgttttacacttggtttgatggggaggttgggccacaagaggagtatacttaaaataaaaattaaattaaaagttttaggccaagcgtggtggctcacgcctgtaatcccagcactttggaagtcaaggcgggtggatcacaaggtcaggagatcaagaccatcctggctaacatggtgaaaccctgtctctactaaaaatacaaaaaattagccgggcatggtggcgggcgcctgtagtcccagctgcttgggaggctgaggcaggagaatggcgtgaacccgggaggtcgagcttgcagtgagccgagatcgtgcctctgcactccagccggggcaacagagtgagactcagtctcaaaaaaaaaaaaaagttttacacgcagattttcccaaaattgtgtaaatcagaagggtctaaaaaaaagtgaaaatctctcattctttctggtctccaatctcagcacaacttctcgggttttgtttgtttggttggttggttttttttttttttttttgagatggagtctcgctgtgtcgcccaggctggagggctggagtgcagtgatgtgatctcagctcactgcaacctgcgctttccaggttgaagtgattctcctgcctcagcctctcaagtagatgggattacagatgcgcgccaacacctccagctaatttttgcatttttagtaaagccagaattttgccatgttggccaggctggtcttgaattcctgacctcaagtgatccgcccgccttggcctcccaaagtgctgggattataggtgtgagtcactattcctggccatcagctcaacttctctatgcacaaatgatttataggaatagaaggagcataccgtactgtacatactgtgctatgatttatttatcttttttacctaatcgattcatagtcagtttatagaaatctgtacaaactttttttttttttttttgagacggagtcttgccgtgtcgcccaggctggagtgaaggggcgctatctcagctcgctgtaagctctgcctcccgggttcatgccattctcctgccacagcctcccaagcagctgggactacagacgcccgccaccatgcccggctaattttttgtatttttagtagagacagggtttaaccgtgttagccaggatggtctcggtctcctgacctcgtgacccacctgcctcggcctcccaaagtgctgggattacaggcgtgagccactgcgccgaccctgtacaaacttttataggggggtaattgaactagtcctccccaccacacccccccccccttttttttttaaagagactgggtctggctgtcacccaagctggagtgcagtggcaggatcatagctcacccccagctaattttttttttagacggagctcccaagtagctggggctatggctaggttgccactatgcctggcctgaactactcccctcttcccgcccatccccgaaccccagatgaagtcttgctctgtcacccaggctggagtgcagtggtgtgatctcagctcactgcaacctccgcctcccaggttcaagcctcccaggttcagcctcccaagtagctgggattacaggtgcccgccaccacacccagctaatttttgtatttttagtagagacggggtttcaccatgttggccacgctgatctcaaactcccgatctcatgatccgcccgccttagcctcccaaagtgctgggtttacaggcgtgagccaccctgccagggcctgaactactcccctttttgatagatgttgaaattaacattgttttaccatgctaaacaatgttccagtgaatattctagtacataaaatagctttgtgcactttagctggtaggtgcagggcaaattcctagaagtaaattgctaggtcatatggcaaatacatttaaaattttgatatgttttgccaaattacccaccaaaaatattatatcaatttatattcctttgagatacaaaattcaaataatatagagaggtgtaaaataaaaagaaaagttctcttgtccccagctattctactccacagagccagccactttttattgtttggtggatatccttctagacttcagattttgcaaattgtacattataatttttttttttttttttttttgagacagagtctcactctgttgccaggctgaagtgcagtggcatgatctcggctcactgcaacctctgccttctgggttcaagcgattctcctgcctcagcctctggagtagctgggactacaggcgcgtgcactacacttagctaatttttgtattttttagtagagattgggtttcaccatgttggtcaggatggtctcgatctcttgatctcaggatccacccgcctcggcctcccaaagtgctgggattacaggtgtgagccaccatgcctggccagtttcttttttcaattgactgtatattgtggctgtctttccatttcaatattattggctactatattgtctacccttagtagtagggactacgtcagggacatgctaagttaggaatagaaataaggagctgtttgtctgtaactgagtggggggatgctgccttgagcatctgtgagtgtgtattttcacacacttgggcaataattgtttattacagccctagaaatgggaatgtaattgtagccaggcactttatttgtgtttaaacttcatttgtgcatttagtctctcctcaactctgtgaaatagaaatgattttacctggttgacaattgggagctgggatagcatcggttctctagacaagctctgtgagttttggtgagtggtaaggaccctgtacagagtcagagcaaatgcactgggcaagggcttcagggaccttcgagtagcatcttgacatttaccagtgttatagaacagttaatatcaacaatagttttgatggagaccattaaaggttatgtgttgaaatattctaagaaaaagttcctttttaaaaaaaaattgttatattgccattccttgctccttttttggtctttattttagcattcttatttaaaacagattttgagcactctttatgtgagctttcctgacttggtacatgcttatttttatggagaattttaatcttatagaaatatactattatagtgaattaagtgtatccaccactcaacttcaataattattaactgttggctaatcttgtttcatctattcccaaactcacctcccactcctcttccctgttatttcttttctgtttttttccctttcctatgatgccaagcctgtgttttttttttaacagctttaccaagaattccatatcagataatttgcacaccatacaattcacccctttaaactgtacaatttagtggcttttaggatgttcatagaattattcaaccattaccacaattttagaacatttttattaccctggaagaaacagtttagctgtcattcaccaatcttctggtcttagcccttggcaaacactaatctactttctatttatggatttgcctattgtagacatttgatagaaatgggataatgtgttgtcctctgtgactggcttctttcacttagcataatcttttggagattcatccatgtatctatgtatcagtacttttttttttttttgagacagagtcttgctctgtcacccaggctggagtgcagtggtgcaatctctgcaacctttgcctctagtttcaagtgattctcctgcctcagcctcctgagtagttgggactgtgggcccacaccaccacctctggctaatttttgtatttttagtagagactgggtttcaccatgttggccaggctggtcttgagctcctgacctcaggtgatctgcctgcctcagcctcccaagtacttgatttttgaaaacagccaaataatattccattgtatggatatactgctttttatttcttttcaattgttgatggacatttggattgtttccacttttttttcctttttttgagacagggtcctgctctgttgcccaggctggagtgcagtggtgtaatctctgacctcctaggttcaagctgtcctcctgcctcagccttcctagtagtgggactacaagtgtgcaccactatgcctggctaattttgtaaaatgtttgtagagatggggttctgctctgttgcccaggcttgtctcaaattcctggcctcaagcacttctcccatctcatcctcccaaagtgataggattacaggtgagcaccactgtgcccagcccacttgttgactgtgggctgggcacagtgctatattataatgctgctatggctgggcgtggtggctcacgcctgtaatcccagcactttgggaggccgaggtgggcggatcacaaggtcaggagatcgagaccatcctggctaacactgtgaaaccccatctctactaaaaatacaaaaaaaaaaaaaaaaaaaaaaaattagccaggcgtggtggcaggcgcctgtagtcccagctactggggaggctgaggcaggagaatggcatgaacccgggaggcggagcttgcggtgagccgagatcgcgccactgcactccagcctgggcgacagcgagactccgtctcaaaaaaaaaacaaaaacaaataatgctgctatgaacatttgtgtacaggtttttgtgtggactcctgcatacctgggagtggagctactgggtcatatagtaacttttttttttttttttttttttgagacggagtcatgctctgttgcccagagtgcaatggcacagtctaggctcactgcaacctccgcctcccaagttcaaatgattctcctgtctcagcttcccgagtagctgggactataggcgtgtgccaccacacccagctaatttttgtatttttaatagagatggggtttcaccatgttagccaggtgggctcaaaaccccgacctcgtgatctgcctgcctcagcctcccaaattgctgggattacaggcgtgagccactgcgtccagccatataggaactctttaaccatttgaggaactgccagataatttcccacaataactgtaccttttattttattttattttatttattttaaatagacatggtttcactctgtcgcccaggctggagtgcaatggcgtgatcttggctcattgcaacctgtgcctcccggttcaaatgattctcctgtctcaccctcccaagttgctgggattataggtgtatgccaccacacctgactaatttttgtatttttagtagagatggggtttcaccatgttggccaggctggtctcgaactcctgacctcaggtgatccacccacctcggcctccaatagtgctgggattagaggtgtgagctactctgcccagccgtgcaccagttcgtattcctaccagcagtgtctgagagtttcaattcctgtggttgtgaaataaatctcagatataatttcatcctaaagtattttagaatgtattaataaagtatgagggatttctttttcaaatataaacataatgccattatagtatctactaacattaatttttaatataatcaaatattcagtcagtattcaaatttctttcttttttttttttttttaatatagagacaggggcctcactctgtcacccagagtggagtgcagtggcacaatctcactgaatcattgaactcctggtctcaagtgatcttcctgtttcaactttccaagtatccaggactacaggtgtgcgccaccatgcctggctaattttttttttttttaattttttgtagagacacggtcttgctatgttggccaggctggtctcaaactcttggcctcgagcaatccttccacgtcagcctcgcaaagcactgggattataggcatgaacaaccgtgcctggctttgtgttcaaatttctaattgtcttataaatgttattttaggccgggtgcagtggctcatgcctgtaattccagcactttgggaggctcaggtgggcagatcacttgagatcaggagttcgagaccagcttgaccaacatggtgaaaccccatctctactaaaaatacaaaaattagctggatgtagtggtgtgcacctgtaatcccagctccttgggaagctgaggcaggagaattgcttgaacctgggagacggaggttgcagtgaaccaagatcgcaccactgcactccagcctgggcgacagagtaagactccatctcaaaaaaaaaaacaagttatttttatggtttgtttgaatcaggattgaaacaaggtacacacattatatgactgatatgtcttttaaatcttctactctataaatttcacctccacaccttttttttacctttgttcttcttcttcttcttttttttttttttgaagagatggcattgtgctatgttgccctggctggtcttgaactcctggtctcaatcaatcctcctgctttggcctctcaaagtgctgggtattgaaggcatgaggcactgtgcctggccctctttcttattttttgccttataatttatattttgtaaaaaacaggtcctttatcctgtagcagttcccagagtctcaattttactgactacatttgtggtgttgtttaacactttgcccccttcatttccattaatttggtgttggataatttccacaataactgcaccagttgctcagtctataacactaatcaagcactgaatccaacaccaaattaatttccagtatgttactttctaattgttacatacattgtcattctaagttaagtggcctgtgaaatcagtgttaaagaataataactggctttttataataatggaatagaatacaatagaaagtatcagtgcaccctatgtaataagaataattattattttgtgaaacgtttttccaccatggatatgtgtattgggaactgggttagtatgtggaatatggttcttaggggttatggtcaaatatttgaagaacactgtaatatgtaggaattttttttaaatttaaaaacaacatatgttctttttgaagaattatataaaaaaaatagaaccactagaaataggactatcctaagcatattagtttcttgtggctaccatagcaaattgccataaactgatgatgtaaaacaacacatttattctgtcagttctggagaccagaagtctgaaatcaaggaattggggccacaagccctccaaaagctctaagggagagtccattccttgccttttccagcttgcagtggctgctggcatttcttggcattcttggcctgttccttgatgtgactccaatctctgcctccattctcatgtcactcactcctctggcttctccttttctgcgtgttgcagatctctttctgcttttctctctgttttgttgtttgatacagactttaactctgtcgcccaggctggagtgcagtggcgcaatcttggctcactgcaacctccgcctcccaggttcaagcaattctcctgcctcagcctcccaagtagctagaactacaggcgcctgccaccacgcccggctaatttttgtatttttagtagagacagggtttcactatgttggccaggcttgtcttgaacttctgacctcgtgatccacccacctcagcctcccaaagtgctgggattacaggcgtgagacaccacgccaggcctctgcctttatcttagaaacgacacttgtcattggatttagggcccgcctagataacccagggagatcttcttatcttaggatccttaattctatctgcaaagacatttttgctaaataatgttcacagagtctggcgattaggacatagacttctcttttgggggcaccacctttcaacccactacactaagtgaaaagtgaaatattgatctctacatcccccaacactccacccaggctagcatcccaaatagggaagcattaagatgtgaaaaattctgcggaacattagtgtaaagcttctagtggaaaaatgatgaccaagcataacattatgagataagagcatgagtaggtttaatatccccctggtatacggcagtgcaagtattgccctgtcttctctgcttggtgaggcctacttttccccagaattagagtaaaattattcagtatccttatattgtccttacttactcctgcaggttcatgaatacttaggggcagaatgtagggaggacatgccattcatttctttgtggtttttaggtcaacttcataatataagagagggataataagttagcttgtcatgctacatgcttgaaagtctgtcatcagtacagccacctatccaggccagacggtttccctgccagttggcctccatgggacattctccaggaaaccagcacatgagcagggaaaatccctgccattgttgaggctatcgttgtgggtgaaaagggaatgtcccttgtggtcctggaatctccctgtggcaagctctgaatagggtatgatgaattgaataggccaggaaggatcctggctcagggctagagtgggatagaaggccattatgaagtgagaaattagaaaactggtgtcaggatggggatcgctattttacacacttgagaatttagaaaggaattactgcacattcctaaactgattttttttttttttttttgactgaggctcgctctgtcacccaggctgaagtgcagtggcatgatcttggatcactgcaacctccacttccggggttcaagcgattcttctgcctcagcctcccaagtagctgggattacaggcgcctgcgcctggctaatttttgtatttttaacagagtcagggtttcgccatgttagccaggctggtctgaaactcctgacctcaggtgatccacctgccttagcctcccaaagtgctgagattacacgcatgagccaccatgcccagccaaaccaaattttactaattgataaatcaaaggactgttgttggtcatgtgataagaatagctagagctgggcgtgatgtctcacacctgtaattccagcactttgggaggccaagatgggaggatcacttgaagccaggagttcgagaccagcttagtcaacatagcaagaccccatctctaaaaaaaaaaaaaataataagtaaaataaaaagaatagctggggactaatgagtgtggacagtttgtaaaaataaattgaaatattgttagtcttctttatattcctagaaatcgatgctccacatgcatcccacaactccttacaactccccgatacaaaaatactcactgtaagaaaaaaacccataaaaccaaactaaaccagacaatagaaatcccaataatctcattacacaaagaaaagcccctataagcattttgtgtaatcctctaatagtacatttctgttttcatctaaagtactttcatttgaggctgggctcagtggctcacacttgtatctcaccactttgggaggctgaggcaggagaatcttaaggccaggagtttgagaacagcctgggcaacatagtgagatcctatctctacaaaaagtaaaaaattagctgggtgtgatggtgtgtgcctgtggcctggctgtttaggaggattgcttgagcccaaaagtttgaggctgcggtgcattatgatcgctccactacgctccagcctgggtgacagcgagaccctgtctcataaattaaaaaatgaataaatgaatgtactttcatttgaacaaaccagtgttactgctgaaacatttatttctgtaatgacccttgtcttcctttcttgtacaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctcagctgaaattatatatatacacatatatatattttacatctgggatcatgatagacttgttagggcttcaaggccctcagagatgatcagtccaactgaacgaccttacaaatgaggaaaccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagtttttgtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaacttatttctgagttgtgcgtttgttttgagggaaggagtgagagaaggcaggcaacagcttcacccctctaaaagtggacactcacaccaaactctgtgacaacggtttttcatttaaaaatgtttcagaggccgggcacagtggcacacgtgtgtaatcccagcactttgggaggccaaggtgggtggatcacccgaggtcaggagttcaagaccagcctggccaacatggcaagagcctgtctctattaaaaatacgaaaattagctgggcgtggtggcagacgcctgtaatcccagctactcgggaggctgaggcaggagaatcgcgtgaacccgggaggtggaggttacggtgagccgagattgcgccattgcactccagcctgggcaacaggagcgaaactccgtctcaaaaaaaaaaaaaaagttttagaattctttctatacctgcatctgtaggttgaccgcttttcaaggatacaggctatttaacattttgggtatattgtgatgtatttaattaattccctaccaacggctccttaggttgtcatccccccacccttctttttttgacttttaaaacagtgctgcacccagaagtccagagtcgctgacaggtcctctgttatctaggtgttctcttcaagattccatttggtcatgcagccttggagaaataggaatgggatggaacttgccgtgtttatatttaatctcttaccttatatgcgtagtgtttcttttgagttgcgcataaatattccatttttgttttctacaaaaaaaaaaaaaagtgctgtatcaaatatctgtatacagacatctgtgagcatattttttgaggataagtttctagaagtagaatggccagctcaaaagttagatgctcattttaggttttgataagtcttgccaaattgtcttcagtaatgtatatttctaccaaaatggtatatttgcacctgtttcctgaaatgctcatccacattccatgctatcaatctttggtttcccaatcttattgttgttttactgaagaagcagcacagcctggtggctaagagtgcaggtcctgggctgtgctgaattctgactccatcactgcttacattagggatgtttttattacctcaagaagtaagaaaaaaaatgcgactcatttgtcaaatggggatagtagtatctcagtttcctcacttgtaaaattaggataatagtatcttcctcataaagttatgagaataaaattatttggcacgtttatgtggtcacaaatattaaataatattattattatgctctgtggacaagacctgttttctgctctgccccctttcacttcagtgtcactgctttctttgcctgttctgctttgagtctgattgcaggcctgtgaagttgtccccgtttgtcaggtgagaaatgagaaaatggtgggaacaggataaaagggagcaggaacaaatggctcacagagccccgaaggccatctgtagctgacctccacctcagtggagaacatttttttggtgtttgtcatttcttggttttttttttttttttttttttttctggtggggggtggacagggtgtcggtctattacccaggctggagtgcagtggctatttccacgtgtgattccactactgatcactatgggagtttttcctgctgcatttccctcctgggctggttcaccccttcttaggcaacctggtggtccccttctccttggaggttaccatattaatgctgaacttagtgcagacaatgatcagcatagcccactacagcctcacactcctggattcaagtcatcctcctgcttcagcctccgtattagctcgggcctacaggaacatgccaacactcctggctatagtctttttttttctttttgtaactatgcaaatctcttttttgtggctatactttaagaataaatgtgtatgaatgtgtgtacatacatatatactttaacttctaaatcagtttatataaattgtcctcataatttttttaactcattcactgtttctcattaatttatttttattttttttttggtagagacagggtcttgctatgttacccaggctggtctcaaactgttgaactccagagatcctccctcctcagcctctcaaaatgctgtgattacaggcatgagtcactgtgccctgcctgtttctcattatttttaatgaccaggtagtatttcatgtatgaatgacccaacatttagtcagaagtacctattaaagaacagatatttttcttggtttattttcaccaagcctttgaatctacattaaaaagtacaaaagaaccaggcgcggtggctcacgcctgtaatcccagcactttgggaggccgaggcgggcggatcacgaggtcaggagactgagaccatcttggctaacatggtgaaaccctgtctctactaaaaatacaaaaaattagctgggcgtggtggcgggcgcctgtagttccagctacttgggaggctgaggcaggagaatggcatgaacctgggaagtggagcttgcagtgagccaagatcgggacactgcactccagcctgtgcgatagagcaagactctgtctcaaaaaaaaaaaaaaaaactaaacaaaaaagtataaaagaaatgatttgagaaattaaaattatttgctaaagcaaaagcttattttttttttgagatggagtctcgctctgtcatccaggctggaagtgcagtggtgtgatctcagctcatcgcaacctctgccttccaggttcaagtgattctcctgcctcagcctcctgagtagctgggattacaggcgcccgccaccatgcctggctaattttttgtatttttagtagagacggggtttcaccaggttggccaggctggtctcgatctcctaacctcaggtgatccacccaccttggcctcccaaagtactgggattacaggtgagagccaccgcgcctggcccagcaaaagcttttcaaatcgttttgttctgcctttgaaaagtggcttagaaaaccccctggtctatctgaattaggctcctgattggaagcatgaggaactctggccctagcggagtagtaccttggatgtggttgtctttgctcttgtgttatatgtcatactgtggtctaatttctctaaactgagtcctaaaatgtctgaaaatgtaaatactttgaactccacaggcttatgtactaacagtgaggcctcttaatttgaaagtgaacgaagatttgcagtcctgatgctcaggacaaaggccagtgctaaactgactcggctggagttgttttatgggctttttcctaacgtgtcacctcagtggtttgcagcaggagtttcaaacctgtaattaatttcctggttatcaaggtttcataaactttagggctataatctcatcagtatgcatagtttagtgattacaactttgttcctgaaacattaaccctttggaggcccctgagaggactataatttattgcagaatcaaaggtagtacttgctgtcctccggatcttgattaaaatgataagtttttgcttgggtgtttagatgtcttctcaaaaagaagtttctgatgtggccagtcctttcctgacccccagttctgaagacaaaaaccaagcccttagtgatcagggatctagccctacattttattcaagccttggaacttcactgagatgattgtcccacttaaatgtcaacaattagagtgactcagaccaaccttggaatgcctctctggagggacagtttgaaatattccgtgatttgagtatgaactgctcttgcctctaccagtgggtcaatctatggactgtttcccagcctttgtctttattggtgagaaattaagcctgaccagagttacagacaacctccggtaaaaaccacagcccaagcctgcgggcccatcaagaacccagcagcagtgtgagtggttcaatccttcatcctgtgaaaggaaaataaatcctgtggccccaaaatcactaagctaatgggaaaagtcaagctgggaaccgcttagggcaaacctgcctctcctattcaaagttacccctctgctcactgagacaaatgcatatctgggccgggtgcggtggctcatacctgtaatcccagcattttggcaggccgaggtgggcggatcacgaggtcaagagatcgagaccatcctggtcaggagttcgagaccagcctggccaacaaggtgaaactccgtctctactaaaaatacaaaaaaaattagccgggcatgctgctgggtgcctgtagtcccagctacttgggaggctgaggcaggaacatcgcttgaacccaggaggcggaagttgcagtgagctgagattgcgccactgtactccagcctgggtgacagagcaagactccatctcaaaaaaaaaaaaaaaaaaaaaaaagcatatctgattgcctcctttctagaggctaatcagaaactcgaaagaatgcaactgtttgtctctcatctacctatgacctggaagccccctccccgcttcaagttgtcctgcctttccagaccgaaccaatgttcatcttacatacgttgattgatgtctcatgtgtctctaaaatgtgtaaaaccaaactgctctgagcactgtgaaccctaaacatttgagacagttctcagttaatttagaaagtttattttgccaaggttgacgcatgcctgtgacactgcctcaggaaattctgacgacatgtgcccaaggtgatcagggcacagcttggttttacacattttagggagacatgaaacatcaatatatgtaaaatgtacattggtttggtctggaaaggcgggataacttgaagcaaagaccagaaaagcagggaagggacttccaggtcacagataggtgagagacaaactctcttgcattcttttgagtttcttcctttccaaagaaggcaatcagatatgcatttatctcagtgagtggaggttgactttgaatagaacgggaggcaggttcgccctgtgcagtttccagtttgacttttaacttttagcgcagtgattttgggggcccaagatattttcctttcacaccaccttgggcacatgtcgtcaggacctccagaggctgtgtcacgggcatgtgtcctcaaccttagcaaaataaactttctaaattaactgagacctgtctcaaatattcagggttcacaattccacaaacattcattgcaacattactgcattattaaatgcaaataattaaattaggatttccaccttaacagctatccagttgaggggttgatgttctctcagtggaatacatcaatatttaaaaaaaaaacacaaaccccagaaacctaaccctccagtatatgggcttctcaaaagcctttaaagcatagcttattccagagctagatcctgagacaggcagaaagtcaaagtaaatgtgaaggacaagaagtttccagaagggccactactatggcttacccccctaaccactgctttgtttacaccattgcttgagcccagcagttcaaggctgcagtgagccacgaagccatgatcacactagtgagtagctactacaccccaccctgaggaacatagtgagacctcatctctaaaaaatgaaaaataaataaaaagaagaagaactgaatagaatagaatagatggcaaataggcatattgaaacataaaagatgcttagccttagtcattagaaaaatgcaaattaaaaaacccatacctattgagtagctaaaataaataagtaaatctgagagtataagtatataatgagaaatgaacaccctccctacccaccacatgggaacccgtttatacgccctctgtatattctttgagatgtttttatgcatgtataaacatgtatacatgctttttaaaaataaaaggagttacaccatgtattagttaaattacacataaattacctcaaaatttagtgtcttaagacagtcataaacatttactaactttcacagtttctgtgggttatgaattcaggagcagtttagcccaatggttctggcttaggatctcatgaggtaccaggtaagatactggctggagctgctgctagctgaagatgtgacgggggctggaggatcctccacagggctggcatgttggtggcagaaagcttcagttcccctccacgtgggcctcttcacagggctgttggactgacctcataacatgaagattggtgttccccaaaatgagtgatccatgagaacaaggggaaagccacaatgcctttcattacttagcttcagaggtcacacaccatcacctccaccatgctagctccaattgcttggtcagacaagctagctccaattcaatctgggagaagactacctagcataaacaccaggaggcgaggatcactggggattacatgggaggctggtttctgcattatatacgtgaacacatcttggatatgattgccatgttagcatttacagattgacctcattattttaaatggctatctccatgtgcacatataccataatttatggaatccagcttatgctatacttatattgctatataaataatatttgagtggaaatctgtacatacttgttaattcaatattcttccaccacgcactatgtgccaagtcatcttctaggcagtaaggaatattgtggagaacaaaatagacaagaactctattctcatggagtttactttctgattggagaaagactgaaaacaaaacaaaatatccaatagtagtaaatgctaagagtattttatattgggagatcagggaaggtttctaaggaggtgaaatttaagtggcaatgtaaagggcaggagagccagccatgggaggatcccaagcaagggctttatgggaatgagtaagggaaggaagagtatgagcaagtaggctggagagaggcaagagcttgataactgaagggaactgtaagggagtaaggagcttgattttctttctacatgggatgccataggtttgttttactgcccatttaaaaaatcactggtggccgggcgcggtggctcacgcctttaatcccagcactttgggaggccaaggcaggcggatcacgaggtcaggagttcaagacctgcctgatcaacatggtgaaagcccgtctctactaaaaatacaaaaattagctgggcgtggtggtgtgcacctgtaatcccagctactcaagaggctgaggcaggagaatcgcttgaacccgggaggcggaggttgcagtaagctgagatcatgccactgcactccagcctgggtgacagagcgagactccctctcaaaaaaagaaaaaaatcactggctattatgtggaatagggattatagaaggacaagatgagaaagcaagaacaatttggagtaatccaagcaagaggtgatgttggcttgaattagggtggtgctaacagagagggagagaagaagcctaaagtcaacagatgtgaaaagaagaggaatcaaagcttgtgcctagagtttctgcttgatggataatggtgaaataattaggagtgagcatgtttggaggttgaaagttaagagttctgttttgaccatggcatcttgagattgagatgcctgttagacatccaagcagcattgttgagtaggaggttgggtgcggtggcttacacctgtaatcctagcactttgggaggctgaggtgggaggatcatgtgagctcaagagtttgagatcagcctgggctacgtggcaaaaccctatctctacaaaagataaaaataattagcccagtgtggtggcatgcgcttgtggtcccagtgttactcaggaggctgaggtgggaggattgcttgaacccaggaggcagaggtttcagtgagctgagatcgtgccactgcactccagcctgggcaacagcgcgagaaaaaaaaaaaaaaagaacttggtgaggttacctatgttactagaaaggggtccagatccagatcccaagagagttttcttggatctcactcaagaaagaactcagggcgagtcgataaagtgaaagcaagttgattaggaaagtgaaggaataaaagaatggctactctgcagacagcagcccccatagctggtggttgcccatttttatggttatttcttgatgatatgttaaacaaggggtggattgttcatgcctccccattttagaccatatagggtaacttcctgatgttgccatggcatttgtaaactgtcatggtgctcgtgggtgtgtagcggtgaggataaccagaggtcactctcgtggccatccggttttggtgggttttagccggcttcttcactgcaaactgttttatcagtaaggtctttatgacctgtatcttttttttttttttttgagatggagtttcgttctttttgcccaggctggagtgcagtggcatgatttcggctcactgcaacctccacctcctggttcaagccattctcctgcctcagcctcctgagtagctggaattacaggcatgcatcaccacacccggcaatttttttgtatttttagtagagacggggttttgccatgttggtcaggctggtctcgaactcctgacctcaggtgatccacccgcctcggcctcccagagtgctgggattacaggtgtgagccaccacaccaggccatgacctgtatcttgtgctgacctcctacctcatcttgtgacttagagtgcctgtctgggaatgcagcccagtagtgttcagccttattttacccagctcctattcaagggttgctctggttcaaatgtctctgacacctagtggagagaatatagatgaagaaaagagggccctggacagaggccttcagcatgtagactcttttgagcagaggaagggccagtaagagacactgagaaggaccagccactatggcaagaagaaagtccagcaaatatgctgtcaggaaagccaagggcataaaggacagagtaatcaatcatggtgaaaattactaagaagccaagtgagatatgaacagaggagtgactacctgagcttgcccttggagaatgttggtgaccttggcaagaccaccctctcagtgatgtgatggggaaaggaagccagaatagtgtgttcaagaaagaattagaaggaaggaagtccacacaatgacagtgacaatcccttacagcaattttaattgtgaaagggagcaggggaatgcggaggcaagaaaggcaatgagagtcattcagcagagagggagacagtgtgtctttgcatgtattgtatttctataagtgaaggtggaaggatctcttgagcccaggagttcaaggccagcctgggcaatgtggcaagaccctatcgcacaataacaacaacaaaagtagccaggggaggtgctgtaaacatattgtctcagctacttgggaggctgaggcaggacgatcgcttgagcccaggagttaaaggctgtagtgagctgtgattgcaccactgcactccagcctgggcaacagagagagactctgtccaaaaataaaaataaaaaaataagaagtggaacttctgggtcaaaggatacatgtaattttgattgtggtaagttgccctcctaaggtgttgcaccagttacacacttgccaaaaatgtgtgtctgtttatctagagtgttgtaaacaccacattttcatggtcttttatttgccagtctgaacttcacaaattttgagtgtaatgataatgcaggaccataagcatctaggaagaaatagagctttgctttcttcctttatttactgttgggaacaggtcccccaaaatctggccataaactggctccaaaactggccataaacaaaatctctgcagcactgtgacatgttcatgctggccataacgcccacgatggaaggttgtgagtttactggaatgagtgcaaggaacacctggccctcccagggcggaaaactgcttaaaggcgttcttaaaccacaaacaatagcctgagcgatcagtgccttaaggacatgctcctgctgcagataactagccagacccacccctttatttcagcccatcccttcgtgtcccataagggatacttttagttaatcccatttcccataagggatacttttagttaatcgaatatctatagaaacaatgttaatgactggcttgctgttaataaatacgtgggtaaatctctgttcggggctctcagctctgaaggctgtgagacccctgatttcccacttcacacctctatatttctgtgtgtgtgtctttaattcctctagtgccactgggttagggtctccttgactgagctggtctcggcaatttactttgtattttaggcatattttccccctgctattcctcaccaccaaggcagtgaccctcaaaaggtacggccttgcgggaagttggtcccatttctctttgtattagctctgagaggaaacctaagctattcttctaggtgggctgcagaaaacttctgtgccgtgtggaacatcctttgctctgatgagttttctatcattcttttttggagaacatgagggcatggcagcagccactacagcaggagcctggagtcccagctctgggccctagccagctcacctgcatatgagggattaactctcaacactgctggatctggctcaggtctgagttcctcacctcagctccaccatgtagcctggggtgaatggcaaacccatggaaagcgtttaattatagcttctatgtaccatcgggtagactcaattacctaatcccgagaaagcagttttagccaagccttatgttgtgaactctttcagaggccacctgggctcttgcaggggaactgtgtctagttcttaccagtggaagtcagacttttttctttaaccagagatttgtgtaaatgggagactttgttaaaaatataacagatttatcagaatttatggcttaaaaaattgcagcacagggagggaaatgatggtgtttattctagtgaccatttctgtccattaaaactgaaattctttttttttaatctttttaaaaactgtgtttttttttttgagacagaatctcgctctgttgcccaggctggagtgcagtggtatgatcttggttcactgcagcctctgcctcctgagttcaagtaattctcctgcctcagcttccctagtagctgggattacaggtttccgctaccacacctggctaatttttgtatttttagtagagacggggtttcaccatgttggccaggctggtcttgaactcctgacctcaagtgatccacctacctcgctctcccaaagtgctggcattagaggcataggccacggtgcccagcctaaaaactttatgtttgtttgtttattttattttatttatttatgtatttttctgagagagaatcttgctctgtctcccaggctggagtgcagtggtgccatcttggctcactgcaacctcggcctcctgggttcaagcgattctcctgccttatcctcccaagtagctgggattacaggcgcccaccaccacgcctggctaatttttgtatttttggtaaagactgggtttcaccatgttggccaggctgctctagaattcctgacctcaagtgatccgcccacctcggcctcccaaagtgctgggattacaggtgtgagccactgcgcccagccctaaaaactttattatggaggattttatacccatacagaattaggattgtatagggaaactctatgtctccatcactcaggcccaatatccatcaacctttggtcaattctgccccatcctcctccccatcccgtttattctgaagcaaatctcaggaatcatattatttcactcgtaaatgtttcagtgtctaagacaagaaatttaaaaatcatacctcaaaaaatttcttaatatcagatatcctgtcagtgttcaaatttctactcatctcaattatcataagtggtttctttttttaaaaaatcagaatctaaataaagctcagacattgcaattggttgatgacttttaaatctcttaatttatctccaccctcaccacttgctacttacttgttgaagaaaccaggttgtttgtagattttccccatagtctggattttgctgattgcatccagaactggaaagtgtgaaagcatattagaggaaatgaaaaggctctgccgatcgagaactctggttatacaactgttcacaagcacttagcaggaacaacgaggaatgctaaaattcttatcactgtgccctcttatgtggtgcctgcctcatggtgatcttaatgttctcctaaagatagggaagaacaggaccctagaccacagtcttgtgcttgggagctacacttggacaggaatcaccacccaaaactggcaatgcagacagattacatgtgttttcttccgcagatttgttctgatctccccagacatccgtcattctataatcctacagtttggaccttcttagttttcactttcaggtgggaaagactagtaattaattaattaattaattaatgcttttatagagacagggtctggctctgtcacctaggctggagagtagtggttgcaatcacagctcactgcagcctcaaactcctgggctgaagtgatactctcaaccccagcctcctgagtagctggaaccacaggtgtgcaccaccatgcccagctaatttttaaaaaaaaatttgtagagatggtgtctccctatgttgcccaggctgtgttgaactcttgggctcaagtgatcctcccacctctgcctcccaaagtgctgggattacaggcttgaggcacagcacccagtcaagaggtttttgggttttgtttgttttttgagacggagtctcactcttgcccaggctggagtgcagtggaacaatcttggctcactgcaacctctgcctcccggattcaaacaattctcctgcctcagcctcccgagtagctgggattacaggcgcacaccaccatacctggccaagagtagttattttggaaagagagacgtttcaatcttcagaacatatctttggccgggtgcggtggctggtgcctgtaatcccagcactctgggaagccaggctgggaggatcacttgagcccaggagttcaagactagactgggcaagcaacatggtgaaaccccatctctacaaaaaaatacaagtattagccaggttgtggtggcataccctgcagtcctagctatttgggaggctgaagtgggaggatcacttgagcctgggaggttgaggttgcagagagctgtgattgtgtctctgtactctaccctaggcaatggagcaagactctgtctccaaaaaaaaaaaaaaaaaatttatctttgaattctttctttcaatatattgttatctgtatttctgtactgagtgctgtgcttcttgacctgtctctgcccttttctgtgtatttatttatttaattgacaagtaaaaattgtatatattatggtatacaaatacagcttgatgttttaatttatgtatacattgtggaattattaagtcaagctatttgacttaattgccccatatacttgtcattttttgggggtgataaagacacttaacatctactgtcttagcaattttcgatacacgatatattgttattaactatagatagcatgctgtacaatgggagctcttaaacttattcctcctgggccaggcgcagtgtctcacgcctataatcccagcacattgggaggccaaggtgggcggatcacttgaggtcaggaattcaagaccagcctcaccaacatggtgaaaccccatctctactgaaaatacaaaaattagccaggcttagtggtgggcgcttgtaatctcagctacttgggaggctgaggcagaagcttgaaccagggaggtggaggttgcagtgagctgagatgatgccactgcactccagcctgggtgacagagcaagactctgtctcaaaaaaaaaaaagaaaaaaagaaatgctgtgaggaattattagccatgaagcttcagcaggcaggttaggtagcttttccagtcacatactggtgaagtaaggatttgaaccccaagactctggtgccagagtaattgctcttcaccatgaggaggcaccagtgggggagtgttggatcacaagcagtttctttttcttttttttttgtttttttgagacggaatctggctctgtcacctagtctggagggcagcggcgagctcagctcactacaacctctgcctctcaggttcaagcgttctcctgcttcagcctcacgagtagctggaattacaggcgcccgccaccatgcctggctaatttttatatttttagtagagatggggtttcgccacgttgaccaggctggtctcaaactcctgaccgcaagtgatccacccacctcagcctctcaaagtgctgggattagaggcatgagccactgcacccagcgcaatttcgttagagacttggtgccttcccatttcttttactcagcaatataccagctttaggtcctaaattaaacctcttcctgctttcccacctgatgaagaaacgtgcctgcagtgtggtgagtctggaccacgcagactcagaacagcactactcacagcagggcctcttgctcgctctagctgctgggaggaaaacggcttgctaatctccacgcccagaaattcagacaagagcattctccttatctcatctgcacaggaagcaggtctaaggtaaaagattatttttgtggaagattcttgcttttcagtctagtggttgaagtgtgagcctggcaggcgttggattagagagggcaacaagagtggaggttgtgaggtggggggttgccttggggcttccactctaaaatgtggccttaccttggccacaaaggggtcgggggggtgggggagagagagagagagagagagagggagagagcagcctgatcatagctcggagcgtagaggttctggtaagttccttgccctaaagaacacttagttcattctggctcctttcctggtgaccatcctggcttcctgcttggccttcacctcaccttgagaaattcaagtttcatgttcttgtccaggccaaagacccagaagaaccttcaaggtgaggcttggccccttagatccacgccgtgatttcgcttctttttcctgaagcctgcacagatgccagtgtaagcccactcccaggaagtcacagcagtggtctatgctcctcctcttcacactggccagtgctgggcatgcctggacaatcagccctggaatggctgctctcagcctacagaagaagagagggaagagggatggaggggctggggagaagttggtgagaggacacaaaatttgggttagacagagaaataaagttttttttgttttttgtttttttctgagatggagtttcactctgtcacccaggctggagtgcagtggtgtgatctcagctcactgcaacctccacctcccacttggcttcccaaagtgctgcgattacaggcatgagccaccgctccccagcctcctcatgggatttttgaggatgacataaaggaatacatttaaactgcctagaagggtgcttggcccagagtatgtgctaattaacgttggctactattattttccttcaacccagtgccggtgcaggtctagaggaaagcatgaggtgatacaggggcacccagaggcggagtgctcccaggagctgaggggcatcggaggcttccctggaggactggcacctgagcagaggaatgggcagcacagtggcagtgccacgtgtgcggcacagatggtgcagaggggatgggtgggcacactgcggggagtttagatttagccaggggatggcagggcctgtccaggaggttaagtgaggagctcaggtgtgcctcccagcaggcaggggaggctaattttgaagaagagcaaagtaggtgcaggaggtgagttgggatctcatgcagtaattcaggccagaagtgacaagggcctgaactatggcgctagggttgaggaggaaggaacagagagtgaggagatacaacctggcaactgattgcatgagagagagagaggggccaggaatagcatcatactcaggtttctggccatgcagttgggtgaatgagggtattgctgttgactggagcagcaaaaaaaggggatcccctctggggtagaggaagaagggagcaggggattggaaaatgccaaaatcagtttgctgtggtttggaatctgagactctgatgtgttacctaagtggagatgtcctgtggtcagtttatttatactctcctgggtcctaggtaggatttaaggtgacatatgaagataacacaaagtagagtaagatattataaattaagtaggagagaaagcagacagaaaagaacgagatgtaaagtagaggaaggaatgaggttaaatataaagtacacagcagaaagcagaagtcacaagctggccagcattcgctgaatttcctgtttgagttgtcctgcagtcttatgtttgtctgttgggttttggtgggttttgtttgtttgtcttgagttgcagtcttaaaatccaggaattcttaaaaattaaaatttctcactttttcttttaaaaaaaaaaaaagtgaagttctgggagctctgagccatatcccatctggcaacgatgatctgggtctgagaagcagtctcgccttcttgggagagcacgggctctccaatttcccactggcctccactccacttggctgtctggcactgaagcagtgtcggtcctcttatcagcatggactatttctctgaactcacccttctatcaaatgtaataaaaaaaattagtcaagatattttttttttcttagtctcaattttgcctgtttacactagcagcctggccgtggaagcaggctgatgctccctgttcacaactgcttttcattctgcttagtgcctctgttgtatctgttgttaaatagtttgggctgggtgtaatggctcacacctgtaaccccagtactttgggaagctgaggtgggtggattgcttgaggccaaagtttgagaatagcctggccaacatggtgaaaacccatctctactaaaatacaaaaaaatagccaggaatggtggtgcacacctgtaatcccagctactcaggaggctaaggcacaagaattgcttaaacccaggaggcggaggttgcagtgagctgagatcccgctactgcactgcactccagcctgggtgacagagtgagactctgtctcaaaaaacaaacaaacaaacaaaaaacagcaaagtttgaacatgacccggctgtaggtatttgagtttgcagcatgtggtaaaatcaagtattcggcctaggtggctcatgaacttgattctaggctttctagcagccaaagaaaaagaggatacattatctgtcttatcctatcttatcagctgggctattcatagtatccatgggatgactgcttaggcaagtcaggactcttctcaacacaagaaccagagcaacatttttcccctgagagtcttcatagagagggaatgaaaagttcaaacaacattcatcccagagtcgattcaagtctaaggctgatgattctagcagcttcaagcagcatttcccttgaagcacagctgcttaaacaattctaggaggggccaatgtgatacagttcagacacctaattttctactgatctggctatattaatttcagaaactttagaaaaatctagagaaatgcctggactccctccaaataatcctccatagatggtctgaggatgtgatgcctggaattgcagcagtcatcttgtgactgtgcggggacaagtcagagatgagagctggcacacagaagatagggaagaagaaagatagatcttgggcccttgatagcattgacaaaacactgaaacaaccaacttttatagtaagagatagcaaattaccttattaagcttgaactacttttatttgcttattctattacttgctaatatggtttggatctgtatccccaccaaatctcatgtcaaattgtaatccccaggccggatgtgttggctcccatctgtaatcccagcactttgggaggctgaggcaggcagatcatctgaggtcaggagttcaagatcagcctggccaacaaggtgaaaccttgtctctagtaaaaacacaaaaaattagccaggtgtgatggtgcacacctgtagtcccagctactggggaggctgaggcaggataattgcttgaacccaggaggcagagattgcagtcagctgagatagtgccactgcactccagcctgggtgacagtgcaagactccatcttaaaaaaaaaaaaaaagaaattgtaatccccagggttggagtggggcttggtgggaggtgactggattatggaggtgtagttctcatgaatgggttagcaccatccccttggtgctgttctcatgatagtgagtaagtgaggtagcgtgagatctggttgtttgaaagatctttctttcttcctcctgctctggccatgtaagatgtgcctgcttcccctttgccttctgccatgatcgaaagtttcctgaggcctccccagaagccaagcagatgctgctatgcttcctgtacggcctgtggaactgtgagcccattaaacctcttttctttgtaaattacctagtctcaagtatttctttatagtagtatgagaatggactaatacagaaaaatagtaccaaggagtggggcattgctgtaaagagacccaaaaatgtgaaagcgactttggaactgggtaacgggcacaggttggaagagtctggagggctcagaggacaacagaaagatgagggaaagtttggaacttcctagagacttgttgaatggtagtgaccaaaatgctgatagtaatatggacagggaaggccaggcggagatgaggaacttattgggaactggagcaaaggtcacttttgttgtgcatttatcaaagaagttggaggcattgtacccctgccctagagatctgtggagctttgaacttgagagtgatgatttagggtatctgacagaagaaatttctaagcagcaaagcattcaagatatggactggctgcttctaacagcctatgcccgttacaggagcaaagaaatgaccagaaactggaacttatatttaaaagggacacagagtgtaaaagtttggaaaatttgcagcctagccatgtgttaaaaaagaaaagccctttttcaggggaaggattcaggcaggctgcagaaatttgcataactgaaaggaaggcaaatgctgatagccaagacaatgggaaaaggcctcaaaggtatttcagatatcttccaggcagcccctccaatcacaggcccaaaggcctaggagggaagaatggtttcatgggccaggccccagggccccatcacctaccctgtgtaagcaggcttgggacactgcttcttgcatctcagccattccagttccagctccagttccagccatggctcaaagttcctgccacttcaaaggttgcaagctgtaagccttggtggtttccacatggtgttaagcctgtgagtgcacagaatgcaaaagttgaggcttggaagcctctgcacagatttgaaaggatgtatggcaaagcctgtgtgtccaggcagaagactgccccaggaatggagccttcatagagaacgtctgcaaaggcagtgtggaggggaaatgtggggttgtagcccccacacagagtccccgttggggcattgcctagtagagctatgagaagagggccattgtcctccagaccccagaatggtaaatacaaggacagcttgtaccttgtgcttggaaaagctgcaggcactcaatgccagcccgtgaaaacagatgccagcctgtgaaaacagatgctgtaccctgcaaagcttcagaggccaagctgcccaaggccttcggagtccaccccttgcagcagtgtgccctgagacttcatgtgagacatgaagtcaaaagagattattttggagctttaaaatatttaatgactgccctgctgggtttcagacttgtgtggggcctctggcctctttttgggggctgatttctcccttttggaacaggagtatttacctaatatctatacccccagttgtatcttggaagtaactaacttgttttgattttacaggcttatttgtagaagggagttgccttgtctcagatgagattttggactttggactttggacttttgagttaatgctggaatgagttaagactttgggggactgttgagaagggatgattgtattttgcagtgtgagaaggacatgagatttggagtagccagaatgatatggtttggatctgtgtccccatcaaatctcatgttgaattgtaatccccaccattggaggtggggcctggtggaaggtgattggatcatgggggtggagttctcatgaatgggttaacatcatccccaaggtgctgttctcatgaaagtgagtgaatgagctagcatgagatctggttgttcaaaagtatgtggcacctctcccctctctttcttcctcctccttcctcctcctccggccacataagatgtgtctgtttcccctttgccttctgccatgactgagcatttcctgaggccttctgagaagcagaagctgcttgcttcctgtacagcctgtgaaactgtgagccaattaaccttctttacttttttgtttttgagatggagtcttgctctttcacccaggctggagtgcagtggcatgatattggctcactgaaacctctgcaccccctacctccaaattcaagcgattctcctgcgtcagcttcttgagtagctgggactacaggtgcatggcaccacacctggccaatgtttgtatttttagtagagatggggttttgccatgttggccaggctggtctcaaactcctgacctcaggcgatccacctgcctcagcctcccaaagtgctgggattaaaggcatgagccaccaaacccggcctaaccttcttttcttacaaattaccgagtctcaggtatttctttacagtggtgtaagaacagactaatacgcttgctgacaaaagtattgtaactagtatagccataacaaattcaagtccaaagaaagagaaccggaagccacaaacaatttaattttttcggaagagtttaagtataaaagcaagataggcaatagctggctatgaaaaacactggcatgttgcaagaagttttaagtctatgttccaggtgagtggaaataaaattgtactgatacgactctcaggggccttgggttaggattggggaagtagagttgaaaattgaaataatttaatttataggtaaaaccatcacagtagatgaaattgcctaggttgactatgtagagctctggagaaggctcacatccaaagggcagttcttaaaagataaggctgtggcttagtaaagaacatgaaggaagaagaattagagaacttggaggaaatccagcatagtgaaaggtcacagaggctgggcatggtggctcatgcctttccagcactttgggaggccaaggcaggcagaacacaaggtcaggagttcaagaccagcccggccaacatggtgaaaccccgtctctactaagaatacaaaaattagccaggcgtggtggcaggtgcctgtaatcccagctagtcgggaggctgaggcaggagaatcgcttgaccctgggaggtggaggttgcagtgagccgagattgcgccactgcactccagcctgggcaacaggcaagactccatctcaaaaaaaagaagaaagaaaagtcacagaaaccaagtgaatagaggcttttagaaaggtaggaatagggaacagtataaaatacagcccagtaatatgaggatgcacatatcaagtgatacccgtgcttccatatatatactctctgagatggcattttgtcagaactgtcttgggtaggatttgcccccacctcccgtcctgcccccattttttttttttttttttggagatggagtcttgctccgccacccagactggggtgcagtgatgagatcttagctcactgcaaactccacctcccggttcaagcaattctcatgcctcagccacctgagtagttggaactaccggcatgtgccactatccccagctaatttttgtatttttttaggagagacggggttttgccatgttggccaggctgatcttgaactcctgacctctagtgatctgcctgccttggtctcccaaggtgctgggattacaggtatgagccaccgtacccagccctattcttgttttaataaccaaagctgcagtcttctacaagaaatttcttacccaagagtttttagaagtaattaataagtttataataaaatgtaactccatgagctactaggaacttctttcttatttggtattaactaccgttttccttagctaacttaaaaagtggcttctgggaagtttttatttaaacagaagtgataaagcctgtacttgctaaaagatgggactgccagaaccagttttgctttgtcagttatcttttgatataaggtataaggcagggagcccctctcctgaggctatcaaaatgaggttccagaagtgtgtgagagtgcaagggattccaccacactcatttcaggcttctgccatcttctcttgccagtccagtcatggcaccaactggcttagggaacatgtcaagaatgagatgatgggctaagtgcggtggctcacacctgtaatcccagcactttgggaggccaaggtaggtggatcacctgaggtcaggagtttaagaccagcctggccaacatggtgaaaccccgcctctattaaaaatacaaaatttagctgagtgtggtggcacttgcctatagtcccagatactagagaggctgagacaggaggatcgcttgaacctgggaggcagagattgcagtgagctgagatcatgccactacattccagccggggcagcagagtgagaccctgtctcaaaaaaaaaaaaagggggtgatgggaaatggctgatccaacttaagtccagcgtgcccatcatccattgtcctgcctggacgatgacaagtagggtgggggctaattgttacacagtctaaaacacaaagtcttcacaattagcttctaaacttttatttcacaatgataaattatgtttataaatgattaagattgggagtttttcaattcacatccctatagagagatgatacaaaagaaacactgtaacttccaaagagaaatatcttaacttggtggatacacagactataaaataatctgaggccctgctggatggctcaggcctgtaatcccagcactttgggaggcccaggcaggcagatcatttgaggtcaggagtttgagaccagcttggccaacatggtgaagtgttgtctctactaaaaatacaaaaaaaattagccaggcatgagagtgcacgcctgtaatcccagctactcagtaggctgaggcatgagaatctcttgaacccagtaggcggaggttccagtaagctgagatagcaccactgcactccagcctgggtgaaagagcgagacagtgtctcaaaataataataatgatgatgataatctgaaagattattaaattatagccagagagtttgcattggctggagagatgtaaatattagaacatatgatgctcatataattaggagtgaaatcaagataggaggaatatatccttattacaggaactttggaacccagtgttgactaagattaggattcggagctgctttcaccaccacacaactatgtctgaactgctgagaaaagaaggagttagcacattgaaaacaagagaatgctctttctagaatcgaggtcttttggagacaggtagtattaaagctcccaagaaaagcaaataatgcaggatctttaccctcaggaccgcatccagctctgtttaaagtgagaagcctcggccgggggcagtggctcacgtctgtaatcccagcactttgggaggctgaggtgggcagatcacctgaggtcaggagtttgagaccagcctggccaacatgatgaaaccccatctctactcaaaatacaaaaaattagctgggcgtggtggcgggcgcctgtaatcccagctacttggaaggctgaggcagaagaatcgcttgaacccggaagtggaggttgtagtgggccaagattgcgccactgcactacagccagggcaacagagccaaaaaaaaaaaaaaaaagaaataagaaaatgagaagccttcatcacagggaggcgaactcccaactccagggaaaccatctgtctagaatgatgcaaccacaattagcctctgcaactctgggactttgagtaaattgggtttgtaacctaacccaaaactggcaaatccagtcttttaaggctaattctttgtggagaatctgctggttttctggatcaagggcagggcactctggagattcaaccagcttggcagaaatcagtcttgaatgaggtatatcagacagggctcttaattgccggcaataaaagttgactctagatgctgaggcagagaaagaactctgggtggctcacagaactcttttgagagcttcaggtgaatcttccaggaatgatgtccaaaaccacagaacagaattggccagatgagaagaccgctcccattgtggccaccaagcaccgaggctctgcttgactctgcagccattgccactgtagccagtatagatgctacatcgactccagcaactttcacctcatctgtggcagaaaacagagggaaaatatgggcttgcatcacagatcaaatttcaaagacagaaaacttttagagttgccatttatgaagggagctatagatagagtgaggagcaacttttctcctggagactctgagatggcccgaccctctcagctgctcaagaggggctgatgggaggcttttggagttctatgttgcaaatcacagaaacagactcatgacaagtaagccctaattatttttagtgaattatggaaataatcagatatgctccaagcagacattgctcagctgatgctgaggagggacagggtaatgctttgtgatgtgaggtgatgcttcggaatcagaaacaatgatttttgtttaaactgtgataagttaaaagcctattattaattctgttaagatattcaaggaggtcatttgcagaaaactcattgttacttcccataaattttcatttccttgattgtaataaaaggtgctatacaaaataggaaacagcgccttctcctgtaagagcatgacatgtgtgctttttgagaggccacgcatgatttcattacatattaatttctggaacattctaatagaagaaacgtatctatttacattgcactatttttctgaagagtcatgtaaaaaggattccaaacttttaaataacaagctatattaggatctattgttccgtaacaatttatccctaaatttagcataaaacagcaacaaacatttattgtttcatacagctgtgggacaagaattcaggagttgtttggttatggctctggcttttgattctcacaaggttgtgttgcagtcagctgaaggcttgaccctggctgaggatccactcctaaggtggttcattgcgtgcctggtcagttggtactggttgccagcaagaggcctcagtcctttgtcctgtagatctctccgtaggacttcttggatatccttacaatgtggcagctgattgcctccagagtgagtgattcaagaggaagcgaggcaaaagccaggattttttttttttttgagatggagtcttgctctttcgcccaggctggagtgaggtggcgtgaactcagctcactgcaacctctgcccccgggttcaagtgattcccctgcctcagtctcccaagtagctgggattacaggcacctgccaccatgcctagctaatttttgtatttttagtagagacggggtttcgccatgttggccaggctggtctcgaactcctgacctcaggtgatctacccacctcagcctcccaaagtgctgggattacaggcgtgagccactgtgcccggccaaagccaggatgtcttttatacccccgtctcagaagtcactcacagtttcccactgggaacacattctatgtgtttattttaggcttggccaatgtgactggctgaggttcagatcaagattcatctacttcatttggctcaagaataaatttgggaaataaataagcattcatgttatacttcttagtcatcagtataaataacgcattttcactccctattttcagagaaagaatcttcttagctgtcttctccagtatcttatttcaatgtttaacagccttcatggttagggatttttttttcctttaacattgtttaagttattcaccttcatctgactgcagcagtgacacaaagaagtttcgtatttctcctctgtcattaattctccatgtattcaatgccatgaaattacttctcttcttctggtgaaataattccagttttgttacctttttttctcatgctggcagggataaggagtgtgcgtgtgtgtgtgtgtgtgtgtgtgtgtaaactttattaggtagaatttcaaatatatagaaaagtagagtagcctaatgaactcccatgtacccagctgaagaaggagaatagggaattagggtaatgaagggttggggcataagcaaggaatagcaggggcagccagatcgcataagcaagggaacagaaggtatagccagttctaggcaagattgggcagcatacaggccacatcctcactcctgtgataacaagatggaagtctccacttcagccgctgattggtcacaggccaatccttcatagggtgtagccaattggaggcctctgaagagcacctaggagtgttacagaattctcttggctttataagaccctgaggagccaccaggtgcggtggctcacgcctgtaatcccagcactttgggaggccgaggcaggtggataacctgaggccaggagttcgagaccagcctggccaacatggtgaaaccatgtctctactataaatataaaaaaaattagctgggcacggtggcgcattcctgtagtcccagctactctggaggctgaggcatgagtatggcttgaacctgggagtcggaggttgcagtgagccgagatcaagccactccactccagcctgggcgacagagtgagacttgtgaccccatcgcgaaacaacaacaacaaaaaccctgaggagcattgcaataaaggggctcttgagctgcttgctcaagttcactcctgctctgtgaattgtaccttctcttaagaaatctgtgacttccttactctgttcttttgttgttttgtctttcgttgcttcttttttgctttgtttctgtgttttgttcaattctttgttcaacacaccatgaacctggacaactcacagtcaagaccttctatctggtaacaataggcaacaccatttaaagaagagagaacactttctgtagttcctggagtagagagacatctgactttcctggcagaaatgtggggtgaattatctaaacctgtttttctggacggtaggggccaggaggaaaagagtatagtcaaggctctccttgaacttcctccagggacctttgacctctacttcattgtctgaattgttttgctggaggaggtaaaacatgcacaccagtgtgcacacacacaagcactcactcacacagtggtccttaacacactttagaatcaaaaaattgtttaaaggaaagggaacttcaaggtcatttagcccaaggttgtcattttacgcttgtgaaaaaggaggcccatttatatcacataacttacggttggttagcacttaataataacctgtaatgcatttttagtaatattttgagcatgtgtcctcaattatattatctcttattttgttttattttattttatttattttttgaggcagagtctcactctgttgcccaggctggagtgcagtggcgcgatctcggctcactgcaagctccgcctcccgggttcacgccattctcctgcctcagcctcccaagtagctgggactacaggcacccgccaccacacccagctaattttttgtatttttagtagagacggggtttcaccgtgttagccaggatggtctcgatctcctgaccttgtgatccacccaccttggcctcccaaagtactgggattacaggtgtgagccactgcgcccggccaattatattatctcttgaaggctccagcacagggcaaatggttgccctaagtatgtgaaagaagccttataaactggaaacttaaatctagaattttatatgctaaatctttattcaacattataccttaaaagacagtgcttaatatggagataggttacaattttaaatactgtattattacaattaatgttttaactgaaaatgcaatttgtcagcagcattaaagaatttctaaatcctccgtaattctattaaacaatgaataaaactacagtcatgtgcccataatgacattttgctcaatgatggaccaaccacatatatgacaatggtcccataagattataatagaactgaaaaattcttcttgcttagtgaagtcacaccatcacactgtcataacacaacacaatacttacatgtctggggcgatactggtgtaaacaaacctgctgtgtttccagttgtataaaagtatagaacatacaattacactacatgatacctgataataaacagctatgttactgcttaatgcatactatatttttttttttttttttttttttttttttttttgagatggagtctcactcggtcacccaggctggagtgcagtggcacaatctcggctaactgtaacctctgcctcctgggctcaagcaatcctaacacctcagcctcccagaggcaggtggaaccacaggcgcatgacaccacatccaactaatttttgtatttttagtagagacagggttttgccatgttgcctaggctggtctcaaactcctgagctcaagcgagccacccgcctcagcctcccagagtgctgggattataggcgtgagccactggcctggcctcatttattatacttttttcttcttgaaagggaatctcgcctgtcacccaggttggagtgcagtggcacgatctcggctcgctgcaacctctgcctcccgggttcaagtgattcttctgcctcagcctccctagtagctgagactacagtcgcacatcaccatgcctggctaattgttgtatttttagtagagatggcatttcaccatattggccaggctggtttcaaactcctgacctcatgatcagcccgcctcagcctcccaaagtgctgggattccaggcatgagccaccacgcccggcctactatacttttaactgttagtttagcgtgtactccctcaattcataaaaaaagctaactgtaaagcagccttgggcaggcccttcagaaggcgttgttatcacagatgccagctccacaggtgttattgtccctgagaccttccagtgggatgagatgtagagacggaacacagcaatgatgattctgaccctgtgtaggcctaggctaatgtgtgtgtttgtgtcctagctctttttttttttttttttttttgagatggagtttcactcttgttacccaggctggagtgcagtggtgcgatcttggctcactgcaacctccgcctcccggcttcaagtgattctcctgccttagcctcccgagtagctgggattacaggtgcacaccaccaggcctggctattttttttgtatttttagtagagacaggatttcaccatgttggtcaggctggtctcaaactcttgacctcaggtgatccacctgcctcggcctcccaaagtgctgggattacaggcgtgagccactgtacccggcccatgtcctagtttttaatgaaaaagtttacaaagttaaaaaaaaaattaaaaatagaaaaaacttatagaataaaaatataaagaaaaaattgtacagctgtacagtgtgagtttcaagtgaagtgttattacaaaagtgtcaaaaagtttaaaaaatttaaaagcttataaagctagaatgttggctgggcgcagtggctcatgcctgtaatcccagcactttgggcggttgaggtgggtggatcacttgaggtcagtagttcgagaccagcctggccaacatggtgaaaccccgtctctactaaaaataaaaaaaaattagccaggtgtggtggcgggtgcctgtaatcccagctactcaggaggctgaggcaggagaatcacttgaacccgggaagcagaggttgcagtgagctgagatcacaccactgcactccagcctgggcgacagagtgagactccatctcaaagaaaaaaagaaaaaaaaaaagttacagtaaggtaaggttaacttattttgaagaaagaaaaatttttgtttgtttgcttgtttttgagacagggtgttgctctgtcacccaggctggagtgcagtgtagtgatcttggctcactgcaacctccacctcccagcctcaagtggtccccccacctcagcctcccaagtagctgggactacaggcatgcgccaccatgcccggctaatttttgtatttttagcagagacagggtttcactatgttgcccacaatggtctcgaaattctgggctcaaatgatctgcctgcctcagcctccccaagtgctaggattacagatatgagccaccacacctggccatgaaaagtattataaaataaatttagtgcagcctaactgtacaatgtttatgaaggctatagcagtgtatagtagtgtcctaggtcctaggccttcacattcactcaccatttacttaccaactcacacagagcaacttccagtcctgcagcctccactcatggtaagtgtcctataaaggtgtactattttttttatcttttatacatatttttactgtaccttttctatatttacctacacaaatactattgcattacagttgcctgcagtattcagcacagttatatgctgtacaggtttatagcctaggagcaataggctatgccatatggcctaggtgtgtagtgggctgtaccatctacgtgtgtgtaagtataccctatgatgttcacacaatgacaaaatcacctaatgacgcatttctcagaatatatttctgtcattaagtaacacaggactatttcattttccctctttaggtacacaacatttatccattacagcatatgtataatttctactttgttagtttcacttaccattttcctgaaattttttttgcatttttgtagtctttataattctaattttaaatggctgcatgattttatcttttgtcagacaagcatgggtctgagtctcagctctgctacgacatagttgtgcgattctaggaaagcttctttctttccttttaaaaatagctttgagttataattgacacacaataaactgcacgtatttaaaatacacactttggtaagtttgacatctgtatacaccagtgacaccatcaccacagtcaagataataaacatactcaccaccctcaaaagtgtccacccttctgaggtccgtccctcccactgagattcctcatgctgttgctaggaaaatgatagaacatttgaatctggttacataaaaagacaaaaactggagagtttaggaggaagcaacttagcctcctgtatgactgtagtcttggccccagggcagttcctggctcagacactctgggggtatcctcagtctaaggagggtgtctgcctgcccggttgacaggatgcctcttcttcacatacgtcttgtctttcagagtccatgaccaatgcctcacttacaaatatcttttctccttttgctcccacctttgtggatatttaccagttttttttctctaaaatcatccttactttttttttttctttttttttttttgaggtggggtctcactctgtctcccaggctggagtatagtggtgtgatctcagctctctgcaactgagttcaaatgatcctcctgcctcagcctctcgagtagctgggattacaggcatgcataaccatgcccgactaatttttgtatttttagtagagatggggtttcgccatgttggccaggctggtctcaaactcctgacctcaggtgatccacccaccttggcctcccaaaatgctgggattacaggcgtgagccactgcggccggccacagtcattacctttaagctccccccaaatctgatcatttctcccattctttgcacactatctcagacctttacgccctaagggctatgactcataccaaaattgcaaagtgcaatggaaataattaatagagcaagcaaggtgcataggataaccctctgtgctatcaacaggtgtgtctccccctcctgggatttcatgtcacccgtaaatttgtgtctctagcctgacagattctttttgagccttttgacattgcctttgtttctgaaagtctcctggagggcaggggctgaggctgggttatataaagataagcccctgaagaaagggctttataaataggatttcaagtgcattctgggaattagagggctgccaggtgcagtcctggagattgacactaaggggcagcatgtaccaaaggatatatttagctctgccaaagcccagtagaaacaaagagaaaatcaccttgcttttaaaccccaagagccaagatgtagaagccacattttcatctcttgaatcaaattacagcattacaattttcaatatctattctattaggagttttacctgccaactgagttctccgagtaaattattttatggttaaatatgatataaatataatactgttgagacccatatactctgtaagatttactgattttagtgcatctataacttcaacaacttaatttggaattaaataatattttattccaaattcaaactcttttttttttttttttttgcgacagagtctggctgcaacacccaggctggagtgcaatggcattatctcggctcacggtaacctctgtctcctgggttcaagcgattctcctgcatcagcctcccgagtagctgggactacaggcgcatgccaccacatctcactgctttttgtatttttagtagagacggggtttcaccgttttggtcaggctggtctcaaactcctgacctcaagtgatctacccgcctcagcctcccaaagtgctgggattacaggcgtgagccaccacatccagctcaaactctttatattcattgacatgactgttgtctgtctgtctgtttctctttctccctttgatgaagcaaatttttatgtggaataaaggcaatcaaataattatttggcagttaaactagacaaggccaactcttggggaatcttatgtttccctctctgattgatttgtttatgaattcatccatcagtgaggatttctgagcacttccatatgcctgtccctgtgctaaatgctgtggaatgcatagatgaaccagatatcaaccctgacatcaaggaactcattcaaagtgtggagggtggggaacatacggcagacaaaaaaaaacgtgatgttgggaatgtatggtaagtgcaatgatgagaaaaacaaacataaggtaggaaataggagaggacagagaaggcacctatcagagatggggggatgtggggtgggtagttgggaagagtgcaggaaaatgtccaagaggagatgacatttgaactgatcttaaaggagcagatggaattagctttccacacagtgtgctcagaacctgcaaaggcatggaagaatgggagctcccaacaccatggtcagtttgcaggcagggccaaccctttgaatggccaggagcgtgggtgttgatttgtgatttagatcagcttctctgacagcagaatagacgtgagaatggaggggcatggtagaaagtagaaagagcagtaaggaagccactgcagtaatagggaccaaaaattaaaaggccccaaaggtggtgaagaatggagagaagtggaccagtttagctggtatttaagaattgtggctgggtgcagtggctcacacctgtaatcccggcactttgggaggctgaggcaggtggatcacttgaggccaggagttcaagaccagcctagccaacatggtgaaaccccatctatactaaaaacacacaaaataattagcccagcgtggcggtgcccacttgtaatcccagctactcaggaggctgaggaaggagaattgcttgaacccaggaggcagaggttgcagtgagctgagatcctgtcactgcacttcagcctgggtgacagactaagactccgtctcaaaaaaaaaaaaaaattgtgacagaagctggtgtgaccaaggaactggatgtttgagatgactgaggggatgagttttgcttaggtcccgtgagataaagtagaaaacgtaaaaagacgtatttactcatttctgcttgccagtgtaatttcacaagcccctgactctgtgtagacacccagctctccagaaaaatgctttgaagacaaaggatacagcatacagtcccgtgtctcggctgagtcatcgcattccttaataggtaaataagcctaattaatgccttttcctataggtaacataatgtctgatggggttagggatgatgcctctgtaatctataccagatgtactcttatacacaaaccttgatgtgattctgctttaatgtaacttctgcaagtttgatgtgactttgcatgtagtgaacccccaaggcctgtgtagaagctgcgggtggagctaccttgctggagcagtctcacagaacccctctgaagggctgctcccaggatgtagaccttggtctatagtcctcagtaagattcctgagtaaaactagttttaactttctaaaagcttgatttttttttttctttagtggacagtccgaattgagtttgaaaagcttgtgggacattcaggtagagatgtggtccagcaggctgttggatagatggttctggagcttagcagacagatctgggccaagaaatataatcttgggagagactgaaattataggagtagctgagaccacagtgggaacaacatttaagagctggagaggggaaagtgctttaaaaaatgaggaggaggctgggcacgctggctcacatctataatcccagcattttgggaggctggggtgggaggattgcttgaggccagaagtttgggaccagcgtgggcaacatagcaagactccatttctacaaagaaaaaaataaaataaaatcctaagctcctcaactgactgaacagaccctctcttggcccaggggaccccagagaaacctgaacaactgaattccaggccttgatgggaagagaggtcagacaggcctcattgtacctctttccttttgggataccaaattccaacctcactctggtagcatcacatgacagatagcagaccatgaaggaaatcaaaatattttaccccaaaatagacttctctgacatattttgaaatggtcctgtaaagccgtcttttatgggggaaattttgcatctatagagaatctccattaatgcagctaggcctttccagatctaggagaaattaactaggaatttgacactttttaaggtccaaaaagaaacatttatcatttattctctctgaaggctgctacctggaggtttcatctacataagaagaaccttggcttccacagccccctttatcttaactcaagaatttctttctgctgacttcaagtctttagacaacaatgcttaactctttcaacaaattgccaatcagaaactctttttttttttttttttttttagacagagtgtcgctttatcacccaccctggagggcagtggcatgatcttggctcactgcaacctccacctcccaagttcaagtgattctcctgcttcagcctcctgagtagctgggattacaggcatgcaccaccacacccggctaatttttttttgtatttttagtagagacagggtttcaccatgttggccaagctggtctcgaactccttacctcagatgatccacccaccttggcctcccaaagtattgggattacaggcgtgagccaccgggccctgcccgaaaatctttgaatccacttgtgatctgtaagccccatacccctgcctttttgagccaaaccaatgtacaccttacatatactgatttatgacttcgcctataacttaacatataaaaccaaattttggccaggtacagtggctcatgcccataatctcagcactttgggaggctaaggcaggaggatcacttgagcccaggagtttgagaccagcttgggcagcatagtgagacctcatctctaaaaaaagtaaaaaataaaaaattaaccaggaatggtggtgtgcacctgtgtgtggtctcagctattcaggaaactgaagtgggaggattgcttgagcctgggagttcgaggctgcagtgagccattattgcaccactgcactccagtctgggtgacagcgggagaccctatctcaaaaataaataaataatgaactaaattgtaacctgccaccttgggcataccttcttaggacctcttgagacagttccctgggccgtggtcactcatatcggctcaaaataaacctctttaagtatttcacagagacaatgtaaggtggctaaagcctgtaatcccagcactttgggaggccaaggcaggaggatcacttgaggccaggagtttgacaccagcctgggaaacatagggagaccccatatctacaaaaataaaaaaattagtcaggcatgataacatgtgcctgttgtcccagctactcaggtggctgaagcaggaggatcgcttgagcctgggaggttgaggtgcagtgagccattactgggccactgcattccagcatgggtgacagagcaagactctgtcttaaaaaaataaataaaataaggctgggtgcagtggctcacacctgtaatcccagcattttgggaggccaaggcaggcggattgcgtgagctcaggagttcaagaccagcctgggcaacatggcaaaaccccatctctactacaaatacaaaaataaaaataaaaattagccaggcatggtggtgtgaacctgtagtcccagctacttgggaggctgagatggaagaattgtctgagcccaggaggtcgaggctgcagtgagctgtgatggcaccactgcactccagcctgggcaaccagagtcagaccttgcctcaaaaataataataaataaataaataaaataaatattgtatagagtttgttttttccattctgagtaggtgctatggtcatccccatttagactaatggggaaaatgcagcatagatgctaattgaccagcacaggatcacacaactagtggcagaggtgagaggtaaagccaggcagttcatgcttttagccaccatgatactgcctcccacacaggaaaaatttacaaagggtaattactagggtagggaatggtgagagagaattttactatttcatactcctaagtattcaaaatattattttacctatattactttgacaataaaaactaacaattttttttttttttttgagacggagtctcactgtcacccaggatggagtgcagggacgtgatcttggctcattgcaacctccacctcctgggttcaagcaattctcctgcctcagcctcccgagtagctgggactacaggcgtgcaccaccatatccagttaatttttgtatttttagtagagacagggtttcaccattttggtcagggtggtctcgaactcctgacctcaagtgatctgcctcccaacgtgctgggattacaggattgagccactgtgcccagcctgaatatgtttgaaaattttgtgttaggtgtacagtgaacacctcctgggaaccttgcagggaggttgcagtggagtagccaggcagcaaggccaggggcagatgggatggttgaggttacatactgactactttgttgaagggaaataaaaaggagatcctggcttgctttccgtataattaagtttcagtcctgagagaacaggcaggatttaaaagcacagtggccaatatctggctttggtttttacatggactctttctttattaagtttctctcacttggaaatctgttgtggattcctgcacacacagctgctctgaggtttatttcaacttttttattaggtaatacattcctataactgaaaaagttaaaatcacttaaaaaggtgtacactgggaagtcttactcccaaccactctgttctaccctttccccccttacccctgacagctcccaacatagtattatattttgtttcctttcagtgactccttaggtaactgcaagcacacatacacatgtattatttcttttttacacagttgggagcactgctttgtacctttctaaatcagtgcgtggagcacttcctctttttttttttttttcaactgtcctttgggttagtttaatctactatgaatttactcccttgtccttgctattggctttgctgagtcatctccaggttggaactagtgtttcttctttgctcccctatttttagagttcttccccatcatcagcttcctagcaactaattgcatttctatccacactcccctaaagagagataaggcttcctcttgctttgtctttgccttcttatctaatgcacccaatgagcactagccttcttcaatgacccttggggcagcagctcacacctgttcattttggtgattaaatacggagcagaggcacctccctttgaatctcttgtcactggcaattttcatcttcccggaaacaggtgtgctggggagaacgtttccccctcccccacgtataaatgcttatagtttaatggtaaacaaccattgacagagctgtgtatctgttgaacaggtaggtattttccttcctatttttatttatttttaaattctatattttagtttgactttgtacctgttacctggttgtcttatgaatatgctggagctgctacctcttgggggtgtagggattagcgaggagaaacaactcagctgcgaagtgcttatttgcagcttgccccagcaagggtggaacactctttaatgaaagactattattattattaattttttttttttgagacggcgtctcgctctgtcgcccaggctggagtgcagtggcgcgatctcggctcactgcaaactccgcctcccgggttcacgccgttctcctgcctcagcctcctgagtagctagctgggactacaggcgcccgccgccgcgcccggctaatttttttttgtatttttagtagagacggggtttcaccgtgttagccaggatggtctcgatcttctgaccttgtgatccacccatctctgcctcccaaagtgctgggattacaggcttgagccaccgcgcctgcgcagactattatgtttttaacaaccatcacttgtgtggcgagctgactcgggggattgtaatattctgttttaatgaaagtgttggtgtttcctcatctgtttattctgaacaagtgtcttctccccgggtttggtggcctgcttctggagtggtcagttctgctgccgacatgcccacccagctcgagatggccatggacaccatgattagaatcttccaccgctattctggcaaggaaaggaagagattcaagctcagcaagggggaactgaaactgctcctgcagcgagagctcacggaattcctctcggtgagtcaggcctttgtaaatgctgtattcatttgagggtagatgaggtgcagattccaggacagcctttgggttcatactgtcctgtgattctgtcacaaatgcagccaaatttgtacagagattcaaaatataggggaagcaaacactggagacgtttgttttctgtgtacataggcatgtgccctttttcgtgttacctggggttagggtttctaagtggtaaaaattgtatttttgactttcaccaattaacattctggtgcggcaaagatgtagctaattatagccagagttatagttataactagttacagctagttatacctggagcttggtccagctgtctgtaaattatgtattgggccagaggtgaaggggtactttaccttcagaggtggggtacttcatgctatggtggcaaattttctagtgaatggcaaatacttagagagctttgtcagccgagcacagactgattgggattgatagaaggatgtgtttggccagtgaccagtggggtagcaaacagattcatttctcaaaatagccaggagtttgagagattaatatatgaagccgtacattgtagcgtttggggcctcctccaaggaaaacacttcacgctggtgtttatagagttgacttaaactgatttttagcacaatatgctaccctcgtgtgatgttattctctccaaaccttgtgttaagactacagagactgttaattacaacacatgtttctccccaccctctatttgggaaaagctctataaagtattttttaacttagtcttcacgacatttttatagtgatcttagaattcccacaaacttttcttttcctctcattccgtttggctactgtatttttttttttttcggagatggagtcttgctgtgtctcctaggccggagtgcagtgacacgatctcggctcactgcaatctccacctcccaggttcgagtgattcttgtgcctcagcctccggagtaactgggattacaggcatgcaccacgacacccagctaagttttttgtatttttagtagagacagagtgtcactatgttggccaggctggtctcgaactcctgacctcaagtgatctgcctgcctcggcctcccaaagtgctgagattacaggcgtgagccactgtgtggggccaactttggctactgtactgtttaacatttagcataaaaactcagtaggtcaaacttcgcacatttatttaatcaagtacaatttataattgttttaatcaagttggttttgatcaattaagtttttctctgaccatttaatggttagcagaaaatgaggggggcatggggatttcctggaggaaatgaactgcttttggaaacactcctcatcaacaccagtcacaggagaggtgggtgcttcacagttccaaccttcgtgaaccttgtcttccctcttctctttgctttccacccataaaatgcaggcatctttataagacctacctttctttgggtgcctctcttctgtgtgtcaggcacactgtgctaagtaggctgccagataaaatattttgtgtcctatacaatacttgagacatactaaaactaaaagttatttgttgtttatttgaaattcaaatttaactaggtatctagtatttttatttgctaaatctagcgaccctggtgctctaagcactttcaaaagtgtgatgaagtatccctgaaatgtgtggatagaaattatcctcccaattttataaataaaagcatttaaaatgttacgcgatttgctcaaattcgctcgttggtatttttctcctttttggcttcaaatcctccctctttctatgtcactcgactatctcctagtgtcctggctctcaacctgtgatgtcctgtaaatgtgtttttagcaacagtcactcactttgatcagctgctgtttgcttttcttggtttctaggtctgagccaggattatatggagctggggcagggggctagattcgtttagaattcgtggctggtttacacctacctgtaaataggttcttagaaaatgtctttagatgctataaatggaaattaggaatttaatgtaaataaaaggaagatgaatttcaattgtcatcatgaacctcagagccagggagttagaaatttcctttctcattttagtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggtaagtaataagctcatctaaaggcagaaatatatccaaagttatgtacttaatgttcatttataccgttcagatctatagacccagtaatgtcatttatagctataatatccagtgcatatattaataattaattgctactattgaattatgtgccccttaaaatattgactttatgtagatattctaaatctcatatgccctacttgaaacttgcctgtattattaagaggctatatgcatctttttggtttgtcaaaacgagggcattacaaaaatttagctactttcaaatgagacttgaatttggcaaatttctaagatggacattcatatccttaaattgtattttgaacttcttaccctattaaaaaaaattaactgggtttcctcattctcttgtgactgtgtttcagatggaaggtgtgagggtctatgagcagaaaggcggctaagcagaagtgctggctttttcagtgatttcgtcagggaatggataggttcagggctaggtggtcaagccgagagagctgaagccagcagctcttgtgagctggcatataaataccctcctttgccccttgggttggataattctgaggcaagtgtttgacactatttcccactgtttccccctggggctgagcctcggtaggccccaagggaggccaccttttcttccttatctcactttcctgctccaaccctgagttttctgcatctctcaaataaatgacttctacacgaaccctggcctcagggtctccctcttggggaacccaaactatgatagatcctttggagaattttaagaaagggagtgatatgattatatttatgcgtgtaaatgattaccctaactactgtgtaaagaaaggactatagagatggcaatcgtggcaggcaaccagctaggaggttgttgctgtggtctgggtaagagatgatggtatatcagaccagcagttcagcactggagatgaagagaagcagctgaattggttaagtattttggagctgggactgataggacttgctgatggattcatagtgaagtgtgaggaaaagagagaagtccaggatgacaaaacaaccgttgctgtttgcccatctgatatctgttcttcctttcttctatgtatcagaaccctggtttgtgcagggtggcaatgtgcctggctaaaaagccatatttcctagcctctctaacagccggtgtggggcttgtaatagttctggacaatgtgagacaagcagaaggctactgggaatttctgggaatgttttgctattgtagacaagaacccatgtagctctttgtcttccaccttgttgagtctttccttgtctttttttgttgttgttgggatgtggatgtgaggctggaggtggaactgctatcttgcaactatgaggaccgtggagaaaaaagatagaaggagcctgggcattgttgtcatggaggagcctctgcacagccttgcttgcctgcttctggtcctctcattatgtggggggaaaaaaatgacagctctctggttatctggttctattacatgcaaccaaacacaatctgtaaggtttagggttttgatcaagcaaatgatgccttttactaaatgggaaagactgagggaagaatcactttggtgtgaaggcatgtgggcagatcaatagctctgtttaaggtggtattggacatccaggtggagatatcacatgggaagttggaaatatgatctggtctggatctcagggtaaatgggggactggagatagagttgggagtcatttgtgatcttaagccacaggattagaggaggtcactccggatgagaatgtggatagagaagaagaaacgtctgacagtttgctgtaaagaaaaggaagagcccataagtgatacaaaagaggcatggccagggagaaagaaggaaaaccaggagagtgtagtgtctcagaagcctagagaagacagcacgtggagaaggaaagagagaaatccattcagaggtgaagtaggatgagaacgaagacttgaccactagatttgggaaggtggaggttgtctcacgcatctgtgtgaagagacccccagacaggctttgtgtgaacaacatggctgtttatttcacctgggtgcaggtgggctgagtccgaaaagagagtcagcaaagggtggcggattatcattagttcttataggttttgggataggtggtggagttaggagcaatgttttgcgggcagagggtggatctcacaaagtacattctcaaggatggggagaattgcaaagaactttcttaagggtgggggagattacaaagtacattgatcagttagggtgggacagaaacaaattacaatggtggaatgtcatgagttaaggctattttcacttcttttgtggatcttcagttacttcaggccatctggatgtatatgtgcaggtcacatgggatatgatggcttagcttgggctcagaggcctgacattcctgtcttcttatattaataagaaaaataaaacaaaatagtggtgaagtgttggggtggcgaaagtttttgggggtggtatggagagataatgggtgatgtttctcagggctgcttcgagcaggattaggggtgacgtgggaacctagagtgggtgagattaagctgaaggaagattttgtggtaaggggtgatattgtggggttgttagaagaaacatttgtcgtatagaatgattggtgatggcctggatgcggttttgtatgaattgagaaactaaatgaaagacacaaggtccaaataagagaaggagaaaaacagatattaaaggactaagaattgggagtacccaggacatccaattacagagtgtccaagggagttcagcataattatttgcttggttgttgagtttttgggtgctatccttgagtttttttatgttgtcatataccaggccagattgatttaggtaaaaacaacactcttcatttaaaaatatacagagtcccctttttttcttcatttaaaaatatacaagagtaccccttttttagtcagggcctcgggaattttggaggaaagagaaaagcaaagccagcaattgtttgttaaagaaggattagaaatggctaggagagagtgactgagactgatatagtgtggtggagatagctggggagaggtagagagtggcataaaaatggggacaagaataagagcaagtataaaagtaaagaataggacttcatcagggtgaaagtattggagtgtactttgtcactgaagaacttctatccacttaaagagagacttaagggtggcagtttgaggtaaaacctggagccactaaataccaagagcctgagaaactgcttgggtgatttgactaataaaggccggtctgttattggactgtatagaagtgggaaggccaaaccaaggaattatgtttgacagaagggaagaaattaccacggtggccttctcagaccctgtgggaaaggcctctacccacccagtgaaagtgtctacccagaccaagaggtattttagtttcctgatttgaggcatgtgagtaaagtcaatttgccagtcctgggcgggggcaaatccccgagcttgatgtgtagggaagggaggcagcctgaacaatccctgaggagtagtagtagaatagcagatggaacactgagaagtgatttccttaaggacagatttccatgatggaaaggaaatgagaagttctaagaggcgggctagctgcttgtaacctacatggaagaggttatgaaatgacgatagactagaatgggcttgtgaggctggaaggagatattttccttggtccaagaaccatttgccttgtgtgggaagagattgataggtggaagtttcagtgggggaataggtgagaatgaccagatgagaaggagaaaaactgccatgagggttagaagttggaactctagctgcttttttagctaccttgtcagcataagcattgccctgagtgatggcatcttatgccttttgatggcctttgcagtgaatgacttcagcttcctttggaagtaaagcggccttgagaagagtttttattaaagaggcattaatgatggaggacccttgcatagtgaggaaacctctttcagcccttataacagcatggtggtgcaggatatggaaggcatatttacagtcagtataaatattgacgcgtagtccctttgcaagagtgagggcttgagttaagacaatgagtttggcttgctgagaggtagtggaggggggcagaaattatatgcgtcaggtgtgaggaagaaaatagattttggaagttatgagaactatagagagtgagttgagcacagtttgtgattttgagggcctctaaaagtattaaggcagcggcagccactgcacacagacatgaaggctaggctaaaacagtaaggtcaagttgtttggataaaaaggctacagggcgcagtcccagctcttgtgtaaaaattccgactgcacagccctgcactttggctgtgtgtaatgaaaaaggattgggatgagttagggagagctagtgtgggggcagcttctagggctgtttttaaggaacggaaaggagtggcaaaaggatttaggatctgtggggtcagctaggtttccttttgtgagtttatataatggttttgttaggatggcaaaaccagtatccaaaggcaaaagtatccaaccatgcccaggaaggaaaggagttgttgttttgtagaaggcattggggtttgggagattagtcagacgtgatcagcagggagagcatgtgtattttcatgaagaattatgtcgagataggtaatggatgaggaagaaatttgggcttgactgaagtaatgggggctgtccgtgaagccttgtggcagtacagcccaggtaatttgtgagtctaatgggtgtcagggtcagtccaagtgaaagcaaagagagtctaggatgaagggtgcaaggaatagtaaagaaagcatgtttgagatccagaacagaataaggggttatggaggggttgtggagggtggtattgaggataggagagtatatgggtttggcaccatggggtggataggcaagacaatttggttgataaggcgcagatcctgaactaaggtaaggcttgtcttgttttaggacaggtaaaatgggggaattgtagggagagtttacaggctttaaaaggccatgctgtaacaggcaagtgataacaggctttaatccttttaaagcatgctgtgggatgggatattggcattgagtggggtaagggtgattaggttttaatgggatggtaaggggtgcatcatttgtcaccaaggagggagtagaggtatcccatacttgtgggttaaggtagggggatacgagaggaggatgcaaaggaggctttgaactggggaaaagggtggcaatgaggtgtgcttgtagcctaggaatagtcagggaagcagataatttagttaaaatgtctcgacctaataagagagctgggcaggtggggataactaaaatgagtgcataaaagaatattgtccaagttggcaccagagttggggagttttaagaggtttagaagcctggccgtcaataccaacaacagttatggaggcaagggaaacaggcctttgaaaagaaggtaatgtggagttggtagcctccttattgattaagaaggagacggacttaccctccactgtaagagttacccaaagggtctgtgatggtccagggggcttccgaggtgatcaggcagcgtcagtctttagccactaagctgagaatatctgggaatgagtcagtcagagagccttgggccagagttccaggggctccgggagtggctgccaggtgagttggacagtccgatttccactggggtcccgcacagatgggacatggcttaggaggagtcccaggctgcgggcattgcttggcccagtggccagatttccagcacttgtagcaagctcctggggaaggagtttctggaggaacccctggcagtggcggttcaggtgtttggagttcttgtgtgctggagatgtggctggggtttgtctcacagtggaggcaaggaattgcaactcagaaatacattgctacttggctgcctctactctattattgtacaccttgaagcgaggttaattaagtcctgttgtggggttcgagggccgaatttaatttttggagctttatttaatgttgggagcaaattggttaataaaataaaatgcatattgagattaagacggccttctggcccctctgggtctagggcagtaaagtgtctcagggttgctgctaagagggccatgaactgggctgggctttcgtctttacctcgggtagtttctttaagtttgtcataacagctttgtaagctgcctttttaagccctttaactaggcaggaaaccatgtaatctcgcctagctatacctggggaatctgcctgatagttccattgggatcttctcggggaactgctctaatgccttcctggaggtctggctcatgaagccagtggttatcagtgtgagattgggctggagaaaaaactctttcccattcatccggggagagggtagaagtcaggatgacatttaagtcactccaggttaaattgtaggacagagttagatatcggaattcctgtatatatttagtggggtctgatgagaaagagcctaaacgctggctgatttgggaaaggtctgatagaggaaaaaggagcattaacgttgactatgccttcagctccagccacgtctttaagaggaaatagttgggcaagtgggggaggactagtcacggaacaaaactgtaaaccagactgggtgtgaggaggggaggtgatagaaggattatagggtgcggaagcagaggctgaggaagaattgggacctggcttggcctggcgaggagcagcctggggagaaggggagaggtcagatgagtccgtagaaaagaaggattcaaaggactcaagagcttggggtggagactgaaggaacagacaggagagaaagaagaaagatttgggacgagtctcactgggagcagagactagggaggaaccaatgtgtaaaagaatgcctggacgtcaggcacctcagaccatttgcccattttttgacaaaaattgtctagatctcataggatggagaaatcataagtgccgttttctggccatttagaaccattgtcgagcttgtattggggtcaagcagtattgcagaagaaaataaggcgtttaagttttaggtcaggcgagagttgaagaggttttaagttcttgaggacacaggctaagggagaaggaggaatggagggtagaaggttgcccatagtgaaggaggcaagtttaaagagaagggtagagacatggagagaaggggtagggggtgcttgccccccaggaaagtggagaaggggtgggaggtgcttgccccccaggaaagttgaaacggggtgggaggtgcttatctcccaggaaagtgggaatgaggtgggaggtgcttgccccccaggaaagtgggaacagggtgggaggtgcttgtccccaggaaagtgggaacggggtgggaggtgcttgccccccaggaaagtaggaacgggttgggaggtgcttgtcccccaggaaagtgggaacggggtgggaggtgcttgccccccaggaaagtaggaacgggttgggaggtgcttgtcccccaggaaagtgggaatggggtgggaggtgcttgccccccaggaaagtgggaacggggtgggaggtgcttgccccccaggaaagtgggaatggggtgggaggtgcttgtcccccaggaaagtgggaacggggtgggaggtgcttgccccccaggaaagtggagaagggatagagacacagacagaagaggtgggggctgcttgccccccagaaaagtggagagaaaagacagtagaggcacggagagaaggggtggggggtgcttgttccccagaaaagtggagagaaaagagagagtagaggcatggagagaaggagtggggggtgcttgcctcccaggaaagtggagagaaaagagagagtagagaaatggagagaaggggtggggggtgcttgtcccccagaaaagtggagagaaaagagagagtagagacacggagagaaggggtggggagtgcttgccccccaggaaagtggagaaggggtggagacatggagagaaggtgtcaaggggtgcttgccccccagaaaagtggtgcttgccgctaagggtgaaggaccaaggcaggtgtccccgtgaggtcagacacctctgaaacgtgggtgaataatcaggcaggcgacctgcaatgattaaacactaagggaaggctgccttcccgagtctgtgacctgcgccggagttttgggtccacggataaaatgtgtctcctttgtctctaccagaaaatgaaaggaattgaaattatgagaagggacagattgaagggtggcaccaagatttaaaggagaaagaggttgagggatagtgagagagattggagaagagagtaaaaagaggccacttacccgatttaaaatcggtgagatgttccttgggctggttggtctgaggacccgaggtcgtaggtggatctcttcatggagtgagggcaagaacaggggactggtctcctgaaggagtcccgctgaccggggtctttggcaccaaatgtctcatatgtccgtgtgaagagaccaccaaacaggctttgtgtgagcaacaaggctgtttatattacctgggtgcaggtgggctgagtccaaaaagagagtcagcaaagggtggtggattatcattagttcttataggttttgggataggcggtggagttaggagcaattttttgcaggcagggggtggatctcacgaagtacattctcaaggatagggagaattgcaaagaaccttcttaagggttggggcgattacaaagtacattgatcagttagggtggggcagaaacaaattacaatggtggaatgtcatcagttaaggctattttcacttcttttgtggatcttcagttgcttcaggccatctggatgtatacgtgcaggtcacaggggatatgatggcttagcttgggctcagaggcctgaaagagatcatctgcaacatcagtaacactgacaggagttgggttttggttacaaaagagcctatctttctttcttttcttttcttttttttttttttcgagacagagtcttgctctgtcaccaggctggagtgcagtggcgcaatctcagctcactgcaacctctgcctccatggttcaagcgattttcgtgcctgagcctcctgagtagctgggattacaggcacccaccatcatgcccagctaatttttgtatttttagtagagacagggtttcaccatgttggggccagaaaggtctcgatctcctgaccttgtaatctgcctgcttcagcctcccaaagtgctgggattacagtcatgagctactgtgccaggctttttttttttttttttttttctgagatgaggtctcgctctgtgcccaggctggagggcagtggcactatcttggctcactgcaacctccacctcccaggttcaagcaattctcatgcctcagcctcccgagtagctgggatcacaggcacaccaccacgcctggctaacttttgtctttttagtagagacggggtctcaccatgttggccaggccagtcttgaactcctgaacacaagtgatccacctgcctcggcctcccagagtgctgggattacaggcacgagccactgtgcccagcccagaagagcctttcaatctggcaggtagaagttgctcaataaatctatgcttagggaacaaatgaaggaatctgccaattgctgactttctagtgctaagacctgccatttttttcccccttaaatagaatatttttgtctcccttaagccagttctgagcagataggacagggagaatttagagggcagaacatttaagagaagaaatgtagaccattggtgtttactcacttctgtctttcaaaagttatgttgtaggagttattaagaaattattggccaggcacggtggctcacatctgtaatcccagcactttgagaggctgaggcgggtggatcatgaggtcaggagttcaagaccagcctggttaatatggtgaaaccccatctctactaaaaaatacaaaaattagctaggcatggtagtgtgtgcctgtagtcccagctactcaggaggctgaggcaggagaatcgctggaacccaggaggcagaggttgcagtgagccaagattatgccactgccctccagcctgggtgacagagcaagactccatctcaaaaaaaagaaaaaaaaaaggaaagaaagaaattattttaggcagatagagaggaaaaggggtccttgggaagttttctttttttttttttttcctgggaaagtgctggtattttttttttttttttttttttttttgagacagagtcttgctctgtcacctaggctggagtgcagtggcgtgacctcggctcactgcaagctctgcctcccgggttcacgccattctcctgtctcagcctcccaagtatctgggactacaggcactcgccaccatgccctgctaatttttttgtatttttggtagagacgaggtttcaccgtgttagccaggatggtctcgacctcctgaccttgtgatccgcccatctcggcctcccaaagtgctgggattacaggcgtgagccaccgcgcccagccatagtgctgggattacaggcgtgagccaccgtgtctgacggaagttttcattttttaaagcatctctggaaaagtttcttgtaaagccccggctcttagagccaggccagcaacctctgatatgcaaatgaaggccattagaaactgggtccacccaacatggccaggctggcaacctttaatatgaaaatgccagctgttagaaacttggtccaccaaacatggtgattctcccgcctttttgcccttgccccacatgtgactggctacacggccacccccacatgtccccatgtgtgtagaacattaaggtgccctacatttgcatattaagagcctagggtgggagggccagcgtttttggggctacctgagtgacatgcctggtcaaaccaagcccctgagccctatgcaaatcaagcaccgcctcctctagccatcgcatgtaactggctgatattacctgagcaggacttccctctctcggctttggagcccccttccctctgtctctgtacaggcgagcttccttctcccttctttcttgccccttcttgcctattaaactctctgctccttaaaaccacttcacgtatgtctgtgttgttttatctaattcaacgtaagacaagagccctggtgttcgtccgctcattgaagccgtatcatttagaagaaaaaattttttaaaaattgaacacatatgttggatgtgtttaagtttgttttttacaagttaatatactactcatgcaagagaagatctcgacatttcgcaggggcctttaagcttttcattttaatttactgcaaagtttacatattctaaagtgagtcactaaaacatgaaaagtaaatccagaattttcttcaccttctagtccaggatagacattattaacacagagaaataaatggaaaaacaatgttaatttcatggcatttctaaaaatcgattaaaagtggggaaaagcaatctctgtttcaaattagatttcaaataagtaagaattacatgatgtaccaaaagctcttttccagtaaaggagaggctttcttttcctcatgttaggaacacacaattttgtagaaggcaaaattggttgtttcttatgcccgggggcactggcctttgcatttgctggagtttaaataaatttgaagtttaaaattcaaggaccatctctgaatgagcagctaatgtttaacattttctcattgtggttattagatagagcagcttatggagacaaaagcctaggcttgcttgagaccctgggtttgagatgtgactgacaatgccaatagtgagaaagcttaaacaaaacaaaaccttaaaatttaatttaattttgttttgtttttctagatggagtctcgctctgtcacccaggctggagtgcagtggcacaatctcggctcactgcaacctctgcctcccaggttcaggttattctcctgtctcagcctcctgagtagctgggactacaggtgcatacaaccatgcctggctaatttttatatttttagtagagatggggtttcaccatgttggccaggctggtcttgaactcctgacctcagggagtccacccaccttggcctcccaaaatgctgggattacaggtgtgagccactatgcccagcctaaaatttaattttgaaaatatatatttctttttcccccaaagatagtggaaacaaggaaggcttcccagaggcagaggcttgagtcaagtctttgataaggcaaagaaatggaggaagattattaaaaaagagaatatgatttcatacccaaatcacacgggtatgaaacaacaggatctgctgatgtggtgacgtgcacctaaagtcccagctgcctggaagtctgaggctggatgattgcttgagcccaggggtttgaggctgcagtaatctatgattgtgccaccacactagcctgggtgacagagtaagacccggtctcaaaaacaaacaaacaaacaaaaacaggatttgtttgggagaatgcaagttctgtttgtggcatccctagggtgtggggtgtccaagggcatgagatggagctagagaggtgaacaggattcagaatcagaaaaggccttgggtgctaatgtgagaaatttgaaatttatcctccatattatgggaagccattataggatttttcagtttcttcttttatttatttacttttttgagacagagtcttgctctgttacccaggctggagtgcaatggcacagtctcggctcactgcaaccttcgcctctgggttcaagcaattctcctgcttcagcctcttgagtagctgggattacaggcatgcaccaccacgcctggctaatttttgtatttttagtagagatggggctttaccatgttggcaaggctagtcttgaactcctgaccttaggtgatctgcccgccttgggctcccaaaagtgctgggattacaggcgtgagccaccatgcccggcccccagtttcttcctttaaattaaagcagttgtgtttatgtttctaaatatcctcctaaaaattttacatcttaaaagcagtaggtttgagtccttactttacgttacacttacctgtggtattttttaaaatatagatgaataaactccacctcattcagattccaattcaattagtctagggatggggcccaggcatcagcattttttaaagggcatcaggggattctaaattcaaccagggttgaaaattattgcttttatggtgaattgcttcaaccaaataatcagatcaacatctgactgagaactgtctaggacggcagctgcttcaactttgatgtgcatgtgaatcacctggaaatctgactcagcttcagtaagtcggggtggagcctgagattctgcattcctaacaaactcccaggtgttgctgatggtgccaatagagatggtctagactctaggatgaagaggaaggggtttgaatggaagtatggaggagtcgtttggaaacactggcacctgtagagtaattcttgctggggcatactttctttggaaaaaatcagacaacacaagaacagtagatagacagagggtgcaggggaagaggagagaggtgggagacaccaaggaagaacatgcattaggggcctgggagagggaggagggggagggaaaggatgtcaccagaccatctcagagtaaaggtcttgggcaacttatttaatttctttaagcctcattttctagcatgtctcaaatacagtggctcacctgcatcagagccaactaagggtacttatcaaacattaggatttgcagtttttccaacctagtccgaatgattcagaatgaaggaggaggaagggtaagaacctgcacttacagcaagcacaccaggttattattatgtaccttcaatgtggagaactggaactctgattgttaaaataagatagcaagcacccagaacacatgaagtgctcaataggtggtaaccatggtgatgatgatggtaatggtgatacagtaaacatctctggtccagcccagacttggcagaacaagagttttatgcatcctactctttcagatgagatcggtaggatggtatggttgtagaccatcctactctttcaaattggtccctaccaaagatgtctgccagctgcttgccacaggaaaagtgggggcacttccacatgattatatttctcttgacttctccagctttctcaaaaggtccttttcaaggggaactcattaaacaatgtgttctcaaagaacatttattatgatggtgtaaaaccgaagaaaatgaggtgagtctcaactactttagaggtttattttgccaagattgggggcatgcataacaaaaagcacaaaatcacaagaacatctgtgatctgtgcttttttccaaagagggtttggggacttccatttttaaagaggaaagagtgggcagtcagggaaagaagaaagaaaaaaaaaggcaggggcaggagaataaataaaagaggcaagcagttgcattcttttgaggctttgatcagcgctcattgaattcacattttatgtgctaaaagggggtagaggaatagtcaactgtgcattcttctgtagctctgtgaatctgcattttacagaagataaagtaaacttagagtagaagaagcaatcaagtatgcatttgtctcaggtgagtggagggatgactctcctcctctctttgtcccttacctatgaagagacgttgttgatgtacatagggtgaaattcagcagaactctgttttagggtaaagatcttggggcccacaaggaatttccaggccctccaggagacttatcgttgtagctctctatttaggaacaaaatgggaggcagttttgtgcaattcagttcccaatcttaatttttccctttggcacagtgagtttggggtttcaagatttctttttcctttcacaatggaaagtgtctactatataatattaactttaaacaacagaatgtttgattggcccaaatttggtgtaaaaattgcggcagaatgaatttttaaggtattgctttgtttctacttgcagtttttaattttctgcacccccatcaagaagagaacaggctccttttcaaagggaaggtctgtgatggggtagaaagcaaaagttcagcctggccaacatggcaaaacctccactctacaaaaaatacaaaaattagctggtgtggtggcacatgtctgtagtccctgttacttgggaggctgaggtgggaggattgattgaacctaggaggtcaaggttgcagtgagctgtgattgcatcactgtactccactctgggtgacagaacaagatcttatctcaaaaaaaaaaaaattgccagaaaaccacttcactttctagcttttgttttcaaaagtctaaaccattgagacaattatgttcggtgcctccagggaaactgtgggaattgctcttgaagtaaatactcccctcgccctgaggaaaacactttcttagggactaaaaagagattcccttgagcactaggagaaagaggtgtgtgggtccccaggggcagatgggcatatgacctttctggagaatcctcttctaatagctaaccttttctcagcttctccttcatcaactaagggtgcaccctgggtttctactatctccttttgcaaatcttggattgtgttctctgattttcctttggaatacagaatccattatcttgaggcatttaaacaaaaaataaagttctaagcccctctaattatctaaatggacttcctcctcacccagggctcttaaaatttaacctgaaagactggttcaggtcatgaagggaagtgggggtctgacgtgcctcattgtacctctttggcattaatatcaacacagactttaagactggtaagaaacattttacaacctattctctctgaagcctgctagctaaaagcttcatctgcatagtaaaactttggtctctaccacctcttattgcaacctagacattcttctctgttgatcccaggtcttcagacaaactcaaccaattgtcaaccagaaaatgttaaaatttacggcttttctggaccaaaccaatgtatttcttaaatgtatttgattgatgtctcatgcttccctaaaatgtataaaaccaagctgcaccaccttgggcacatgttctcaggacctcctgagggctgtgtcatgggtcatggtcactcatattttgttcagaataaatctctccaaaacatgttacagagtttgacttttttcattgacagacatcagccaaaattttaacatccatatacgtacgcatggaagaaagactggaagactggaaacccaccaaggtgtttaccacagatggtgacattgtcggtgatttaaattttttttttttttttttgagatggagtttcactcttgttgcccaggctggagtgcaatgacatgatctcggcttacagcaacctccacctcccgggttcaagtgattctcctgcctcagcctcccgagtagctgggattacaggcatgcactaccatgcccagctaattttgttttagtggagacagggtttctccatgttgaggctggtcttgaacccctgacctcaggtgatccacccgcctcggcctcccaaagtcctgggattacaggtgtgagccaccgcgcccaccctaaattttttctttatattttaaattttgatgtttcaacaatgaacaataatcagaaaaaagcgctatgttgtttatttttagtagagaattccctgaagtctaactttaaatgtctctcttcctcccttacaaaccctattcttacaaactgtagtgtctttttctctgagaccacttatttagccatgcgtggccactccccctctgcattgtcagttatttcttaaaatgaccctagcacctagcatagcaccaacaaatcagagaagtcaagcgcatgttttctgaaatgaacctgtcttgagaatgcccaggattttctttgttaatatcatcaccgttttaaaacttgtttacggtacaagtatagcaccaaccaaataacagagccatttgccccttcatggaaagagagcaacttataatatgctagtccctggagttcctcaggaataaggaaattatctaaaggaggagttattgccaaacatccctatcaacaattcccaaatgatagaaatttggtcatcaaatattatctagtgccatcaaagaaacaattgaaagttaaagcccaatgacagtttaaaaaaaaacccctgatgtccaacttaccctgatgtccaatggcttaccattttaattttttaatttttaaattatttaaaattttttgtgggtatatagtaggtgtatatagggtatatgaaaggttttaatacaggcatgcaatgtgaaataagcacatcataaagaatagggtatcctttcccccaaacatttattctttgagttaaaagcaatccaattacattaagttattttaaaatatagaggggtttttttgctttccctttctttctttcttttcttccttttttttttttttttttttttgagacagagtttggcactgttgtccagactggagtgcagtggcatgctcactgcaatctccgcctcccaggttcaagtgactctcctgcctcagcctcctgagtagctgggattacaggcacccaccaccacgcctggctaatttttgtatttttagtagagatggggtttcaccatgttggccaggctgctcttgaactcctgacctcaagtgatccacttgcctcggcctcttaaggtgacggattacaggtgcgagccaccagacccaaccattatacagttattttattattgactatagtcaccctgttgtgctgtcaaatagcaggtcttattcattccttttaactgttttttgtacccattaatcatccccaccgtcctccccaaccccctgctacccttcccagtctctagtaaccatcattctactctctatgtccatgagttcaattgttttgatttttagatcccataaataagtgaggacatgcgatgtttgtctttctgtgcatggctcatttcatttaacataatgatcttcagttccatctgtgttgttgcaaatgactggatctcattctttttcatggttgaatagtactccattgtgtatatataccacattttctttgtacattcatcggttgatggacatttagattgcttccaaatctgagctgttgtaaacagtgctgcaacaaacagtgcaggtttctctttgatatattgatttcctttcttttgggtatatactcagcagtgggattccagtagctggatcacatggtagctcaatttttagttttttgagaaacctccaaactgttctccacagtagttgtattagtttacatccccatcaatgcatacaaggattcacttttctccacatccttgccagcattcattttacctgtcttttggatataagtaattttaacccggggtgagataatatctcattgtagctttgatatgcatttctctgatcagtgatgttgagcaccttttcatatacctgtttgtcatttgtatgtcttcttttgagaaatgtctatttaaatcttttgcctactttttggttggattattaggttttttttcctatagttatttgagctccttaaatattctgattattaatcccttgtcagatggggagtttgcactgtaggtgtggggatttgtttccgggttctctattttgttccattggtctgtgtgtctgtttttatgccaatgccatgctgtttggttactatagctctggtgtataatttgaagtcaggtaatgtgattcctccagttttgttctttttgcttaggatagctttggctattctgggtcttttgtgggttcatttaaattttaggattggccgggtgcggtggctcatgcttgtaatcccagcactttgggaggctgaggtgggcggatcatgaggtcaggagatcgagaccatggtgaaaccccatctctactaaaaaaatacaaaaaattagccaggtgtggtggtgggcgcctgtagtcgcagctacttgtagaggctgaggcaggagaatggtgtgaacccaggaggcggagcttgcagtgagccaagatcgtgccactgcactccagcctgggcgacagagcgagactctgtctcaaaaaaaataataataataataataaaaataaaaaaataaataaattttaggattgttttttctatttctgtgaagaatgtcattgttatcttgataaggattgcattgaatccatagattgctttggctagtatagacattttaatattaattcttccaatccatgaacatgaagcatttttctatttttttggtgtcctcttcaattttcttcatcagtgtttcacagttttcattacagagatctttcacttctttggttatcttaattcctatgtatttaattttatgtgtagctattttaaatgggattactttttaaatttcttttttttgcattgttcgctgttggcatatacaaatgctactgatttttgtatgttgattttgtatcttggaactttactgaatttgtttatcagttctaatagttttcttgtggactccttaggtttttccaaatatgagatcatatcatcagcaaacaaggataatttaacttctttctttccaatttgaatgccctttatatccttctcttgtctgattactctagctaggacttccagtactatgttgcataacagtggtgacactgggcatccttgttgtatcccagatcttagacgagagactttcagtttttccccattcagtatgattctagctatgggtctgtcatatatggctttaattatgttgagttatattcttttttttttttgagatggagtttagctcttgttgcccaggctggcatgcaatggcatgatctcggctcactgcaacctccacctcccgggttcaagtgattctcctgcctcagcctcccaagtagctgggattacaagcatgcacatcatgcctagctagttttgtatttttagtagagacggggtttctccatgttggtcaggccggtcttgaactcctgattcctgaggtgggtggatccaggtgatccgcccacctcggcctcccaaagtgctgggattacaggcatcagccactgcgccaagccaaggtatgttccctctatccccagttttttgagggtttttatcataaagggatgttgaattttgtcaaataccttttcagcatcaactgaaatgatcatatggtttttatccttcattttgttgacatgatgtatcgcattgattgatttatgttgaaccactcttgcattccaagaatacatatcatttagtcatgatgagtgatctttctgatgtattgttgaatttggtttgccagcattttgttgaggatttttgcatcagtattcatcaaagatattgccctgtagttttctttttttgatgtgtctttggttttggtatcagggtaatatgggcctcatagaattagtttaggagtgtttcctcctctattttttggaatagtttgagtaagattggctttagttctttaaatgtttgatagaattcatcagtgaagccattgggtcctgggcttttcttttctttttttttttttttttttgagacagaattttgctcttgttgcccaggctggagtgcaatgacacgaccttggctcagtgcaacctccacctcccaggttcaagtgtttaagtgattctcatgcctcagcttccctagtagctgggattacagacacgtgccaccacacctggttaatttttgtatttttagaagagacaggtttctccaggctggccttgaactcctcacctcaagtgatccacccacctcagcctcccaaagtgcgggattacaggtgtgagccactgcacccagcctctttataggtgaattgtgtttcttgtagacaatagatcaatgggtcttgttttttcatctgttcagccagtctatgtcttttgattaaagagttcagtccatttatagtccatgttgttattgctaagtaaggacttactcctaccattttgctatttttttttttttggtttttgtggtcttctcttccttctttctttccttccttttgttatctagtgaagtgattttctctggtgatgtgatttagtttcttgcctttttattttttgtgtatccattgcatattttttggtttgaggttaccataaggtttgcacatactatgttataacccattattttaacctgataacaacactatttgtataaacaaacaagcaaaaacataaaaactctatgcccttaacgttgtcctcctgctttttaactttttcttgtttctatttatatcttattgtattgactatgtcttcaaaagttgttgtagttattatttttggttggttcatcatttagtctttctacttaggataagagtagtttatacactacagttgcagtgttattctttgtttttctctatacttactattatcagtgagttttgtaccttcaggtgattatttattgctcattattgtccttttctttttgattcatgtactcccttgaacacttcttgtaggataggtctggtattaatgaaatcccccagcttttgtttgggaaagtatttctcctgcaggtttgacggatattttcactggatatactattgtagggtaaaagcttttttccttcagcactttaaatatggcatgccattctctcttggcctgtaaggtttccactgaaaagtctgctgtcagatgtattggagctccattgtatgttatttgtttcttttgctgcttttaggatcctttctttttggttgacctttgggagtttgattatcaaatgccttgaggtagtcttatttaggttaaacctgcttagtgttctataaccttcttgcacttgaatattgatatctttctctaagtttgggaagtcctctgttattatccctttgaataaactttctacccctatgtctttctctacctcctctttaaggctaataatcttacatgtgcccttttgaggctatttctagattctgtaggattacttcattgttttttattcttttttcttctgtctcctctgtgtattttcaagtagcctctcttcaaccttactaattctttcttctgcttaattctgctattaaaggactctgatatattctttagtatgccaattgcattttttagcttcagaatttctgcttggttctttttatttcaatatctttgttaaatttgtctgatagaattctgaattccttctctgtgtaatcttgaatttctttgagtttcttcaacatagctattttgaattctctgtctgaaaggtcacatatctctgtttctccaggatttgtccctggtgacttatttagttcatttaatgaggtcatgtttttctgagtggtgttgatgctagtagatgttcttcagtgtctgagcattgaggattaggtatttatcatggtcttcactgtctgggcttatttgcagccatccttgggaaggctttccagatatttgaaaggacttgggtgttgtgatctaagctgtatctgctttagaggacaccccaatcccagtgacactgtggttcttgcagaattgtaaaggtacctccttgaatgtcttggacaagatctggaagaattctctggattaccagacagagactctagttctcgtcccttactttctcccaaacatacagagtctctctctctctgttctgagccacctacagctagaggtagagtgacacaagcactcctgtggccaccaccacaatgactgtgctgggtcaaacctgaagccagcatagcactggatctcatctaatgcctgctttaaccactccctgaatactgcctatgttcactcaaggccctggggctctacaatcagcaggtaacaatgccagccaggcctgtgtccttcccttaagggttttaaggtcccccaagcttcaagtgggtccagaagtgctgtccaggagtcagggactagagtaaaaaacattagaagtctacctggtattgtattgcagccgagctggcactcaaaccacaagatgcagttcttcccactttttcatcattttttccaaaggcagaggagcctcacctcatagccaccccgaccccaggtcacaagtacggccagactaccaccaatgttcccttaaggcccaagggctcttcagtcaactggtttgtaaatgctgcctggcctgggtctcacccttcagggcagtgcactcccctctggcccggggagggtccaggaatgctgtccaagagtcaagtcctggaattggggatcccaagaaccctcatggtgctctattcccctgtggctgtgcaagacaaagtcccctttactttaccctctgcttttctcaggcagaaggaacgttgctccatagccaccacagctgggaatgtgctgagtctaacctgaagccagcaagtctcagcagctcacccaaggcccacagtgtagtacctgggtatcactgctggttattcagggcccaagggctctttagttagcaggtgatgaatgctgccaggaccgggttctttccttcaaggcagcaggttccctcctggcccaaagtgtgtctagaaatgtcatcttggagcctgggtctggaatgagggcctctcaactctgactggtgccctgtctcgctgtggctgagctggtattcaagactcaagacaaaatcctctccactcttccctctcttctcttcaagcagaaggaagggggtctcttttggagcctccagctgtatagcccagagttaggaaaggggtgatgccagcacttccttggctgccccacgtgatgtctcagtatgttgcatgccctctcagcccactgtctctagtcctagttcagtcacaggactcactgaagagtttcagtccttatggtctagactgcctttcaaatattcttggagacacagagtgctgtagcgctctgctgaatttgatccagttttcctttctgctctaacaggacagcactgagttcaatgcttcacaattgcagtgttctccctctcccagtgcccagaaatgccctctgcaacacacactgctgccaggggtggggcaggggtggcattagctatttagaactgttttattaatctcttcagtgcctctttcagtgatttgaaatctcttcagtactctttcactgagtactgtgagtgcacacctgatttttggttcttatgaaggtgggttttttttgttttttttttgttgttgtttgtttttttttctgtgtagatagttattaacttgctgtccttgggggaggcaggatgattttccattccaccatcttggtctgccccccaccattttaattttagatgctctctttccacagaacattaggacagacttactatcttgaggaataaataaattttgcaaactatatacgttacctttcacgaagataatttttaaaacaaacattcttggatttttctgcttaaaaataaataaggcggctgggcacggtggcttacacctgtaatcccagcactttgggaggctgaggtgggtggatcatctgaggtcaggagttcaagaccagcctggccaacatggcgaaaccccatctctactaaaaatataaaaattagccagacatgatggcgggtgccagtgatcccagctactcaggaggctgaggcagggagaattgcttgaacccaggaggcagaggttgcagtgagctgagatcatgccactgcactccagcctgggtgaagagtaagactccatctcaaaaaatatatataagaataaggctggttgcttttcatcatcaccagatacttctgtcttatcccctagagaccactgattagttttttgttttcatggttttgcgttttccatcatgtcatataaatggaattaggcatgatgtagcctttgagtctggttttttttcacttagcagaatacatttgatattaatctatgattttgtatatacctttttattgctgtgtagtctttcactgcatggatgtaccacagtttgtttattcagttgaaaaagatttgggttgtttctggttttggttgactgaataaatctgctacaaacagattttcatatggatgtaaattttcatttctctttaaggtaagtagtaagtgtgggattgctgggtagtatggtatcattatatttaaaaattttacctttctaataggtgtaaagtgttatctcattgtaattttaatctgtatttccctaacaatgaatgattttgagcatttctttatgtgcttatttgacatctttgttttctttttttgttgttttttttttttgagacagagtctcactctgttgcccaggctggagtgcagtggcacaatcttagatcactgcaacctctgcctaccaggttcaagcaattctttgccttggccccccaagtagctgggattacaggcgcccgccaccacgcctggctattttttttgtgtgtgtgtatttttagtagagatggctgttagtagagaccatgttaggctggtctcgaactcctgacctcatgatccacacaccttggcctcccaaagtgccaggattacaggcatgagccactgtgcccggccgacatctatatgttttcttttgtaaagtatctgtttacatctttgagccattttttaaaaattgggttatgtttctattcttgagttttaagagttctttatatattataaatataagatctttgccaaatatgtgttttacaaatatttgtcccccctaaccccacttttctttttgagacaaggtttcactctgttgccctgggttaaactgcagtggtgtgatcttagctcactgcaaccttcacctcccaggctcaagtgatcctcccacctcagcctccaaagtagctggagtgcattggcatgatctcagctcactgcaacctctgcctcctgggttcaagcaattctccctgcctcagcctcctgagcagctgggatcactggcacccgccatcatgcctggctaatttttatatttttagtagagatggggtttcgccacgttggccaggctggtcttgaactcctgacctcatgagataaaatcaagaaaattattaacttgttgcttattaaacacacatttctttacaagtaatgatgggcttttactgactgcatttatgtttgaaatgaaattaatttcaaactagaactttcaagtagagttgagataaaacattatgctttttggtccacaggtgtataccaccatgcctggctaattaaaaaaaatttttttttggtagagatggggtctccctgtgttgcccaggctggtctcaaactcctaggctcaagtaatcctcctgcctcagcctcccaaaatgctgggattatagttgtgagccactgtacccagcctcacttttcattctcttaatattgtcttttgtagaacataaatttttaattttgaaaaagtcaaatttatcaaatttttcttttgtggattaggcttttgatgtatcaggaaatatttgcctaatccagtggttttcaaacgaagggcaactctcattccccagaacatttggcaatatcgaagacatttttggttgattggggacagagttgctgctggcctctagtgggtagaggccagggatgctgctacacatcctacaatgcacagtatgaactcttcaacaaaaaattatcaatctaagatgtcaatagtaccaaggttgacaagcttaattcaagatcacaaagattttgttctattattattatttagagacagggtcttactatgttacccaggctggcttcaaactcctgggttcaagcaatcttaccatctcagcctcctgagtagctgagactacaggcacataccactgtgcccggcttatttcttgaaaatttttttacaattttaggctccacatttaaatctatgattcattttgagtttatttttatttatttatttttattgttttttgagatggagtctcactctgttgcctaggctggagtgcagtggcatgatttcggttcatcgcaagctccacctcctgggtttgcaccattcttctgcctcagcctcctgagtagctgggactacaggcgcctaccaccacgcccgtctaattttttgtatttttagtagagatggggtttcaccacgttatccaggatggtctcgatctcctgacctcgtgatctgcctacctcggcttcccaaggtgctgggattacaggtgcgaaccaccgtgcctggccattttgagttaatttttgtagctagtgcaaggtatggattgaggtttgttctttttcaactttaaatcgaggttttatgtttagtagctgagccatcacagtactttacaaataataactttttgtttgtttgtttgagacaggatatcactccattgcccaggctgcagtacagtggtatgatcgtggtcactgcagctgcgactttctgggctcaagtgatcctcccacctcagcctcctgagtagctgggactacaggtgtgtgacaccacacccagctaattttttgtctttttaatagagacaggatgtcaccatgttgcccaggctggtcttgaagtcctgggctcaagcaattcccctgccttggcctcccaaagtaatgggattataggcatcagccaccacacccagccaaaaacatcttttatgttttattttattctttattaaggtataattgacaaaattgtacatatatatggtagacaacgtgatgttttggtgtatgtatccattgtgaataattaagctaacatttaatcacttcacatatttttttggtgatgagaacacttaaaatctaatctcttggcaattttcaagtatgtaatacattattattaactatagtcaccatgctatacaatagatctccaaaagtttttatcctgtctcattgaaactttgtagcctttgaccaacatcactccatttctctggcctcctcacctgccagcacctgctactatcattgtactttctgcttctagttcaacttttttatatttcacatataagtacagtaatgcagtacttgtctttctgtgcctggcttatttcacttaacataatgtcctccaggtttatcatgttgctgcaaatgacacaatttccgtgttttttgttgttgttgttttgttttttgtttttttttgagacagagtcaagctctgtcacccaggctggagtgcagtagtgcgatctcagctcagtgcaacctcctcctcccaggttcaagtgattctcctgcctcagcctcctgagtagctgggattacaggtgcctgccaccacgctcagctaatttttgtgtttttagtagagacagggtatcactgtgttggccaggctggtctcaaactcctgatctcatgatcctcccaccttggcctcccaaagtggtgggattacaagcgaaagccattgcccccgccaaatttccttctttttaaaggctgaatagtattccattgtgtgtgtgtatatatatatatatatatatatatatatatatatatatatatatatacatatatatataccaaattttctttatccattcatttatcaatgaatatggtattcattccatattttggctattgaaggttcttttttgatgattgcctaattgtttcaatattatcaagactatcctttttttctgttgaattatctttgcaccttttctgaatatccattgagcatatatgtgtgcgtctattttgtgaacacttattctgttccattgatctatatgtctatcctttcctgataccatatagtcttgatgactattgctttgtagtaattcttttgtttttttgagacagagtctaactctgtcacccaggctggagtgcagtggcatgatcttggctcactgcaagctctgcctccctggttcacgccattctcctgcctcagcctcccaagtagctgggactacaggggcccgccaccatgcccggctaattttttgtatttttagtagagatgtggtttcaccatgttagccaggatggcctcgatctcctgacctcttgatctgcctgtctcagcctcccaaagtgctgggattacaggcatgagccactgcgcccagctgctttatagtaattcttgaaataagatagtctgagtcttaaaattttgttcttctttttcaaaattatatttgctattctagtttactttattattatttttgattgctgcttatagtggttgccaagtagccaaacattaaattcaatatttggccaaagctgagactgaaattaagtatcatcattgcagaaaaaaattctaatgtaaaaaaattaatttgagatcttattgtaataaataaggccaggtgcagtggctcacacctataatcctagcagtttgggaggccaaggcaggcatatcacttgagcccaggagtttgagaccagcctgggcagcatggtgaaagcacttctctacaaaaaatacaaaaatatcagtcagatgtggtggcacctgcctgtagtcccagctactcgggaggctgaggtgggaagactacctgaccctggggaagttgaggattcggtaagccatgattttgccactgcactccagcctgggcaacagagtgagaccctgtctcaaaaaaattaataatcaaaggtctctctaacaacctgcaactctttggagttgggaacattggtttacctggaaccagtttctgcttttcctgtacttctgggctgagccaagggtcaacggagaggaagccattcagcttcggggtcctgacaacaagttggttgacccggcagccatgagcggaactctcaaagtcatgtcgcccaagcaagacttgcctatctatcctatctaccctgacccttgcctcctgggtcctaatgcctgccagacaaacttcctctcacttctcttctctgaggctagtcacgcttctaaaaaccactccctgtctctggtgcttttctagtttctcctatgagaatgatttctcgtataaacttcaggactctgttacctccttttggcacctgggctcaccaatgagaaagacatattttttgcccaaagccccatcataggtgggactatctggaattttcagatccctcctcagacaagcaggcctaacaaaagcaaagctattcctaaagctaggatatggggagcctcagaaattgtatccttcctattcatataaatgaggacaaaaggcatcactcttctaactctggagatccctttcctccctcagggtatggcccttcacttcattttggaggcataatatctttataggacaggcgtaaagtctcaatactaacaggagaatgcttaggactctaacaggttttcgagaatgcatcattaagggccactaaatccgatttttctcagtccttcttgtggtctaggaggacaggcaagtgtgcagatttttgagaatgcatcagtaagggccactaaatccaaccttctttggtcctccttgtggtctaggaggaaaactagtgtttctgctgctgtgttggtaagcgcaactattccgatcagcagggtccagggaccattgtgggttcttggacaagaggtgttttcggctactgcatcggtgagcacagctattccaatcagcaggctccagggaccgttacgggttcttgggcagggggagaaacaaacaaaccaaaactgtgggcagttttgtgtttcagatgggaaacactcaggcatcaacaggctcacttttgaaatgcatcctaagccaatgggaccaatttgatccataaaccctgaaaaagaggcagctcatttgtttccacactacggcctggccccaatattctctctctgatggggaaaaatggccacctgaaggaagtacaaattacaatactatcctgcagcttgaccttttctgtaagagggaaggcaaatggagtgaaataccttatgtccaagctttcttttcactggaggagaacatacaactatgcaaagcttgcaatttacatcctacaggaggacctctcagcttacccccttatcctagcctccctatagctccccttcctattaatgataagcctcctctaatctcccccgcccagaaggaaataagcaaagaaatctccaaatgatcacaaaaacccctgggctatcagttatgtccccttcaagctgtagggggaggggaatttggcccaacctgggtacatgtccccttctccctctctaatttaaagcagatcaaggcagacctggggaagttttcagatgatcctgataggtacatagatgtcctacagggtctagagcaaacctttgatctcacttggagagatgtcatgctattgttagatcaaaccctggcctttaatgaaaagaatgcagctttagctgcagcccaaaagtttggagatacctggtatcttagtcaagtaaatgatagaatgacagccaaagaaagggacaaattccctaccagtcagcaagccatccccagtatggatccccactgggatctcaactcagatcatggggactggagtcataaacatctgttgacctgtgttctagaaggactaaggagaattaggaaaagcccatgaattattcaatgatgtccaccataactcagggaaaggaagaaaatccttctgctatccttgagcagctatgggaggccttaagaaaatatactcccctgtcacccaactcactagagggtcaactgattctaaaagataagtttattgcccaatctgcagcagatatcaggagaaagctccaaaagcaagccctgggccctgaacaaaatctggaggcattattaaacctggcaaccttggtgttctataatagggaccaagaggaagaggcccaaaaggaaaagtgagatcagagaaaggccgcagccttagtcatggccctcacacaaacaaaccttcatggttcagagaggacagaaaacagagcaggccaatcacccgggatggcttgttatcagtgtggtttacaaggacattttaaaaaagattgtccaacgagaaacaagctgccccctcgttcatgtccactatgctgaggcaatcactggaaggtgcactgccccagaggacaaaggttctctgggtcagaagctgccaaccagatgatccagcaacaggactgagggtgcctggggcaagcgccagctcatgtcatcaccctcactgagccctggggacatttaatcattgagggccaggaaattgacttcctcctggacactggcgcggccttctcagtgttaatctcctgtcttggatgactgtcctcaaggtccgttaccatccgaggaatcctgggacagcctgtaaccagttgtttctcccacctcctcagttgtaattgggagactttgctcttttcacatgcctttcttgttatgcctgaaagtcccacacccttattagggagggatatattagccaaggctggaactattgtctacatgaatatgaggaacaagttacccatttgttgtcctctacttgaggagggaatcaaccctgaagtctgggcattggaaggacaatttggaaggtcaaaaaatggccacccagtccaaatcaggctaaaagatcccaccacttttccttatcaaaggcaatatcccttaaggcctgaagctcataaaggattacaggatattgttaaacatttaaaagctcaaggcttagtaaggaaatgcaacagtccctgcaacaccccaattctaggagtacaaaaaccgaacggtcagtggagactagtggaagatcttagactcatcaaaaaggcagtaattcctctatatccagttgtacccaacccctatagcctgctctcccaaacaccagaggaagcagaatggttcactgttctggacctcaaggatgccttcttctgtattcccctgcactctgactcccagtttctctttgcctttgaggatcccacagaccacacatctcaacttatgtggaccgtcttgccccaagggtttagggatagccctcacctgtttggtcaggcactggtccaagatctaggccatttctcaagtccaggcactctggtccttcagtatgtggataatttacttttggctaccagttctgaagcctcatgccagcagactactctagatctcttgaactttctagctaatcaagggtacaaggtgcctagatcgaaggcccagctttgcctatagcaggtcaaatatctaggcctgatcttagccagaggtaccagggccctcagcaaggaacaaatacagcctatactggcttatcctcaccctaagacattaaaacagttgcgggggttccttggaatcaccggcttttgctgactatggatccctggatacagagggatagccaggcccctgtatacttctctttatacatcacagagagtgcagggctagctcttggagtccttactcagactcgtgggacaaccccacaaccagtggcatacctaagtaaggaaattgatgtagtagcaaaaggctggcctcactgtttaagggtagttgcggcgttggcttagtgtcagaggctatcaaaataatacaaggaaaggatctcactgtttggactactcatgatgtaaatggcatactaggtgccaaaggaagtttatgggtatcagacatccgcctacttagataccaggtgctactccttgagggaccggtgcttcaaatacatatgtgcatggcctcaaccctgccacttttctcccagaggatggggacccaatcgaggatgatcaccaacaaattatagtccagacttatgccacccgagatgatctcttagaagtccccttagctaatcctgaccttaacctatataccaatggaagttcatttgtggagagtgggatatgaagggcaggttatgtcatagttaatgatgtaaccgtacttgaaagtaagcctcttcccccagggacaagggcccagttagcagaactagtggtgcttacctgagccttagaactgggaaagaggaaaaaaaaataaatgtgtatacggatagcaaatgtgcttatctaatcctacatgcccatgctgtaatatgggaagaaagagagttacctctggggggaacccccataaaatacgacaaggaaatcatggagtgattgcactcagtgcaaatactcaaggaggtggcagtcttacactgccaaagccatcaaaaaggggaaggagaagggagaacagcagcataagtggctggcagaggcaaggaaagaccagcagaaagaaaagagagaaagagacagaaagagagagagagaggaagagacagacacaaagaaggagtcagagagagagagagagaggagaagagacagagacaaatagggagtcagagagacagagagagtcagagagaggaagagacagacaaaaagggagtcagaaggagacaaagaagaagtcaaagagaagaaagagagatggaagtagtaaagaaaaaacgtataccctattcctttaaaagccaaggtaactttagaacctataattgataattgaaggtcttctctgtaaccctataacactccaataccaccttgttgtcagtgtaaacaagggcgtagcctgaaagcactgaggccactgacaacccatagccttcctatcaaaaatccttaacccagcaggtttcctaacaggggatctaaatcttaactaattaccatacaaaggtccgatcagaccaaggaggaactcccttcaggacaggaagatagatgtttcctcccaggcgattaagggaaaaagacacaatggatattcagtaagtgataaagaaactcttgtaaaatcagagttaggaaaattgcctaatgatatgtctgctcaaacctgcgagctgtttgcactcagacaaacagaatcaggaaggagccatcttatagaatcaggaaggaattatctataccaattctaagttaatatggactgaacaaggttttattaacagcaaagaaaaaatcccaaacttacaagattttcaactaaagtttgctaaaagttaacagtgtaacatgtattatcctactaccacacactctcaaaggatttctcagacagtttgcaagagataacaaaatctatccttactctacaatcccaaatagactcttcggcggcagtgactctccaaaaccgcagaggcgtagacctcctcactgctgagaaaggagatctctgcaccgtcttaggggaagagtgctgtttttatactaaccagttagggatagtacgagatgctgcccggcatttacaggaaaaggcttctgaaatcagacaacacctttcaagctcttataccaacttctggagttgggcaacatggcttctcccctttctaggtcccatggcagccatcttgctgttactcacctttgggccctatatttttaacctttttgtcaaatttgtttcctctggaatcaaggccatcaagccacagatggtcttacaagtggaacaccaaatgagttcaaccaacaacttctaccgaggacccctggactgacctgctggcccttccactggcctaaagagttcccctctggaggacattacaactgcagggctccttctttgcccttatccagcaggaagtagctaaagcggtcatcggccaaattcccaacagcagttggggcatcctgtttagaggggggattgagaggtgaagccggctgggcttctgggctgggtggggacttggagaattttctgtctagctaaaggattgtaaatgcaccaatcagagctctgtgtctagctaaaaggtttgtaaacacaccaatcagcactctgtaaaatggaccaatcagctctctgtaaaatggaccaatcagcaggatgtgggtggggccaaataagggaataaaagctggccacccaagtcagcagtggcaacccgctcaggtccccttccatgctgtggaagctttgttctttcactcttcgcaataaatcttgctgctgctcactctttgggtccgcactaacttcatgagttgtcacacttaccgtgaaggtctgcagcttcactcctgaagccactgagaccatggacccaccaggaggaaaaagcaactccagacgtgccacctttaagagctgtaacactcaccgcgaaggtctgcagcttcactcctgaagccagcgagaccacaaacccactggaaggaacaaacaactcctgacgcaccacctttaagagctgtaaccctcacagtgaaggtctgaagcttcactcctgaagtcagcgagaccacgaacccaccagaaggaagaaactccggatacatctgaacatctgaaggaacaaactccggaccatctttaagaactgtaacactcaccgcaagggtctgtggctttgttcttgaagtcagcaagaccaagaatccactggaaggaatcaattccggacacataaggccgggcacggtggctcacgcctgcaatcccagcactttgggaggtcgaggcaggtggatcacgaggttaggagatcaagaccatcctggctaacacagtgaaaccccgtctctactgaaaatacaaaaacattagccgagcatggtggcagtcacctgtagtcccagctactcgggaggctgaggcaggagaatgcgtaaacctgggaggcggagcttgcagtgagctgagattgtgccactgtactccagcctgggtgacagagtgagactccatctcaaaaaaaaaaaaaaaaatgctgggcgtgatggctcacacctgtaatcccagcactttgggaggccgaggcgggcagaccaccaggtcaggagatcaagaccatcctggccaacatggtgaaaccccctctccactaaaaaaaatacaaaaaaaattagccaggcatgggggtgagcgtctgtagtcctggctactccggaggctaaggcaggagaatggcgtgaacccgggaggtggagcttgcaatgagccgagatcacaccactgcactccagcctgggcaacagagcgagactccgtctcaaagaaaataaataaataaaaaataaaaataaataaataaataaaaaagataaagtggtaggcttaagcccaaacatatcaatagttacattaaatgtaaatggtttaactataaaaattaaaatacagtaactagcataatggattaaaaacatgccctaattatatgttctctacaagaaactcacatcaaatacaataacgtatgttgaaagtaaaaggacaaaaaattacacaagcattaatttaaaatgttatgttaacattagataagtggacttcagagcaaacaaaattacctaaccctagcactttcggaggccaaggcaggcagatcatgaggttaggatcaagaccagtcaggccaacatggtgaaacctcgtctctactaaaaatacaaaaattagctgggcgtggaggtacacacttgtaatcccagctacctgggaggctgaggcaggagaatcgcttgaacccaggaggtggaggttgcagtgagccgagattgtgccactgcactccagcctgggagacagagtgagactccatctcaaaaaaaaaaaaaaaaaaattaccagagatggtgaagtacattactaataataaaagtataaatctaccacaaaggcatagcaatcctaattatatatgtaccaaataacagaactacaaaatatgtaaagcaaaaactgatagtattgaaaagagaaacagacaaatccacaattacaattgaagactgcaacatccttctctcaacaattgatagaaaagctagacagaaaatcagcaaggacatagaagaaataacatgaccatcaattaacaggattgaactgacttttgtgaaacactcaacaacaggccacacattattttcatgtgcccacagtacatataccaagacagaccatgtcctaggccaaaaaaaaaaaaaaaaaccttgaaaaattaatacccattgaaatcctaagagtgtgttttctgactacagtggaaacaaactagaaaccaataacagaaagataacatgaaaatttttaaacacttgcaaactaaacacacttgtaaataatacttgggtcaaaaagagggtcttaaggaaaattaaaaacacattcaactaaataaaaatgtaaagacgatatatcaaaatttgtaagatactgctaaagaagtcttgagaggcaaagttatagcatgaaatccctgcattagaaaagaggatatttcaaggctgggagcagtggctcacatctttaatcccaatactttgtgaggccaaggcaggtggatcatgtgaggttaggagttcgagaccagcctggccaacatagttaaaccccatctctactaaaaatacaaaaaggagctggatatggtggcaggtgactgcagtcccagctacttgggaggctgaggcaggagaatggcttgaacccaggaggcggaggttgcagtgagctgagattgcaccactgccctccagcctaggtgacagagtgagactgtctcaaaaaaaaaaaaaaaaaaaaaggatatttcaaaaagttgtatgaaaagaagaaaaaaggaaggtctcaagtctgtatttctcataactacatgtgaatctataattgtttcaaaataagtttataattatgtattaacatacatatttcaatcatttaatagagcttcaaaacataaaatgtgagatttccagtttgacttttttgtagcatgcttccatatactattcatagatagtcacaataattctgaatgacaggccttgttggtattactgacattgctaggctgcctaggtgtgaggtggtacttacacagtttcatgatcacacacaagtttaagaatgtcagaaaagagactgaagtagccattcagctatatggttttccagagggaaagcttgggtcaaaaatcagaaattggcctggcacagtggttcacacctctaatcccagcacttttgggaagtggttggatcacttgaggccaggggttcgagaccagcctggccaacatggcgaaaccccatctctattgaaaacacaaaaattagctggatgtagtggcacatgcctgtaatcccagctacaagggaggctgaggcacaagaatcacttgaacccagaaagtggaggttgcagtaaaccgagataacaccactgtactccagcctgggtgaccgagcaagactgtctcaaaaaaaaaaaaaaaaatcagaaattgaataccaaggtcaaaattggtattgaacctcaatgcccaatatttttatgtcaaagtgccagtttcctgtaggtggacgtctagttggtttcttgctttttgctcttacaaatagttctacaatgacaatctttaaatatatatctgtgtagtctttagggtatctatctgtaggttaattcctacaattggacttgtggtcaaaggtatacgtatttaaaattttgattgataacgtcaattttctatctaaaaaccttataccaatttgtacctccatacctctatgcacgtgttgtttttccacacatttactaacattagatattatccaactttattttttgtcgttagaatagggtttttactttgtttttgagacagaatctggctctgtcacccaggcttgagtgcagtggtacaatctcagctcgctgcaacttctgcctcccgggctcaagtgatcctcccacctcagccttctgagtagctgagactacaggtgcgtgccactatgcctggctaacatttgcattatttgtagagacagggttttgccatgttgttcatgctggtctcaaactcctgagctcaagcagtcctcccgtcttggcctcccaaagtgctgggattacaggagtgagctactgtgcccagtagaataagggttttaatttgcttttgaaaaaatagactttagagtagttttaggttcatgtaaagtttagtggatacacagagtgctcccatgttatacctgcctccagatgtgcaccgacttccccattatcaacatctcccaccacagtggtatatttgttacaatagaacctacgttgacacatcattattacccagtgtctgtagtttacactaggtttcattcttagtgttgtacattctatgggttttgacaaatgcatagtgacacgtatccactgttacagtatgatacacaataccttcactgccctaaaaatcctctgtactctatctattcaacattccctcccacttgtccctggcaatcaccaatccctttactctttccattgttttgtctttttcataatgtcatataattggagttatatggtacctagccttttcagattgccttctctcacttaatacacatttaagttttcttcgtggcttttcatggcttgatagcttatttttttgaaagctgatgaatattccattgtctggatattccacagttcatttatctaattacccactgaagaacatattgcttgcttccaaggtttgccaattatgaataaagttgctataaacagtcatgtgcaggttttatgtggatataagtttttaactcatttaggtaaatatcaagggacacaactactggattggatagtaagagcatgttcagttttgtgagaaaccaccaaattgtcttccaaagtggcagtgccattttgcattgccaccagcaatgaatgagagcccctgttgctccacatccatggcagcatttggtgttatcagtgttttggattttggccattctaataagtatgcagctgtatctcactattgttttaatttgcaatttcctaatgacatattttgtggaggatctttttatatacttgccatctttgtatcttctttggtgaggtatctgttcaggtcttctcttcttctcccttcctccctccctccctccctccctcccttccttccttcctttctctctctctctctttctctctccctctctttctttttctcttcctttttttttttttaaagagatgcaggtctcattttgtcacccaggctgtagggtagtgatcatatttcactgctgcctcaaattcctgggttcaagcaatcctcccacctcagcctcccgagtagctgggactacaagtgcatgccaccatactggctaaaattctttttttgtagagatgagatctcatcatccttcccaggctggtcttaaactcctgggctcaagtgatccttctgcctcagcttcccacagtgctgggattacaggtgtgaaccaccatgcccagctttcatttttttttttttttttttgagacagagcctcactctgtagcccaggctggagtgcagtggtccaatcttggctcactgcaacctccgcctcccgagttcaagcagttccccctgcctcagcttcccaagtagctgggattacaggtgcccaccaccatgcctggctaatttttgtatttttagtagagatggggtttcaccatgttggccagactggtctcgaactcctgacctcagtttatctgctcccttggcctcccaaaatgctgggattacaggcatgagccaccacgcccggctcagccttcattttttaaattgggtggtttgttttcttattgttgagtttaaaagttctttgcatattttggataagtcctttaccaggtgtgatttgccatttaaaattcatgaaatgtgttggagtaacttttttatatgtttactggccatttatggctcttttttgtgaagtgcacattttcttgcaattggcattagctgaatccactgctaagacttctccccacttgggctttcatgcatagcataatggtatacacaatgcttcgtcggaatttacctgacttagaaagaacatgcctgcccaccttccacaagaagctgtacatctgactgtaatggagcgctcctcactctcctcaatgcagagcagaaatagtcacagcagagtggtagataaacttatagtaaatgtgtccaatttaaatgttaccatcatcagcaggaaacatactacacagccattggctggatttcaagtgactgtgtgggtctttgatttcaggaagttcgtgaatgctaatcaagggctaaataaagtggaaagcagcatccttgaaaatcatcgctctcaggacggggtctgcctggaatagcactgaatgtgtttagtagtgcctttggcttgggggctttggagaaagctgcttgagcccttcccatgctcataaattaggtaaggagcagtgaggaagtgtctacagcaacctcagccaatgtgatgtgcctctacagctgtatgaagtagattctctgattttatcttgaaatccacaacttccacaaaaaagaaaaatcttttaccatttctcattaaaaaagtaatataagtttattgtagggggaaataatcaaatgtaatctcattacccagatataatcactgttaacttcttcattcgaattttccctaggtccatgtatctatatatctatggttcataaaaatgagattacaccaaaaaatatcttttgttatctatatagttccagcttaataaatatacaactgtattattatttttgtctgaatagtattttcattgatatatcacaatatatttactccaattccctattgcatatagattatttctaatttttctattaataatactaagggagcttttaagtcaatacatctgaatcttgaataaaattcttgttccttctctttggatgggtattcagactcttaattttacaaatgaagaaataaagtcccagaaggtaacagagatagaactaggcacgattttctattcttctttccttcctttctttgtgagagttaacgattatttaaaagtattcataattttctgataataaaagtaagacatggcattatgacactggatattcaaaaaccacgatgtccttttacttgaagattttaaaaggaaatgattacaataaatacccagagtcaacaattatcaagtttctgtcatatttgcttcatctatctctttcctttgaaagcgaatcctaggccgggtgcagtggctaacgcctgtaatcctagcactttgggaggtcgaggtgggcggatcacttgaggtcaggagttagaaaccagcttggccatcatggtgaaaccccaactctactaaaaatacaaaaaattagctgggcatggcggtgcacgcctgtattcccagctacttgggaggctgaggcgggagaattgtttgaactcaggaggcagaggttgcagtgagctgagatcatgccaccgcactccagcctgggcaacagagtgagagactgtctcaaaaaaaaaaaaaaagaaaaaagaaagcaaatcctaggtaccatttcattttatccctacatgttcagatatgctgttagggctcaaaagtgataccccaaagactgtgctttgacatgctgagaggccttagaagctgcctcagaatcaaggttcccctaaccttgtcttgtctccaccccctcccaagcatagggagagactctctctggaatttccttgtctaaccaagaaagcttttttccaaaagaaatgcaatttttcttaggatcccctccctagggggtctcagcaaataaccaggaaagatcactcaccagagaagagaagatgttggaagtcatcaccatgcccagacagacttttcttctattcttctgaaggaagcttcaagagattacctgggaaacttaatctgcaaaataagatgacctttgttcctgtgcagttctgcccatcaccttcccataatgtctccctcccacctcccaggttcatacatctcttcccataaagagagtttttttgttgttgtttgtttgtttgtttgtttttgagatagagtcttgctccgttgcccaagctgaagtgcagtggcacgatcggctgactgcaagctccgcctcctgggttcatgccattctcctgcctcagcctcccgagtagctgggactacaggcacccgctaccacgcccggctaattttttgtatttttagtagagatggggtttcaccgtgtcagccaggatggtcttgatctcctgacctcgtgatctgcccgcctcggcctcccaaagtgctgggattactggcatgagccaccatgcctagccaaagagagtatttaagcaaccatctagcccctcttagaattcacattttgtatgaatcccatgcacatatatgcatcttaataaaatttgtatgccttttttcccaataatctgccttttgtcagctgagttttagcaagccttcagaagacaaaggggaagttttccctttgcccctacaatgcctatgtaaaaaaaaaaaaaatgggcttctaaaaaaacacaataccatatcacacctaataatttaataattccgtgacatcatctaatatgcagttcaaaatgaaatttccatgactatctcaaaacatctctttttacattgggtttgtttgaatcaggaacaaaacaaggcccacagattacatttggttcttaaggctcctaaatctatatcaatcctcagcagtcttttgtaatttccccccatgcctatgttgtagaaaccaggtagccctgtggaaagcttcatattctggatttgcccatttattcccatgttatttaattgtttcctctatcacctatatctccatcagtgaaggtagctctagagcctggattagagtcaagttggactcctgttaagagtatttcacaggtggtgctgtgcagtcagtattgcattaggagctatctaatgcctagttgcccacttttagagtatagtgggcccagtgctatgccaccccaatgggggagggcaggctagaggggtgggagggcaataccaagacaaatgcaagataccctcccacccacgatggttcctcttccacctccaactacaccctcatgggtgtagaatcagattttgctttgagatgggagaggtttcctcattcagcccaatccacaacaccaccatagctccatcatgggcaaaccgtttttatagacttgctaattaatgtctgtggaccggcagcattagcatagcctgcacctgaaagcttgttggaaatgcagaaactcttaccctataattaccaaattaaaaattggatttgttggggctcaaagaaatgacactccaaaatatggcactttgacatgctgaactagagaagcagccacaaggcctctctgccctccttccccaccccccaattctctgtgtctcccaaagcataggatgaggctgttctccgaagatccctgatctatctagaaactgggtccaccaaagagaaacacaattgcctttgatcctctcccctaaaatatcgctaagcagaaaagattaaaactcatatctcagaggaagagatgataattaaacaccacacttggagcccagacactgttctctggtcctgtttgattcccaaagagaattatttgctagccatgaactgaacattgggcccattcattacccctaaaaatcatttactatataaattgccacatttccctgctctttcctcccctgtgaagaaaagtatataagcatctagacctcactgggtttttaggtaatcatcctcctgggattcccttgtgcttatgtgtgttaaataaatgtatatgcctttttctcctattaatcttcctattcattctctgttcactttcagcaaagcttcagagggtgaagaagagctttcccttggctcctacacgttctaacaagattctccctgtgattagcatgccctttaaaatttgagaacccctggtcctcaggaccccggagaagttaggtctggattagaggaataagggcagtagtattagttccctgcttctgtataacaaattaccctaaaacttaatagcttaacaaagatacatttatgggccgggtgtggtggctcaagcctgtaatgtcagcactttgggaggcaagggcaggcggatcacttgagcccaggagtttgagaccagcttggccaacatggtgaaaccccatctctactaaaaatacaaaaattagccgggcatggtggcaggcacctgtaatcccagctaccactctggaggctgaggtaggagaatcgcttgaacgcgggaggtggagattgcggtgagccaagatggcgccacggcactccagcctgggcaacagagcgagactctgtctcaaaaaaaaaaaaaagatacatttatgatctcacatattttcagagtcagaaagcaggagtggcttggctggtgagttctggctcatgggactcttacaaggttgctgttgggttgtcgagctattggccagaggaaccacttccaagcttactcatgttgttggcagaatgcttcagtttcttgccacaaggtccgatccctaggactgcttatgatatgagggtccccaaagatgagtggctagatagagagagagagaggaagggagagagaagtcacagtgtttttttaatagcctaatctcagaagtgacatgccatcacttctaacacgttctattggtcgtacacactaacctagcactctatgggaggggagtatgcgggggtgtgaacgccaagaggcagggatgcttggggaccatttcataggctcactaccactgcagtaaccataaccggggcttcgccttgtgaagaggatgggaaacttcctcctggaaacagagtaggtctcacactcagtcctctactccaggagaaacagggttcacctgcctggctcttatctctctgtcctcctgagtctatagactctcatttctgttgcaattgcatgatttgttctaacgctctcaattcccacaagcactttttttttttaaagttacagattttcgcttgagtaacttctttagataatctatgctgcttgctataggaagaacttagtggctgacagtaagaaatcacttaatataaacgtatgtaaagccaggcgtggtggctcatgcctgtgatcccaacactttaagaggctgaggggggcggatcacttgaggtgaggagtttaggactaccctggctaacatggtgaaaccccatctctactaaaaatacaaattttagcagggtgtggtggcgtgcacctgtagtcccacctactcaggaggctgaggcaggagaattgcttgaacccaggaggtgcaggtggcagtgagccaagattgtgtcaatgcattccagcctgggtgacagagtgagactccatcttaagaaacaaaataaaacaaagatacataaaaatataagggcacatagtttcaaaggttggtaaacaagtcattcagtgtgtgtcattgtggcatctgggctacaaaggacagctgggaggtaaaattactgggcagagcagaggatggtttagatacaggatagtggagaagcttgtttttttttctgaggaatgatgattagaattcacccaggagtatactctggcctaactgcagatattaaggcgatagaattgtccaatctggtgagtgatgaacttagagttggtgattagtagccgtgagggttggggcagtgtgatgctgtagtcctacctgccaaatggagctgataatactccaggaagatgtacttttatgtttgtttcaccaataaggaaatacaaaaacaagttcagttttccacaacattcaggtaatgggctttgaggaaaaaaaagatgaaagtggcagttcagtgtgggagctgggagggctgtggaagtgggtggggctaaaacagagccctccctggactggctgctcctcaggatctgctgtgaaatttgcaagaaagtcctatagagcctggttaggagctgtggaacaggggagggagctccagagaaaacgaagcataaagcttaaggcccagacctgagagaaaggctaaatgcccaagacaggaaaagaaccaagcaggttttagaacaacagaaagatgagaaagcaaagaggggatctggagaaagaacaggctcgtgaagcccagattaaaattctcttctcaggaattgacagtttccagcttgcggcagtagaatcagctttgcaaaatagaaaggaaaagattccccctgaagagttgcaaaccatctgattcatgatttattgccttagaaacgtctgtataaacacaaggattaggtattgtctcccccagcttcctgtcttcaatttccttctttttcatctggatgttttgttatgaactctttatctcttaagacaatgtctttaacattcaatggttagggcaattcccaattcagtctgtgattctttcgcctgtgcatgattgtaagatgttcctgctacttccttcttacgctaatagtagtaacataagacatcaaaactcaaagcaaagacactgacccacaaaaagtgaagcgtggaaataattgttgttcagggaggccctaaaacaagtcaggtttgaatacctcaggtcctttctgtgctctgggggagagggattctaaagcccaattgcctcacactgacctatgctttgatgccctcagcatctggccctacctctccaccttcaactcataccatgttcccccaagctccagtccactggcccctttttgaggttccaggtgtcagtggaagatgccaagttgtgctctccctctgccccagatcctcacatagctggtccttcatctttctcacctccattcagatgttccaagtctcaaaatatcaagctgacccattttcttggcatttaaatcccttcctggtaactgattaggcttccaccactactcagccacaaccggtctgggttgcaaaaatcagtcacctcaatggctgggagaagttaaagacccttccaatagtggcttaggcccctgaggaaagctgtcaggaaattttaaaagaaaactcaaagggcattttgatgaaagaagaaataaggaattaaatttcagcttatgaacaacagttgtagaaagaggagagttaggaaggtgaagactaacattcatttaggtccagcctcattcccatgttttacccatgttatgacatggaaacttctcaacaagcctacagggaaaggttagtatcctcatttcgtagataaggaaaccaaggctctggttgagcaaatttcccaggatcctgcagcaaatacatggaaaagccaggttcaagctgaagcccagctgactctaagcccatctgtgtgtgtgctgttccctgtccacaggcctagactctgctctgaggacgtgggggtttgggtggggcatgtgctggcattacacaggtattgaaagacacatgggcaagaatacttcccatgccctcaccatctatatggatttcacgtatcctttaggagcacccgagtcagtactgcctcctttgttttgaaacaaagggtctagttcactgtcatttttacacaatggagacctttataaattacagctttttggtcctccacttgcaagggaaacaaggaccataacagggccatcaataatctccccaacgcagaggacctgaacatataagctgcaaaaagatgtctgaaattttataatttgtttgcttcctgaataatcttttacttggtagaatcaattgtaagtgccactgtgcttgtggcttcacagacattttgaaaattagataatgcacctttaggatgggagtgagaagcctttgtccctcatggcatattttatataataaaaaaggcttgtatggagcaggggtgagctgggaaggtgaagctacttaagctgctgctttctttctgcattatggtacagaaagtagcaaaatatcaaagccacacagattccatcttcccttaaaatgacagaagattagttgaagacagaagcagctcaggctcagtaaaaaacagaaggtcttttcatatccagatgggactctttaatcctatgaaaattcccagtgtcacttactggggtagaagttgactatttggctgtctctttttgtttttattttcgttttagagattgggtctcactctgtcgcccaagctggagtgcagcgcacaatcacggcacattacagcctcaaactcctgggctcaagcaattcccccacctcagcctcctgagcagctgggactgcagaggtgtgccaccatgcccagctaatttttaaacatttttcgtagagacaaggtctcactatgttgcctaggctggtctcgaactccggggctctcaagtgttcctccaccctaggcctcccaaagtgctgggattataggcgtgagcctctgtgcctggctatttggctgtctcttgagttaccttcagtattagaatctgagccacagtaggagaaacctaatagtcaaccttaatgatggatgtggcagagagaaaattacagctcctcgctggacaatgcacccaacacatggaaaaacataggaagaggtttggtctttgagttatataatcagcctggatttttacatggcagagagaagggtgaaggtagatgcatattgtaccttttttgttttctgaaaaaagtttgcaaatgaggctttgatttgtatatgtccacttcatctgggaactccattactaattcagggaaagagttgctggaccaattgaacaatttgtctctcagatatatgcaggaaaatgaaatatcctattagttaacagaaaattgtcctgatacatgcagtaaaagggaattaaaagcattgtttccaaattgattgtgccagacaaatttggccaaatataagtgcatgacaatatcctcttatggtcttgcactttgctttacagttattccaatagaactcagtattttgggtctgtacaccaagaggtgacatgagatggaagctggggtcattatggttaacctgaatgtgtcagaaaccaagcagaggctgaatgttattatatgcagcctgtgaatcagagtgaatggtagaaccaggctaaactatacattgcaaaacaggtgcaatgtttggatggaatggtcaccaacagtatccaaataaccaatagctggttgatgggtgttatttaccataccaaaaacccaacctgcagggacacattgttcaattgatctgagatcccaacccacttccacaaaaggaaagaggctcaattaataggagctaacagaaacaggtaaaaggaaagcagacaggcatgtgcacaagagatttgtagaccttcatgtgaagaggagaatgttaataaaaacttcttgtgcatcagcatcctaaaattctactgttgcagctgctggtctgattttcctacaacatggggaggtgtttgcagtgaagatatcttctattcccacaaagagtagtttttcatctttaaatctttaaaacaaagaaatctgaaagctagaaaacagccagggatttccaaattcagtgtttcctaaattcgtctgtgctacagaattatctgtgatgcgtgttagacagagattctcagactctgacagcatctccagagaaatagctgggatcgctctactgagcaagctccctgcttatgctcaggcgtgggcaggtctggcaacatgatgattgcacatccaaattgtaccaaaaagaaaaacaggtgcacagaaatgatacacccaaggtccctaggaacacaatagaaccaggactgaacttaggtctcaagcacataaaaatccaatcttatttaatttccatggtaaggaggcacacatctcacagtgtgggtttcaggaccacaaagcctaaggtttggttgcttagggcagtaggtgattggaccaaacccttctattcaatcctcagcaagaagttctgcagctcgataccttagaaaagatgcaatcactcgactctgaaaattccctgttagcttgtcagctggggctgctttaattttacttttaggtcataattctatttaataccactgagctctgttctattgatcactgggcttgactcagcactgatgtttttgaggaattgaccattatgtctgaagtgtagggtaaagcgggtatccaaggagaagaagagtgtttgaggccctatgatttcctggaatattacccatctgggaaattgtgtaggagtccattggaggagatattttaaaactccagcttggcagaggttttgtggaaatggacacctaaatcaattcgagagcagcctatgagagctagaatggggtcggcaaagttaacagcttttttgcctgaaggagtgggggcagtggggtatggaacaggtattcttgctggcttgtaggtgggtgagcagggagaaagagctctagtctctctttttccttttctttcttcctttttttttttcttttttgagacagggtctcactcggtcgtcgagggttggagtgcagtggcacaatcacagctcactgctacctccacttccctgggctcaggtgacccttccgcctcagcctcccgagtagctgggacttatggaggtgtgtcaccacacctggctaattttttaaaaaacttttttgtagagacagggtttcactatgttgcccaggcttgtcttgaactcctgagctcaagcaatcaacccacttcagcctcccgaagtgttgggattacagtctccagccaccatgactggctcctctttctcttcttatttgaggacaataatctcatcatgaggtccccacactcatgacctcatctaaacctaattaccttccaaaggtcccatctccaaacactatcacatggaggattagggctccagcctgtgaattagtggggaggggcacagacattcagtccataataggaggtgtccttaccttcagccccgtagcgtggttgaaccttggtggggatggagaagtgctatagaaaagaccagatggatagcgaatctgagaacattaaggttgcattaggaggccactgactgtgggagtctaatacccagaagtaagctgcaatcttaagaacaagatgagatcacttacaggaaagaaagaacatttgggttttttttattcttctttttttttgtgcacacataagtctcagtgtgtaaaatttgacaccaggatgtccatatatacacattcacacacacataggagagacagaggaacatagtaggggtaatatccataatggtagttatctctggatggtaaaattatgttattttatcttttttcattgaccactagtgcggatttttctaacatggattattatttatatatataatttataacaaaaacttcccaatatatcttttcataagatgtcagttattttcaaaggtcacttgtgttgtgtctgcatctttcaaaatcataggttgtaaactcaagcatttaaattcttttttttctccccagtgaaaagataggagatttgttgctgttgtttgtctggtttttgcgcaggactgacaagttattttgatgtcttataggcacaacctaagtaatataatttggttaagttggaaaataagcattttgcagagctttctcctaggctttcaacagcacaagatttttatgcccttctcacgatgagaccgaagtgaagactttttttctttttgagacagggtctctcactctgttgcccaggctggagtgcggtggtgtgatctcagctcactgcaatctcagcctcccaggttcaagcaattctcctgcctcagcctcccaagtagcaaggattacaggcacccgttaccacgcccagcttatttttgtttttctagcagagatggggtttcatcatgttggccaggctggtctcgaactcttggcctcaagtgatccgcccgccttggcctcccaaagtgctgggattacaggtgtgatccaccgtgcctggctgtgaagaccatttttgaaactccagttagggagatgtctcccactgtgtggccgaccccttcccatccacagatgaatgacttagtcattaccttttacaaagaaaattcatttattttttcatcaacgctttaaaaataaaaacaaaataaagctagacatttttttctgatgggatttgggaagaaagattaaaaaagtgtaagaaaagcctttaatgactctgtaatatttaacacctaaacaaagcggcttagtaccagtgggagctgaaactcattaaaatgaaaattatatttgcttcatcaatgctaaaataaatccaagggaaaacaaagaggtacttttgtaattaaatttaacttactgtcataatctcaattctcgctatttgcaactgtgggagttattctcaaaaggatgtttaaggataaagttttagagtccacagtattccaagtttgggataaaattgagatgattcaaaggagagagaaagaggaaggggtgtcaggtggtgggggattgagagcttcagagaagccaggcggagtgcccggatgaggcttcccatctcctgttctctactgtgttgctgggtggagttctcgcctccctcaagggatagcatggaaagaaaaacgttgttccagtggtgtctcctctgtcagtacagtggaacagggaagaatcctgtggagtgagacggcctcttcgagaggatttctagaattgggacccagcgggtggaggaatcacctcaaacagtgtgaatgttccctagagagctgagcagtctctgacctggtcgacataaccactcacctgctcagaacggcccgtgatatgctgctgaataccagaaggagctgtcgcctgttactgggtggtagctacctaccatccccggagcatttgttacatgtcaggccctgtactaagtaaacacttttcatatactatctcactcaatattcacaacaaccttagggtacaggaattattgttcctattttttaagaatacaacttgaaaatttattctcatttcttcatggccacacctttcatttgattgtggtgagatatacataacaaaattttaccaaaattttaagtgtacaattcagtattaagtatattcacaatgctgtgggacaatcaccaccacccatttccagaactttttcaccatcccaaacaaaaactttgtacccattaaacaaaaacttcctattccttcttcccccaaccacctggtagccactagtctactttgtctctatgaatttgcctgttacagatactgcatataagtggaatcatgtatttctggcttatttcatttagcatagtgttttcaagtttcatccatgttgtagtatcccattatataggctaggaaactgagacttatactaaataacttgcccaggaccacagaagaattagtgacagaggaagaattcatatccagggatgtcacactccaaggtccatgctcttaatcatcctctaccaagtgtttctcccaatgcagaccacagaccactaaatcagaatgaccatgagtgcttaaaaaacacagatttctgggctccaccctactaagataatccttctaaacgataatccttgtacttttaacacattccccagttgattcttatgcaaaactaaagtttgtgaattacttcattcttctctattgaaaatgcaactaaggaaagatggcggcagagaaaatgaagacatagttacaaactcaaggccaagtgatctcatggaaaaggagaaatgagtaggcaagtgctatggtttgactaatagtgtcccctccaaaattcatgttgaagcctaatccccaatgcaacagtattaagaggtgtggcccttgggaggtgactaaatcatgcaggctccaccctcataaatgggattagcacccttataaaagggcagaaggtggaagggagcattctcttgttcttttgtctcttccaccatgtgaggacacagtgttcctctccttcagaggaggcagcaatgggaaccatcatggaagcagagagcagccctcacctgacactgaatctgctggtgtcttgatcttggacttcccagacttcagaacagtgagaatttaaatttctattgtttataaattacccagtgtgtggtattttgttatagcaacacagactaagacaataagctctaggagttgtcaaatgcctatatattttgttggggtctcctggagggatttccaacgcatccaccctatttgccctttgtggccccatgagtcatcctttcatgaagtgaaaagatacatctcttatagtcatgccatatttttcattccaagttttacggtttatgtcaatatgtattatgtatgaaaaacaaactagctttttgtcaaatgctgccaaaatgtagcatctcaatgtctggcataagaaaagaaagacacaaatggtgattgtgatgctggcaaaccaatgcacaacgtagccaaaatacatgtcatatttaatgtgggactaaaaactcaccttcaggaagactttcaccttgaaatctggtgatgtgtggaacagatgttttaatttagctaaaattatttgcataatcgatttaacacatggtttatcaaacctgccaaagagcaggtgacaatatggaattaatatgattactaatttgacacatcattgagattaatttgacctttctcgatctcagaatacctagaggtcttcacagacaggaatagtgtgctatgaaatgcagtctaaaatccaccatcttagcatcataaagtaagcaaccactttgctcagtctggcctcatgtttctattccttttctttccatctcttctctaaatggaaaggaaggcaatgagtgaatattggggaacatatctgattcacagtgttcaaaattttatgaaaagtaattgatctaacgtgcctctgatactagatgtggtactgccttctccctggtctgttgatttatccttgaatctagactcaaaggatatcacctttgagaattaattggcttaagcctttagctttaagtctaaagactcaaaataatgacttttttttttttttgcgatggagtttcactcttgtcaccagttgtcacccaggctgaagtgcaatggcatgatctcggctcactgccacctccacgtcctgggttcaagcaattttcctgcctcagcctcccaagtagctgggaatacaggtgcacaccaccacaccgggctaatttttgtatttttagtagagatggggtttcaccatgttggccaggatggtcttgaactcctgatctcaggtgatctgcccacctcggcgtccccaagtactgggattacaggcgtgagccaccgtgcccggccaaaataatgacttttaaattgtatatcagtttgattacaatagtaaattattctattagaaataatagaaatgtttattaatagggaattgataaaataaaataatatcgtatgcgagtaaaatgctgtgtgcccatttaaatgatgtggaaaaagtatatttaatgatataaaaacatgtttgtgatatgtgacatgaagaaatcatattgcatctctgaaaaataacaataaaaacgagaaatcatattgcaaattagtatgtgcactataagcttatttttataagaaaaattatgtacatatctaaaaggataaatatcaaaacgttaaccatggttatatctacatggtaggattaaggctgatttatggtttttcttttttatttatattttaaacaattttttaaaaccatgaacatacaattttttggtgtaatagagaaaaaagtcaatcaaaaaaatatttgtgaagtgaggatggcagattgaatcagcatccaattttactctctcccaaaactccattaaagttcctacacacacacacacacacacacacacacacacacacacacaaccatgaaggaaacaacagcaagaatgttttggaagctggaaacattttggaaactggtttggtaggctcgcaaaagcctaacctcaaggctgcagtaggtaaatgaaccaagctgctttaggctgcagaatcctgcctaggattgccactggggatggagatgggaagagggaagaggcaagggcactgaaagaaggagcactgggaaaggttgtctgagaagctgcgagatctcaagagacggtctctccttcgtcattcctcagcccttgagcccctcatccttcacccaacaggagtatggaagcttattctctgtattatggacactagacacagttggaagtctgatcgtcatacgcaaaacagaaagaataagtgatcttatgctcagcaaatcccggctgcagagccctccctgacctttccactcaggtccaggacaccaacagccagactctgacccttccagataagatattggaaatggcttcttcataaaggctaaatttatgcttgcccctcaagattgcaaaattaagcaacatatcacttaaggacacatatgtaggtgatataaccaaaagaaaaaaaaaagcaggggaatgaatactcttgccctatgtaatgaggaggaaggggttgcacctggggtaataccttggtaatgtttgattttttttttaaagaactagagtgataggaatatagatagtataataatacattttattattcttatttaaattttagatgtgcattttatatattcttccctacctattttatattttacaattcacaaaatgttggtaggccaggcacagtggctcatgcctataatcccagcactttggcaggttgaggtgagcagattgcttcagcccaggagtttaagatcagcctggacaacatagtgagaccttgtctctaccataaaaaaaaatagctggatgtggtggcacacatctgtggtcccagctactcaggaggctgagacaggagggttgcttgagcccaggaggtcgatgctgcagtaagccatgattgcgcaactgcactccaggctgggcaacaatgcaagaccctgtctcaaaaaaaaaaaaaaaaaaggaggcaacctaagacctcttcctttctgtgtgattttctccctttcttcttttcatccctattatgtttctgctgctctttcattccctttttcttttctagaactttatagaggtcaagagttcaagatcagctgggccaacatggtgaaaccctgtctctacaaaaaatacaaaaattagtcatgcacggcggtgcatgcctgtaattccagctactcaagagtctgaggcaagagtttgaacccagcaggcagaggttgcagtgagccgagatcgcgccactgcactccaacctgggcaacagtatgagactctgtctcaaaaaacaaaaaataaacaaaaaaacaaaaaaagaaatgagattggtcaaaaaggtatgacctaatgggaatagacaggggactcaatcaatgcctgtctattcagattcttcttggcttcactctttcctcctgggtatgggccaggaccctttgtggaaaggtagttgcatgacctacaatcaaacaaagtaggtaagagaatttctttatgtccagttcttactcaaaaaggcaggggaaggttagagtagtattttatgttttatggctggctttggggatttttgggttctggtttttatgaaccactttgcagaagagaaattctagtttctgtggcttgtcttgaagaagaatgagaggtgaaagacaggaaagcaggagagagccagaggaactttgcttttgaggctgcttctgaagccttcacttgggggcatcactttctgagcccccacagtgtcttctgatgaacagaaatgtttaatgttaatgaagtttaatttattagttttttaatggttagtgctttctgtaacctaggaaatctttacctgtcccaacattgcaaaggcattcccctatgtttccttctacatattttatagttttagtttttacgtctatgtgtgtgacccatctcaaattaatttttatgtatggtgtgaagtagagatcatgtttttttcccatgtagatattaagttgttccagggccccatgtttttaaactaatagaatgtgcctctatccctttatttgctcatcatgcaaaaaaaattctaaacctaaacctgaaattttgaaatatgcatccctgtcttcatatctcactgcctccctatgacatggccagtaactttaaggaccacctattatgacagctccccaccccagataattacaaatgatatatttctttaggatcatattttcagattagagaaaaatagattttgaaaggaaaaaccttggcactattattctttgactgctctgctcttccaatgtctaagatgtaaataaaatcaactattaagtttggggctgcaaattttttttttttttcttttagatacagaatctcgctctgtcacccaggctggagtgcagtggcatgatctcggctcactgcaagctccgcctcccgggttcatgccattctcctgcctcagcctcccgagtagctgggactacaggcgcccaccaccacgcctggctaattttttgtacttttagtagagatggggtttcactgtgttagccaggatggtctcaatctcctgacctcgtgatccgcctgcctcggcctcccaaagtgctgggattacaggcgtgagccactgcgcctggcctggggctgcaaatttttatatatcatataaagggtgaaatagtatgaaacaaaattggtgtttaacttttttttttttttaatggagttttgctcttgttgcccaggttggagtgcaatggtgcgatcttggctcactgcaacctctgcctcctgagttcaagcaattctcctgcctcagcctcctgagtagctgggattacaggcacacaccaccacacccggctaatttttgtatttttagtagagaccaggttacacaatgttggctaggccggtcttgaactcctgacctcaggtgatccacttgcctcggcctcccaaagtgctgggattacaggtgcgagccgccacgcccagcctaattcattttttcaatgtttttaaaattggcacgtctgactcctttaaaaaatcaggtttactgggccaggcgcggtggctcacgcctgtaatgccagcactttgggaggctgaggcgggcggatcacgaggtcaagagatcgagaccattctgaccaacatggtgaaacccatctctactaaaaatacaagaattagctgggcatggtggcatatgcctgtagtcccagctacttgggaggctgaggcaggagaatcacttgagcccagaaggcggaggttgcagtgagccgagatcatgccactgcactctagcctggcaacagagcaagactccatctcaaaaaaaaaaaaaaaaaatcaaatttacctaaaaccaaaggaataaattccaaaaagagaaaaaaagcaactgtcaaaaaatgcagagaagtcaaggaacaaaggacgtgatcagcagatgtaaaaattaggaggaacctaacagagaaggttttgcagcctggtggagatgggatctggagcaaaggaggctgaggaaaatgcagggaataactataggtgaatgtgaatggaattaagtggcaatttttttcttttttttttttcttttttttgagatggaaccttgctttgtcacccaggctggagtgcagcggcacgatctcaactaagtgcaacctccaccttctgggttcaagtgattctcctgcctcagcctcctgagtagctgggattacaggcatctgccaccacacctagctaatttttgtatttttagtagagaaggggtttcaccatgttggccaggctgatcttgaactcctgacctcaagtgatccacccaccacggcctcccaaagtgctgggattacaggcgtgagccaacatgcccagcctcatgaaccaatctctatgtaatagtattaactagagtccatagtttattcagatttctttagtttctaccaaatgttctttttctggtccaggatcccatctaagatactccattacatttgctggtcgtgtctccttaggttccccttgactaggacagttgctcagacttttcttgtttttgatgatcttgacaattttgagaagtactggtcaggatgcccctctgttggaatttgtctgttttactcatgatcagattgggttatgggtgtgtattagtccattctccagggttctctggagaaccctgactaatacagttcttgcattgctgtaaagaaatatctgagactgggtaatctgtaaagaaaagaggtttaattggctcaccgttctgcaggctgtacatgcaagaacaaaaggaaagacagtttcttgcatgactcaactttcagcttaatttttttcgttttgacatagtgaattggggcgccaagatttttgttttccttttacaatgtcaaagtgatatggtttgtctgtgtctccacccaaatctcatcttgaattgtcacccccataatccccacatgccctgggagggacccggcaggaagtaattgaatcatggggtgagtttttcccatgctgttcttgtgatagtgaataagtctcatgagacctgatggttttataaagggtggttcccctacacacgctctcttgcctgccgccatgtaagaggtgcctttgctcccccttcactttctgccatgattgtgaggcctccccagccatgtaaaactgtgagtccattaaacctctttttctttataaatgacccagtcttgggtatgtacttattagcagcgtgagaacagagtagtacacaagggtggatactaccaatgtgattcatcactgttgatattgactgggattgagatagtgtttgtcaggcttctccactgtagagttactccccacccactccacccctcccttcccccttctcatgctatcctctttggagggaagtcactatgtgaagtgcacttttaaggagcggggagttatgctccccccccttgatggcagggaatccagataaaatatttgggattcttctgggcaggagacttgtctcttctccccatttattaatttattcaatcatttatattagtatggatttgtagaaatttattttattcactggtttataatccaatattactttattttgttgctcaaattgttccatttttggccatcgagagcactttcagttggttctggatgtttactttttaactctaaaagtattcagtgttctggtgagttttataccatgatatttaaaaacatgaatgggacctaccatataaatattattattttattattattattttgtagacagagtcttgctttgttgcctaggctgaagtgcagtggtgcgatctttgctcactgcaaccgcttcctgggttcaagcaattcttctgcctcagcctcctgagttgctggaactataggcgcccgccaccatgcctggctaatttttgtatttttagtagagacggggtttcaccatgttggccagtctggtcttgaactcctgaactcaggtgatccacctgcctcggcctctgaaagtgctgggattacagacatgagccaccatacctagcccagtatagctattatattggccaaaaaaaaaagcaaaaacctctatttctttaatattaaatgactgtcttctcctaaatgacttagaggaaacttgtttgtttgcacaatagtaatgattagaaatgttaaaatgtcagcattgaaaaaggagcagggtttattgatctttcatacataattccaacaccagctggtgagagtgtgctgggctcagggctgagacactggggtgtttagtatcagctcttcatccacttcctatgcccccataagttgagcttggcaccagtcagcttgtttttacagatgttgattcagtttagaaatagccatctgggcccaaggctatgcctcacagatggtgattcagctcaagggtttcacagacaaaggttgtcatacagctggagcacttggggactccctagttcagagccccagagaatgtagaaaattagaaatggaaagggcctgtattagttatctattcctgaataatgcatcactccaaaacttagtggcttaaaacaacagtcatttattatctctcgtggttcctatgggttagatattgtgaagtattcagtggggtggttcttttttttattattatactttaagttttagggtacatgtgcacaacgtgcaggtttgttacatatgtatacatgtgccacagtgggggggttctgtcttgggttctctcatgatggtgcagtcagatggtggctggaaccgggtcacctctagggcttctttactcacacatctggtacccagactgtgatgatcaaacatttgaggaccgaaacagctagggctccagggcatctccctgtatgtggtctctccatgtgacctctccagcatagtggcttcctggtagctggacttctttcatggtggctcagggtaccaaaggcacatattgcatgagagagagaaaactccaggctgaaggcattttgctttttttctaacttagcctaagaggtcatatggaaagagaattagcctctacctttttgtgagaagagtgtcaaagaatttgcagacaagttttaaaaccacggcaggaccttagaggcctgatagctccagggctggatgtcttcctttgcccctcctgttcctgtctgtgccctcctacccattcggtgcccaggaggcagagtgacagctcctctctgctcttggtcctgggacactgcatgcttccttgcatttttcctgcacattgcccacacctttgtaaacagtccttttattcaactcctcaaattacccaatttgagacaccatctgtctcctgcagtgattctgatagttactcccacatccttcaccttagagatgagaatgaccccatgctcccagccaggggtccaggacttgggacacccaatccagggtccttttgtttccattctattagccaacacatgcagaaaccagaatggggcccgaggcaaaaggaaaagtcactgacacagtgtatttatttaaaactttgacatttttttcagcacggatttttgcattaatttttgttttataacagattgcgttataatattatttatcatgactgagttttttttttggcatccccttaacttttgtgtccctgggagtcccctacttgcctcaccctatcccggccccatccctccagcttgctccccaccttgtgctgctaccacactgcagagctggcttgggcttttagaggccacccaggaatcctttcagcacctcctccttttcctgaggttttaccattgaaccctcattgcctggtgggtgccacatcttcggatgctgtcagcagcatttgagtggtgacgaatccctagtttgtaactaggtggaaataaaagctcctttattcaattttctgttaggcacctcccaggagtgccaggtgtatgtatgcctggtgctctggaggaagatgggtgagatgcatggtggaacttagaggcatttgcatttagggtggaaaacagacatattaaaagttagaataaaatatgacaaaggctcttcaagctatataaaaaatactgagtacacaactaaatctgttgtttagagtttgttcaaagaaggaaggagggtgggtaggaaggggtaggctggcagagaggaagagcaggctggctgctggcaagtcccaccaaggtgaggttaggaggcaccacagataactaaacaccggctagcttgcagttttctcttctgctgtccttatttagatcctcttctgtcactgcacgtagctggcagacttttctcttttagatctattctaaggcactaaggaatgaggctctttacacttcatttctctgctgtcagggaagaggctgatgttacgtgcccatgcgtcaccactatttaacgacagacacaccaacggttctggacctggcagtatttttccctttgatgcaggcagtgagggatgttaaatggcatttcattatgatctactggctagatgttagtcatggcatattttagagtaaggctgaagggagttgtagggaaaagaaagagagatcagacagttattgtgcctatgtagaaaaggaagacataagaaactccattttgacctgtactctgaacaattgctttgccctgagatgctgttaatctgtaactttgccccaaccttgagctcacaaaaatatgtgttgtatggaatcaaggtttaagggatctagggctgtgcaggatgtgccttgttaacaaaatgtttacaggcagtatgtttggtaaaagtcatcgccattctccataaaccaggggcacaatgcactgcggaaagctgcagggacctctgccctggaaagccgggtattgtccaaggtttcttcccgtgtgatagcctgagatatggcctcaagggatgggaaagacctgaccgtcccccagcccgacacccatgaagggtctgtgctgaggaggattagcaaaagaggaaggcctcttgcagttgagataagaggaaggtctctgtctcctgcctgcccctgggaatggaatgtctcggtataaaacctgattgtacatttgttctattctgagataggagaaaagccgccctgtggcgggaggcgagacatgttggcagcaatgctgctctgcaactctttactccactgagatgtttgggtggagagaagcataaacctggcctatgtgcacatccaggcatagtaccttcccttgaacttatttgtgacacagattcctttgctcacatgttttcttgctgaccttctccccactatcaccctgctttcctactgcattcctcttgctgagacagtgaaaatagtaatcaataaatactgaggaaacccagagaccggtgccggtgctggtcctctgtatgttaagtgccggtctcctgggcccgctgttctttctctatactttgtctctgtgtcttatttcttttctcagtctctcatcccacccgacgagaaatacccacaggtgtggaggggcaggccaccccttcaggaattgaggtactccaaaggccattgtgcaaacaagaacaatccccaatctccttcacagttatccatctgcaggcatctcgctttaggctgcaccatctcatttttttgctgctagtctagtcatttggttaatttccaaggctattgtctgtgaaggattgactgcctggctggacacagggatctctttagtctggattttgtttctgattcactgcgataatctgggtagatagatcacttaatctctcaccctttcctcccattattactcttcaaaagccttctcgccaaatcaccactttcttattcccagtgttcctgggccttaatagatgatgtcattcaacaatccttgatatgggatcaaaatactacttcttttgggcagttcctaattattttattttctgtttctgctttataacttccagttccccctttcttcaatcttctcaatttcactacactctacatttcagctcttctctctgatgcagctaaactactatattatggtgcataatctttaatgggacccattcctagctaatcttttgaaatgcagttctgtaattatattttaacttagttccctctttttctaactgtggcttttaaagtctgttaatgttctaatatgaagtcattccttctaatttaataataatatgaaaaacatatcctatgcatgcactcatataaaactattattattaggagtaaaaccctagggataaagacatataatatggttggtataattcaataacagctaccatttaaatacattctctatgtattatatatattataatatttgatccctacaataattcttagtatatatcaccatttcacatgtaagaaaatttacaatcaaagacattgaatcgaggtgggcctttgttttgttttgtttaactcttttgcggaaacctatcattttgtggattcagcatcccttcttctgaaaactgcttctcccttctctatccctatggctgcattgagaacagtcctgttatgacaacatcctaccccctggcctctgggcctcgtcctacaattgtgtgaagcacattagtttatgttatttttatttgtctaacagtaacatgtaaaacttagaattgttggtggcctgtttaccagcacagggactgcagatgtcagtaaagtcagctagcagacagagagactggggagtggcattcacactcctgcctttaatcccccacgtcctggcccccccatgtattctggaagaagtcttcgtgtcctgataaaaaatttcccttttggcttacgctcaagtttgttatcagtcacttgcaaccctgaaaagtctgaacttttaccaactgttgatcatcatttgggttgaaaatagctggcacattagaatttcattcaaaagctgatttatactagttccccaaaggctatgtgcttcgtttcttccttcctgatctcaaacacacatgaaaaataaatcttatctattaaaaacagttgcattaaaaatagctaaatcctttttttactgaaatagaaaaacaattataaaattcgtatgaaacctaaaagacctcaagtagccaaaacattcttgagaaagaaacaaagcacgaggcaccacacttcctgatttcaaaatatatcacaaatctacagtagttaaaacaatatggtacaggcataaagacagacatatagaccaattgagcagaacagagagccagaaataaatccacacatatatggtcaactcatcttcagcaagggtgccaagaatatacaatggggaaaggataatctgttcaacaaatggtgttgggaaaactggatatccaagtgcaaaataataaaattgaacctttaccttaaatcttacacaaaaatcaactcaaaatggattaaagacttaagtgtaagacctgaaactataaaactcctagaagaaaacaggaaaaagcatcatgacattggtcttggcaatgatttaatggatatgacaccataagcacaggcaacaaaagcaaaaataggctagtgggactacatcaaaccaaaaagcttcttctgcaggctgggagccgcggctcacatctgtaatcccagcagtttgggaggccgaggcaggtggatcatttgaggtcagaagttcgaaaccatcatggccaacaaggtgacaccccgtctctactaaaaatacaaaaattagctgggtgtggtggtgcacacctgtaatcccagctactggggaggctgaggcaggagaattgcttgaatctgggaggcagaggttgcagtgtcctgagattatgccacagcactccagcctgggaaacagagtgagactctgtctctaaataaataaataaataaataaatgccttctgcacagcaaaggaaatgatcaacagggtgcaaaggtaacctacataatgggagaaaatacttaccaaccatgtatctgataagtggttaatatccaaaatatataagaaactcctacaactcagcaaaaaacctattaagtcattttaaaaatgggctaaggacttgaatagacatttctccaaagaagacatacaaatggccaaccagtatatgaaaagatgctcaatatcaccaagatcaagaaaatgcaaatcaaatccacgacgagacatcacctcgaaactgttcagatggctatcatcaaaaagatacaagatgacaagtgctggcagggaaaaaaggaaaccctggccactgttagagggaatggcaattagcacagccattatggaaaacactatggactttcctcaaaaaattaaaatagaggagtattgtatgaaaggagagaaggttaacattccccttgacaagaggaacagaaaatcaaataccgtgtgtcctcagttataagtgggagctaaatgatgagaacaaacacatggacacatagagggaaatgacacatactggggcctattggaagttggagggtgggaggagggagaggatcaggaaaaataactgatgggtactaggcttaatacctgggtgaagaaatgatctgtacaacaaacctccatgacacatgtttacctatgtgacaaacctgcacatgtactcctgaagttaaaataaaagtttttaggccaggcacagtggctcacgcctgtaatcccagcactttgggaggccaacgtgggcagatcacgaggtcaggagatcaagaccatcctggctaacacggtgaaaccccgtctctactaaacatacaaaaaaattagcctggtgtggtggcaggcgcctgtagtaccagctactcgggaggctgagacaggagaatggcgtggacccaggaggcagagcttgcagtgagccaagatcatgccactgcactccagcctgggcaacacagcaagactccatctcaaaaaaaaaataatgaaaaaataaaagtttttataaaaatagaatggtaatatgattcagcaagcccacttctgcgtatttttccaaaagaattgaaatcagtatgttgaagacatacctgcattcctatgttcgttgcaccagtattcacaatagctaagatgtggaaacaacctaaatgttgacgaatgaataaagaaaatgtggtatatacatacaatggaatattactcagtctgagaaaagaggaaatccttgtcatatactacagcatggatgaaacttgaggacattatgctaagtgaaagatgccagccacaaaagggcaaatactgtacgattacacttacatgagctatctaaaatagtgagactcgtagaagaagacagtagaatgatggttgcagggattgggaggagggtaaaatggggaatcgctaataatgggtataaagtttcagctatgcaagatgaataagttccagagatctgttgtacaacgttgtgcctatagttgataatattgtgttgtgcacttaaatatcttttaagagagtagatctcgtgttttaactcttcttaccacaataaaataaaaataatagctacattcattcaaacaaatcatcttgaaagcaatggaaaactatttggtggttgttgttgttggctaactacaatgagttttattcagtagtctttatttcttaaagaacgcaatgatatgttctattttctaacatttcaactaatcgattaatcaggaaaggaaaaaggaagttcatctaaagcatggattagtgatgttctaagttgacgtgataaataaaagaaaaaatttattatcacaggtcatattacaacttctaacttgcgtgcatagggattttgtggtcaccctgaaaacatggcctataatgtgactgtgaaagccaagtgcagcctgtggaggctctgccatgaagtgtcagaagttctctgtgtgtgtctcatcagtctaggcacaattttaaattctgcacctgcccccatgtccatggattgaatatggatctgctattgtgtggccaccctggccttcaggcttaacataggtgacaatttgctctggggctttgtgaaagaaaaaatgtcttattcctacctaacaaaaagaaagtattaaccctgcctaacaatagtcgaagacccaaaaaacacctatccgggactgtataacatcaacactggagaagctatctggaaaaatatggagaaaaactgaaatatttgaaagtaatggaggttaacatacaggtaatttccaatcagcatacttggggactctgagttttcccagaacatatttaaaaaaaaaatccagtttgcttgaacaaacaactttcaaatattaagctaattgtttgaatgaccaaagcagtccatgaaaataatttatccttagtcttcacacataggcctacttattgcccagaaaatttttcttcggcctaatccaaattactcttccatttctctcacctatttttaatactttctctcagagagaatggctacctggcttctccttgtcttccaatttaatcttcttagtttttctcgatagcttgtagtttccatcttttaattaccattaatttttttttttttagaaaaggtagtttccactggcttagtagatatttaccaaactggtgaaaactacacattaatttatccacctagaatttggtgggaatgaggtccatcttgtactataatttgtggattaagtaaaatcagatgctatgctatgatgtttgtaaaatcagtcactatgttagtgctcattcatcccagctcttgctgtgtgtggttcctgaggagtgggcatcatgacagcagggtgggaacatcactgttgtctgtgcacgtgcatgcgtgcatgtgtgtgtgcacatgtgcacatgtgcatatgcttgtaaaggggctggctggagaagaatgtctccttggtgatgctaacaaagcaacattgagctggagtgacatcaggtgccagaccccctaagaggtaaaggcagaggtctccaaggtgggtgctggactgaattctgggaacaggccaagggctgtggctacatcaatgggaaagagaagagggcctgtggcatgcctggtgagtgggcctaaggctccctctaggcacaaaaagggtgggagatagagctgaagatggcctggcatgtttgaggccagcaagttggggttaagttgtttgtttttctcctcttttattcctcccaggtttctttataaccttttcaaaattcaggcatctaaacagcccttgggatgagaaggacatggtggccagtgtccatgagctttaggtactcttttccctctcactgtctgtggtctgaggactgcttacaaagttggactgtggcacgaaggcctcctgattaaaccaacaaagaggccgcctctccagagctcagaattgtcctgacatgaaaataatcaagttctgacactgccaggataattactgtttaatttcgagtattttaaaactgaaaatatagccattccttcctttataactctgtattatggtctatttgtaataattgtaataacaatgcttggtgcagagactggaaaggggtaggaaagccaatagtggagcatcctcatgtttcccacagttttggacacaaagaagaaattctcttctctcctgataagcagagataagcttatacttatttccggatccctaagtcatctttttagccctgcaaatttgctggtgagcagttacaataaagcttcctggcagttccttctaccagagtgttaaagtaatccaggtatttgaaggcacgaaatggaatgacttaatctcatctctcagtggttcagatggatgcgaaggtcatggctacagctacctggtctaggagtgtgtacatcatgtaaacatccaggtcaagtgacagagctcagctaaaatccagaagtcccctgacaccagagttagttttccatgaaagaaatgcctataagaaactggaccaggataaagcaaagagtaaggggcaggaagaaagcttataattgcattactgcaatcttctgcaaaatcagacttctgcttctgttccacctctttaaagctgaaaatgcctcaagtttcttactgagagacatgagaaattccatgaatactaaattctttgacaatttctagcatggtttcatccaaggttatgtgatgaggctgcataatataggctctatatgtttgggtattttatgcgtgtatgtaactttgtcactttgatttgcaaaatggaaaattccctgaatgcccacagaaaagtataatgtagcatttagcaggtcaacaaaatgcactcccttattctttgtctccgcctcattctccaacactttagtgcactaagttgtagtgactgaaatcattcttggtgaataatgctgggccacgctgaaaatttgtggctgagagctggaccctcgtcatcgccacgtactctgtcaatgagacagggtaacccatggttactgagctccgatcagttaaggggcagagagcctccgctccccactgctctataaaagagacccagcaaagggaccctaccagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagaggtgagccacccctggactgacccatctcaccttccttgcgtgttagccctaggcggcaggcaggctgcctctgctcgcagccttttggggttcgctgtttcttccctctctgctggatgctgtcttgcccctggtttcccctatcctgttctccctccttgcctctgagcatcccagactgcctgcctgccttcctctggccgctggggataccctggcctgatggagagggtctaagaccttcccgtcttctccggacacgggaaaacattacccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgcccggctcgcgggcgcccgggacgcggggaaggtgggactctgtgcggggggcagagggctcgcggacatctcggggaaggggctggccggaaccgccaggggcgcggtccccttagctaaggatcggtccgcggaggcgcgccaggagcgggagagggtggcgcgcccggggcgcaggaacccagcgcagcctaggctggaagtcggggcgctgggcactacagagcccgggaatggggcgcgcggagagcggccgcccgaggacggcgctgcggcggctgcagcccgggacttattgccccatgccctcctcccccagggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtgaggcgcccacggccagccaacctagccggagggcggcacgggagggttggaaagggctggggcgctgcacccagcgtggggctgctgagcgtaggtagccagtggcacttcttagacacttcgctggtgcccgagtcggagaggcgcgttcgaggacccccacacggcgagaatctcgcccttacccgaagacctcgacccacacacatccagtggggctggggccggtgcctctggacgctgccatggtttaaattcccttctgggcgctttcgaggccctaggaacttctaaagacttgaactcgcagcgcggaactctgacgcaatccagggccgaggaaaaatgattaaaacccaacaagctcgagtgctggggtccaccaagcgggccgtcttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggagggcaggacaagacccctaagctcactgcctcctcgattccagtcgtcagactccataagtataacagggcagcatgggatggctgatggagctctactgtccaattaaaataatcatgattaacatctccaaagtaggattattttggaacctgtcacatgcgttagaaataatttgtagctgggttgttggtaattttgctaatgtggactagattggactcgttaaactggagacctgtggtgattttgagggtcaagtcaatagactctgaccctttgttcaactgcaaactttaacaagtgaaggaaaaatgttccaggtagcataccagccatcattgcctggctgttgaagcagttcttgacattttaaagtaatatgtgatgatatttttaaaaaatgagaaaaatgggtgtatatagtcattagcaggtaaagttgctgctccagttttttcttttgctatctattttcaagatattttgttcacatttcaatgactagaggaaagagagaagctgcacgaaacctaaattatgcttttgtggaattcttctgaaggtgagaggtagaaaatatgaccaaggtaaaaatgtacattgtacgttgttttatttaccaaagtggttgaaatgataaagtataaggaagtttacttactttggaagctttaaggcttataaaaaattaattaatactattacttgcaaacaaccctcaccatccaatatatacaaatgaaaaggcgagcaggcagagtgtggactgtcgattctcacttatgactgaaggcccattgctggatgactttcccccccttttcaactcatttcagacttcaggagttgatggaaatgatagcatctatgtctgtatttttttcaaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttcgtaagtgttctcagtcaaaaggcagaacttcggatatagacccgctttttgaaagtagtatcattgcacagacttaaagaaatttgaactgaggaatgatttgaatggaaatttttttgtaattagaaatgacctaaaggatagtttctattctttattatgaaaatcaaatcacagtttttaatttatttcccaggttaggtagtatactaatttatgaagagtacaattctatcttttctccaaagtcttgctctgagcttctcaggttctacaatgcatttagtgataagctttaatcttccaagtcatttcactaatccaggataagcttgagtgatcagatataaagttgcagtcttagagatattcaggcacaggcttgaaagtctccatgtctttcagcctgtgcctgaatgtggtagaccgatgtcatgccctgaccagagggttggattatagcacctcaatgttaccttctgattctgagcccaccactctaattcaattcatttatgatggacacacacgtagcttatgctacacaactgaacagcccaggtctaaagcatattatcttactaaaaatatttactccgcggtggctcacgcctgtaatcccagcactttgggaggccaaggcaggcggatcacgaggtcaggagatccagaccgtcctggctaacacagtgaaaccccatctctactaaaaatgcaaaaaattagctgggcgtggtggtgggcgcctgtagtcccagctacttgggagagaatggcgtgaacctgggaggtggagcttgcagtgagctgagatcgcgccactgcgctccagccggggtgacaaagggagactcttgtctcaaaaaaaaaaaaaaatgaatttactcatctgctaattgttttttccccattaagagaaaaatctgtttaaaaaattagaaaaggaacacatatcactcatttttgcatacagtagaattaatggtaacacttcatgcggctgaaagatggggcctttatctgccaaagaataatgcactactgatcttttgatttctagttctgaaaaaacaaaagaatttttgaaaaagccccccaaaaaggctgttcctgaggactgcaacagaagaattctagaagacaaaataaagagtttcccctatattttgtttagttagaaatcagaaacctcctgggccaggcgtggtggctcatgcctgtaatcctagcactttgggaggccgaggaggaggatcacttgagcccaggagtttaagatcaggctggcccacaaagtgagaccctgtctgtattaaaacttttaaaaaagtttattaaaaaaagaaacttcctagaaccatcaaggaatttcagtcctttttgaaagtaagtataattaaaaatatgaaaaggaggcaagaggtgtttctgatctgttctgatcaatgttgattcatccagtaatcagaaaaaaaagtacaaattctgatgcttctagtttcatatctagactaattaatgtattgtaaatttatttatttgagacggagtgttgctctgtcacccatgctggagtgcagtggcacgatcttggctcactgcaacctctgcctctcgggttcaagcaattctctgcctcagcctcccgagtagctgggattacaggcgcccgtcaccatgcctggctaatttttgtgtttttagtagagacagagtttcaccatcttggccaggttggtcatgaactcctgacctcgtgatccacccgcctcggcctcccaaagtgctgggattacaggcgtgagccaccactcccggccaatgtattgtaaatttagatttgagatataaaacaaaaaattgtagaagttcttgggagtaaattaaacattaaaaatgcaccttttagttaacttatcacttaacatgcagcaaatatttatcagacttaatactgctgtctttcatttttttctcagcctattttctcactattagaaaaatacttaaaataggcctggcatgggggctcactcctgtaatcctacactttgggaggctgaggcaggtgaatcccttgaggtcaggaggtcgagaccagcctggccaacgtggtgaaaccctgtctctactaaaaatacaaaaattagccagatgttgtggcacatgtctgtagtcccagctactcaggaggctgaggcaggagaatcacttgaacccgggaggcagaggttgcagtgagctgagatggtgccactgcattctagccagggtgacagagcaagattccatctcagaaaaaaaaaaagaaaagaaaaatacttaaaataagcctggggccatggtgaagctgccgagctgcatcctaggcccccagttttaaaataaaaattaagtttttttaaaaaagaaaataagtaagaatgaaaaagaaaatacttaaaattatttactttattatttaaaaatagacagagtttgagttttggactcaccattaagcctcgatttttccagattcctagctttaagctggactctagttaactcaagtgttcctagaactactaccagctagtatttgtttgggtgctgtgttatgtcttgtgattgttataaacaaggtaaccccctaagattaacattagaagccccctcacagcccagggcctcctgacaatatccacgtgtcactgatggtttttgttccccaaatccttcctgtctccaaattgcttttgtggtatatatgctctcttcctgggcagaaggccctagatcatgaacaggagccctagaataagatacaataaatgtctataaaaacctagcaaaccaagtaaaggaaacgtgaatttctttttcttttctacaaagcttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaaggtgagttgcttacttgtttcctaaccgtttgataaggccacaactttatcagagcagaagcaatcatatagggaaaacctggacactagcaaattggcgtagtacgttgctctgatgaactcttaaatctcaaatgtgtttgccctagctgctttgactaaccccctcttctatttcagttatgcggcaagttgcatactcaggtgccccttctgactacttgaatactttccctgtgatgtaagaagtgttttcaattggtaaagttgtggtatataattacaattgaactctcttgtacttgcctcttttacaaaaattctctcctagcagaacgtagtgtgagtcatctacacagctgtttttctgattattggaattttcttttgacatgaaggaagtatctcattgacagaactgcgttgtgaaggagtgctaactgtagcataaaatacaaaattggatttttagattgcaaaatacagtaaagctttgaaaagtatttggcatgacatttaactcaatacattttgcctaaaaaatattagccaagaacccctatcaacttgtttttgaataaacttctgtatggaccttaaaattcatgctgagtttgaccgcattttcttgcactggtagcattttccctctgagtcatcctcatttccttctactttctcacatgactaggttaagataactcatgtatttgctgctatcaaaggcagtcataattcctaatcagacagattttagtgaaaaccaaataaatagaactaggactgagaaaaggagtatatccaatttcctttaagccctaaattcatggactagtgcctgctttttttaagttggaacttagtggaagaatagtcctttgataaggacatttttgggtatctttggtacagttttactggcttgatattatttgtatgtcatttttgatgtaaaatatagaagatgaaaggtgtgagcacagactgggagatctgcactttagttattggggctatgggggtaatcttggtgtttcctcccgaacaatttagagcctacagtgttctaggcatctgttccttcacaaaatattttttgaatgcttaccatgtgcaaggcactattgtagatgctggaaattagcaataaacaagacaggtcctgctcacagggaccctgcattcaagtgggatgagacaggcaaaattgccatgtatttcagttggtgataagtgctatacagaaaatgcagcagagtagtgtggtagacagtgactgggagcatgggggtggatggagaggcgcggggctacttgtgataaagtggtcaggaaagaaaccttttgagaagtgagacctgggtgatagatcagaaggaaccagcagctgtgagaacagggagcagagggaacagtgcaggggctcagaggcaggaatgggcttgctggattccagacatggaaagaagaggaggattggcataaaacagcttcagggagatgggcagggccagagtgtggtgagccctgcaggccacattagggagtttaagtgcagtggtaaaccactgaaagagttcagggaggaaagcaacatgatctgatgtatgctgtctaaaacgtcactgtggcttccatgcaatgaatgggctgtagggccatgccaccctttttatggctctggtgagatgtttctttagttattattaacatatctatcaagattattttcttaaacctcccagatttctatgtattggaagatgagttccaccaaaataaaaccaaaaccaaaaaaccttcaattttgcacattgagttggtgtgaggatcttacatttggtacaaggaatgtaagtactttttattgttttttgttttttgttttttttttgagatggagtctcgctctgtcgcccaggctggagtgcagacatgcagtctcggctcactgcaacctctgcctccgaggttcaagcaattctcctgcctcagtctcctgagtagctgggattacaagcatgagccaccacacctggctaatttttttttgtatttttagtagagacagggtttcaccatattggccaggctggtctcaaactcctgaccttgtgatctgcccgcctcggcctcccaaagtgctgggattacaaacatgagccactgctcctggccaagtacttttttggtacattattgtgggctaggcaaaagatagtagtggcttagaacctgaacaaagaaatttagggaatccctgttgagaaactgaacttgagaggtccctgcataactcagtttctgccattgtaagaaaagctgagaggtttgcaaagaagggagaaaaatcattgaacagcaaggaataagtgcacttaactttcttgtttctttgttttgttcccctcactttagtttctatttcttcctagcttctttatttcctacttctctctcctgagtctgcctttttgcctgcaacagcacctgctgaattttggaacctataaaactaagtggaaaatttagttgtaagagatgttcctcctggacatcctctactcaagggaaaggcaattaaagtttttttcctttactgctaaattgcttattccactctcaatacaagaacatgaagccctgtatacagtggggctaattaaacctctttcatcatttgatgcaattatgtataaagcctctaagcatcaaacccagtacatagtaggtaggccctttaaaaatatgtatccccacctgcccctgctcattagtgaagcagttgccattatgttattttccaatttgctgtttagttccagttgtattccaatgctcttctgtgtttttttgtttgttttgttttgttttgttttttcggagacagagtctcactctgtcgcccaggctggagtgcagtgacgtgatcttggctcactgcaacctctgcctcccaggttcaagtgattctcccacctcagcttcccgagtagctgggactacaggtgtgtgccaccgcgcttggctaatttttgtatttttagtggagacggggtttcaccgtgttggccaggctggtctcgaactcctgacctcaaatgatccacctgccttggcctcccaaagtgctggaattacaggcgtgagccaccatgctggtcagtgcccttctaaatgcctgaatgtgtgtgcttatgtgtgtgtgtgggtgtgtgtgtgtattaagttctctattttagattttggttcctatgtgttaaggtctatctagtgaagtactgagcaccttgtcacattctactagatctcttaatgagcacacttcaatgaaaaagaggatcacaggcaaaattgtggggaccagtacaaatgaaaatgtgggagcccttattacaattttatgaaaatgcagcagaacattaaaccaagcatagagcccttctaggcactggctttttgtggctgcacaggtggcatacttgtgagactgccctggggagatgggggctcagagtacttttgggactaagagtggttgctttgtttgtgttggaaagtgaggcacggggattgctatggacaagacagtgtggaaaaaatgaaaaggctgggtgaggtggctcacacctgtaatcccagcattttgggagtccgaggcaggaggatcccttgaggttaggagttcaagaccggcctgggcaacatatcaaggacccatctctacaaaattgaaaaaaaaaaaaaagggggaagcaggaaaaggtgatcatggtggaccacacaaagctttagaatgaattcttttgagtagcttgaaataaatttgttttagttgaaaggagaaagatcatggtaactgtagctaacttgggccccaaatcagggttttattatttctttaacatactcataattaatcaaaattcttattgttagaaatgaggtgttccaatagcacacaaatttcctttacaaagaagaagaaaagagatgaggtgaaggaaaaacggatgtgaaagccctatttataaaatgtaggtatttgacttcgcttagctgtgactgcatgcattaagaaattggagtgattcagtatgtatgtccaaatgatttgaaaagtaaagcattttttggttgaatttccacacatcttatatggagtttacagatttccattttatcattccagtccttgagcttaaaaaaaatgaaaaaaacatgtacacacatttctaaaaaaaatgattactcaactgatttagaaaagcaatttttatgattttttctcttttaaatgtcttttaatttccagagtcccagatgttaaattaaatggtattgccaggatgttgagggctgattgagtgaattcatggacccgctgttggtcaaatggtttgacttctgtaattggtttaaatgtgtctttctctgctgctttattcccttagaaatcctcagcaggttgcgagggaataggagactttgtggagctgctgggaggaactggattggacccttccaagatgacgcctttagctgatctctgctacccctttcatggcccgggtgaggtatttctttgattgttatgtatgtgcctatcaagattaaaaaaaaataagcactcccctaatattttctacattggaaggtgagtttcgccaaaaaagccttcaatttttcacactgagccagtatgaggatttgaggctatatataacatcagtatctttaccaaaatatccgacactgggagagaaacctttgaagcaataaaggttggccttaagtaaaactatgaaaaagacaaagcttttaaaatctgcattctttccattttcttgggggtctctgctttcattttctagagactaaagagtttactaactgaaacacttatggttcaaatagtagatgtatcatcaattagtaataggataataatgaaataactgttttttatgtatgtgtatgtatgtgtgtgtgttactcatagtaaataaacaacaaagtgataagctttattagaaattcttagaactgctaagtctataacttcttatggctaaactagcctctcaaaggccagtgtaacacagaggtaaattctgaaatctaaaagcggtcaccagtaatagaagactggtttatttggcacagcatatgccaaatagaaccagatctatgtcagagacaagtgagtattttcacttttttatgctcatgtcaggtgaggatggatgggacttcatgacctcatgaccagataactcaatgaagtctcggggaggtgggggagaggagtcataaaacattcctgtaaaggtcactcccatagctttacttcagacacaggagtcctagattaacattaacgagacaaaacagaagaagaacagcagtctctaatctcagttaattcttactgtagcctccttcctctcctgtcactgcagatcattaaccagctaggcaatgaagctgcaaagcagacagtcctcttgatcagctgttacctgtaataattaaaaccaggccagaccaccagtattttctgactctgagttgatgatggacaaaacatctccaaaatagaattaacatacagtcagcccttcttaactgtgggttccccatacacagattcaaccaattgtaatagaaaatattcagcgtaggctaggcgcggtgtctcacgcctgtaatcacagcactttgggaggccgaagcgggcagattactgaggtcaggagttcgagaccagcgtggccaatatggtgaaacccccgtctctactaaaaatataaaaaaattagccaggcatcgtggtgcacacctgtagtcccaggtacttaggaggctgaagcaggagaattgcttgaacccgggcagtggtggttacagtgagctgagattgtgccactgcactccagcctggatgacagagcgagactagacagagtgagattctgtctcaaaaaatatatatatattcagtgtaattcctgaactttgggaggctgacgcaggaggatcgcttgagcccagcagtttgagaccagcctgggcaacatggcaagaccacaccccataaaataaaaaaaaagaaaagaatcaggtaaaaaaaaaacacacaaaaaaatacagtataacaactatttacatagcttttacattgtattaggtactataggtaatctacagatgatttaaagtatatgggaggatgtgtgtagtttacatggaaataggtaaaggtaaaaggtagccatttacataagggacttgaacatctgtggattttggtatccgtgggatggggagcatcttggaaccaatctcctgaggataccaaaggatgaattatacaaaagtcagcactaaagcctgatatgcactccaccctcccccagatacacctatattctaaaagtttcagatgagatttaaggtaggagtgggctcaaagcaagctttctaatcaaggtaaaggcaaaagatttccaaaatcccactttgcggaaaactagaggattctctaatgctaattgacacttgagccatggtttaaactgtcagtgcatgcggcttctttagccttttgggtgcatgatctgaggcactaaagtacttccatgctcatgattggagagcacctttgaggagatatacctcagctgggttaaaaagtaagacaaggattaaagaacaatcaggccttacaatttagataattgaagccaaagtcatttttccgcttgagtgatataacttgaattagaaaaaaaggtgattctaaagccagaaaaccacttttgcctacattacctaggtaactgaaaccacttttaagacaattttaaggcttgaattatatcactctttggttcattttagactttattccgttactggaaggagggccttgagtgtaagttgtccaggttcttggcgttttgaacaaagaattggacaaaacgcacaaagtaacaaaggaatgaaacacaggaacaaagtagccgaagcagggatgtattaaagggagaaagcactccgcagggtgggagtggaccctagcgagcggctcaagggcccggttacaaaagttttctgggtttcaagtactcctttcttttgttttgagatggagtttcactcttgttgcccaggctggagtgcaatggtgcgatctcggctcaccgcaacctccacctattgggttcaagtgattctcctgcctctgcctcccgagtagctgggattacaggcatgtgccaccacgcctggctaattttgtatttttagtagagatggggtttctccatgttggtcaggctggtctcgaactcctgacctcaggtgatctgcccacctcggcctcccaaagtgctgggattacaggtgtgagccactgctccttttgaggttcctatcaattaccctttatctggatgaaggatttggtttgtgggtaaaggctgaggtgaattggcaccctatgcagatgaagagatagcccatgcttgttccacggccagtacaaggcactctccctttccttgtgagatgtggtggaaggggagggttgtagggagactagcctttgatccgtcgctacttgggcttgggggagatgcggtttttccttttggttcagctttaggaagtttgcattaattgggcttaggttccctgcccccagacccaggtgttttccttttgatccagctttgggaagtcagcacaaattggcctcagtttccctgccaccaggccttggtgtttttccttgattcagcatgaattgaccttaagttccctgcctccagaccctattctcctgccttaattcttttctttctttatcatatttccatgagcccctcctgagttgttcagtgttgaactattaaggaccctgccctttacattggattttgttaggaattagttcaaaataataaataaataataagtaaagaaaataggacatgttataaagattaaagtccagagtaagatcagaaaaagaatgacctccaaactgtttaatgaaaaataaatttggctgggtgtggtggttcatgcctgtaatcccaacactttgggagtctgaagcgggcacatcacttgaggtcaggagtttgagacgagcctggctaacatggtgaaaccccatctctattcaaattcaaaaattagccaggtgtggtggcacacaactgtaatcccagctactggagaggctgagttaggagaattacttgaacctgggaggcagaggttgcagcgagccaagatggcaccactgcactccagcctggatgacagagcaagatcctgccacaaaaaaaagaaaggaaaggaaaagaaaaagaaatttggacctcctggtagaagcttaactagactacctggtacttatattaaaataattatagggcttttatttattatgtcatccatttgacttttatctcaataactctattgaactgtttacttcatttaaacccaggtatgtgtttgagtggtacccattacacgaggacaatgatagcatttcttaaaatttaaaaacaccttatagagacaaagtgaggaaaagaaagattgagaaaactaaaacagcagaaatgattattgtagagcagataaatcttgcctcaggaatcagcttggataaacaaatagaataaataaaaggaaagtaattcttaataaaagtaatatgagtttcaatatataacccatacagaggagatataaaagttgtcagatcttatataaataatgaataagattggattttttttttttttgagatggagtctcactttgttgcccaggctggggtgcagtggtgtgatctcgacccaccacaaccactgcctcccaggttcaagcaattcttctgcctcagcctcccgagtagctgggactacaggtgcgcaccaccatgcctggctaatttttgtatttttagtagagacggggtttcactatgttggccaggctggtctcaaactcctgacctcgtgatccacccacgtcggcctcccaaagtgctgggattacaggcatgagccaccgtgcccagctgaataagattggatttaagagaagcaaggatatcagaagccatttcatataaatagtacagaaaaaatcagagaaaagttgtaagtggataataaaacaaaaactagtatgttcagtgtatgtctatacgatgcaaatgatctttttgtttatgtataaaacagtttttgtataaattcagaaaatgataaacaggtgtttttttttgttttttttttttttggtctacataaatgtcccgcagtacattccatcctctagcccccactaaatgccccttgcaaccctagatcggtgacaaccaaaaactgccactgcaaatttccgacctgtccttagagggccgtactgtttccactgcaatccctgaacccgagcaactgtgcacactccagactgattgcctttgcctgcctttactacttaggctttgcaggcaaaaaaggccgaggagacatcttcttgcctctttccagctagttttattttttaatagtgttcttgcacatgaggagaaagactgaattcaattgcactattctataactaattataagttataataaaaatgaaacaaaaacatttcaactgatagtagatgcatggtttgggtacatgagaggaagataggtctccttgctttcattatgtttaagtgatcccgtcatttaaatgatgactgtgtggtttctaacctgctgggaaacttttatcttttccatccattatagcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggcaccatgatgttgggctttatttgctttcctgagtagtcctctttcttgttaccatcagaaaataatgttatcatgtggtgcagagccaaatgctgaactaaatcattttggacttctcagagctagaactctgggccattgaagtagaattatttagaggagaggtagaattgcagtgtttgcacaggcaacactagctggtcctggcagggaagcgggtgcagagattcattttccgctatcctcagaatacgtgtttttgtcacgatatacatttctacaaagacagcaaggaccttacaacaactctcatagacacaatttgcagaaatctgaatacttctttgatactgaaggcagtttactgttgactgagctttgttccgtgtttggcttaaaactgagtgtgtagtatgtaaaagacatcttggagcaaaaaggaaggttctaagctacaaagaaaattcttttttttttttttttttttttttttttttttgagacagtcttggctctgtcacctaggctggagtacagtaatgtaatctcacctcactgcagcctgcacctcctgggttcaagcgattctcctgcctcagcctcccaagtagctgtggttacatgtgcgccaccatgcctggctaatttttgtatttttggtagaggcagggtttcaccatgttggccaagctggtctcaaactcctgacctcaagtgatctaccagccttggcctcccaaagtgctgggattacaggcatgagccactgtgcccggctagaaaattcttttaagggaactctttactttggattagtagatgaaagcttcaaactatgccataattaatggccttattatggttcctgaaacatatttaatatgattggcatatactgggatcctatacactgggcttgttcacaaaatctgaaaaccaggcagaaaaaaaaaacccaactaattggaagtgtttcaaatacctaggatttggcacaagttttggctcagtaggtattttggaatgagtgactactttagcaaatgatgaataaatgcttgaatggatggatggatggatggatgacggatgactataattcttgattagttatataaaatattggattcttcatttcatagaaactaaattctatgaagcaggaggttgaacccttttcttaaaaaagatagtcactctagcaacccaagaattaaggaagttacttttatcaccatcagaagtttctggctcttaaccttcatgattccctcatgctgagtaaaatacacttttctattacatctcaccatcaaagttaggaaacttcttttattcctaagggattttgcaagctgattagcctctctgcagtaagacaggtgctcctgtggtccttaagccctgacattctgtggtcatttgtgacatgctttacttcaaagcttgttagtgaacaacaggttacattctttgagaggatgtccaccctggtgaactgtccatgtctttttcttggactgtctactacttagcctatgttccaaaaggatggggcagctttctggaaacaaaatggtaaatgaaatctccgggggagatttataggttgtgtcttcattggtatatccatcaagcgagtaaaagtttatatgaaacaatatgactttctaagaaaggaagtatagcgtagtggttaaggtcattgactctgcagccaaccctcttggaatcccagctctaccactgacttgagcaagtcacttataagtctccattccttagtttttaatctgtaaaatttgggtaatttacagtacctttacagaaggagaaaggtgccttcttcaaaaggtttttggccacattaaatggttagatatatttaaagctcaagacctgtgtctcacatgtgttggctgttatttttatttttctctcttctaagcaaatatgccattctgggtcctccgtactcttattgggacatttgctttgtacgctgaaggatttgcactaattcaattatactgtttcatcccaggacatttgtgaggaagctagggttagttaaggttgttgcctgtcactgagaagcatagtaaccccagccctaatcctcaccctaatcctaacgtttgagggtagatcatgtcaggatttatctaattcacacacatctcttctcacagctcacccctgtctgcaggcactgcactgctccaggaccaatcctgaccttgggcaagaggaatttgaatagctcttgtctgacgttctggtcatgagcaaattgtctcataaattgtctggactatctgcccttctgccccattctccatctctgtaatctttcagatcttggttatttcattgtagtagttcttgtctggccctgtttttatctctcactcctacctataggtctttctgaataccaattaggggactagggatctgctttctacaaccaataactgatttctcaaattcttcctgcctacatgtctaaaattctgagcatttttgctcataggttttatgtcactgtcaccatctaattttctagatgcttctcttttttcttcttttgagacagggtcttgctctattatgcaggctggagtgcagtgacagctaactgcagcctcaacttcctggggtcaagtgatctctcacctcagcctcccaagtatctgggggtcacgggtgcatgctacctgtggctaattaaaaaaaaaaaaattataggctgggcgcagtggctcacacctgtaatcccagcactttgggaggccgaggcaggctgattgcctgaggttgggagttcgagatcagcctgatcagcatgatgaaaccctgtctctactaaaaacacaaaaattagccgggcatggaggcaggcgcctgtaatcccagctacttgggaagctgagacaggagaatcgcctgaacccgggaggcggagattgcagtgagccgagatcatgccattgcactccagcctgggcaacagagggactccgtctcaaaaaaaaaaaatttatagagacagggtctcactatgttgcccaagctggtctcaaatttctgggctcaagcgatccacccacctcagcttcccaaaatgttaggattataggcatgagccactgcacccagccttgtggatccttttctacctcctctaatcctgcctcttctgccactgtcttcgagcctgccatctatggaatatcttgatctgcctatgatactggactttctcctagtatataaagcagcatgtcttctttacctccaactactccctggtactgttgcttcatttaagtgggtagggcagaaatgctatatgttcatcagaactcactttacaacctctcttacagttaggcttggtcacgtgactgaattatcacagaaagaatgtgggtggatatgatgtccaccccttgatatgatcctccacaccttctctctcttcccatacctactatctgttagacacagaggcttgaacagaggactccaaggccatacaggaaaacagagccataggatgcaagaagcctgcatctctgaatgaccacatagacggctgcctattgactatgcatatccacattggactttgtatgaatgagaaataaatttttattttgttaagccactgagataaatatatatagcactattatcatacttcatacaatgggcctgtctaaatccaattcttagctattctgtctgttttcgttgcaactatccagacaggcctgacttgactcttccaaagaaaaatacctcaaatgcacatctttgatcttatgaaaactaagctttaactggtataaccatatgcaacctttccacattctttaaatagtcttagaacagtgatccttagacctctttgaaaatctgacaggagctagaaattgttttccagtaaaatatctctatacatacaaaaataccatgcaaatacctgagagttcacaaacccctgaagagcatctaaggatttcaggataactcctgctattggattcagcaatggatgaaagtcagttttatatcagtcttctcacactgaattgccctctcttcaatattagtttaaaacattcattagtgaatctggctgcaaaataagtccataataacaacttagtctttctgcttctatatttatttaattttgccttttaccagatgagtttttcttcatctgctatgtagtttttcattagagagaaaacatgtttgactcaggacaaatttttgtgacacagatttttccagatttctcctaatttcaaacttctcttgcttgctattttattttatttaagacagagtcttgctctgtcactcagcctggagtgtagggcgcgatctcagctcactgcaatctctgcctccagggttcaagcgattctcccgcctcagcctcccgagaagctgggattacaggcacgtgccaccacacctggctaattttctaaatcgttattattattattattattattatttttagacagggtctcactctgtcacccagactggagttcagtggcatgatcttggctcactgcaacctctgcctcccaggctgaagtgattctattgcctcagcctcccaagtagctggaattacagcctcccaagtagctgggattacaggcatgtgtcaccatgcctggctaatttttgtatttttagtagagacggggtttcaccaggttggtcaggctggtcttgaactcctgatctcaaatgatccacccgcctcagcctcccaaagtgctgggattacaggcgtgagccacggtgcccggccaaattttgtatttttagtagagagggggtttcaccctattggccaggctggtctcaaactcctgatcttaggtgatccgctggcctcagcctcccaaagtgctgggattacaggcatgggccaccatgccaggctgcttgctattttaattgggaggcaacattgccagtttgtctgcaaagtagaatcttcatgaaaggaaaacaaaggtttgatggacaggatttacttgtaggcagtttgtttatgtgctcaaaagcacccaaaagagagttgtggaaagaaatgcctattgtagggtagtcatatgaaattatatctgaatacacttttatctgtgcagtgaagtatttcagaaaacagaaacacctttgtatcttcaaataagtaggttgaatggcatcagttctaatgggtcatttgtaatgattatcatccatttttctctttgcattttaaagtttttttcttcatttgttaagacaaactacacaaagagaaaagaaacagagatacgagagaggaaatatgggtgagagaaagaagcttgattagaggatttgaaaacataatgaaatagaggtctctaaattggattctgggctttgctcttgataacaaccatgtactcaatccctctgcagctgaaaaactgaaaacaggaagtgtttttgctttaggggaaagatttcatgtcaacattaagacatacagttggatgagctagaaataaccatgctctttgtaactagaagaattattagatattgggggttcctagtatgaaaatgcaattcccctgttgactctcctttccaggtttttaaagtttaagaaaacatgtcttgtgttattaacggttcagatgtaatcaagccagccaaagacaccagcacagcaggtagctactgtgatttcagggatagcacttaagtgaaaatattgcattttactgaaatgcccacccttacaaccctttttcttctgttatcaaaatgtatatttaattaagcaagtaattcattagtaacatattactttaaagattcaaaccatatagtggtaactagttaatgaactaacttataaatcagtcattaatttgaccatatattatcgctaatcattatgacatgacaagaattggcaggaaagtctcaaatacaggggagggtagtgagtgcaattaagagtattaggtcctggccaggcatggtggctcatacctgtaatcccaacactttgggaggctgaggtgggtggattacttaaggccaggagttcgagaccagcctgtccaacatggtgaaaccccatctctactaaaaatacaaaaaattagctggatgtggttgtgcgtgcctgtaatcccagccactctggaggctgaagcaggagaattgcttgaacccgggaggcagaggttgcagtcagccgagatcacaccactgcactccagcctgggcaacagagcgagactctgtctcaaaaaaaaaaaaaaaaaaaaaaatatatatatatatatatatacacgcatatatatatacacacacatatacatgcatatatacacacgtgtatatatgtgtgtatatatatgtgtatatatatgtgtgtgtgtatatatatatatatatgcgtgtatatatatatatatgttggtggtccattggcaaagctaagaaaatggtagatcaactctgccttctgctcagcaaaagccaatcccttcacccatcacatccaggcttattagcagaggcctctgtgatcttatatataataagatgctggcccctacccacccatcctcaccctctctttttacatcaaagagatctctctaataaattgggtaataagcaggaaaagaaagagtatgagatgctgaaaagcaaacagacccaggtaaataaatactccattaaagctacctggacaactaacaaggtattgatgaagccactagctggctgaaagtttgtagaggtaagcaaagtttgctatagacttgggagtgttatcaaagacaaactgtatttccttagttttgtttaggaccagcccagaatgcaatctatcctgtgtggaatggatgggatgagagatggatgggcccagccttagaagcaagatctagacctataagtatagtcaacagaatggagagggaagaacccagacttcaggaacccaatgtagaggtgagttcttattcaaccactaaccagctgtatgtccttgagcaagttcctgcactgctctgagcagcttcgttacgtgtcaggtataacaggagcacctacgttttaatgcgatggcttgcatgaagtaccacgcaccagtcaaggcacatggtagacactataactatgagtgttcctttctcagaaaacttatcagtcaagtctttggtaatataattttatcttaaatgcttctaaaatgttttctatttcaaggaaatagagctggctcccttaattgatgagaatttatttggcaaagagaaaatagcttgtttttataacattcaattactattttttttcttgaaatggctttacctctacagtatctactcatcgattaattaaaatagggtggtccattggcaaagctaagaagatggtagatcaactctgccatctgctcagcaaaagccaatcccttcacccatcacatccaggcttattagcagaggcctctatgatccttccctatcctggcctttccaatgaaaaacaaccagtgctgacattgagtgccccttaggggacactgacacgccaactgccaggtaaaggtaggaagggatgaggctggtgtaacgttctgtaaggctgcaggtttaaaaacaaaacaaaacaaactcaaaaacctctaagattgataataagaaaatgtttggctttattcttgaatcatagtaaaagctaatatttattgaatacgaagtacaggcataccttgttttattgcacttcactttattgggctgtgcggatattatgttttctacaagtagaaggtttgtggcaactttgggtcgagcaagtctattggtgccatttttccaacaacatgtgttcacttcatgtgtctgtgtcacattttggtaattctcataatatttcaagctttttcattattatcatagctgttatggtgatctgtgatcagatgttactattgtaattgttgttactattgtaattgttttagggtgccacaaactgtgcccatagaagacagtgaacttatggataaatgtgtgttttgacttctccgcctactggctgtttgttcccctgtctccctttctcttgcctcgggcctccttattctctaagacacaagaatattaaaattaggccaatttataattctacaatgacctctaagtgttcagtgaaaggaagagtcccaggttttctcactttaagtcaaatgctagaaatgattaagcttagtgaagaaggcatgttgaaagccaagagaggctaaaagctaagcgtcttattccaaacagttagccaagttgtgaacgccaaggaaaagttactgaaggaaattaaaagtgctactccagtgaatacacaaatgataagaaaacaaaacagccttattgctgatgtggagaaagtttgagtgttctggatacataaacagccacagcgttcctttaagccaaaacctaatccagagcaaggccctaatattctctcattctatgaaggctgagagaggtgagggaacctgccgaagaaaagttggaagctagcagaggttgcttcatgaggtttaaggaaagaagccatctccattaaaaaaaaggtgcaagatgaagcagcaagtgctgatgtagaagctgcagcaagatcattgatgaaggtggctactccaaacaactgattttcaatgtagacaaaaaagccttctattggaaggagatgccatctaggacttttatcgctaaagagaagtcaatacctggtttcaaagcttcaaaggacagaatgactcgttaggggctaatgcagctggtaactttaagaagccaagctcatgtaccattctgaaaatcctagggcccttaagaagtatgctgagtctactctgtctgggctctaaaggaacaacaaagcctggatgatagcacatctgtttacagcatggtttactggatatttgaacctgactgttgagacttactgctgagaaaaataatctttcaaaatattactgctcattgacaatgcacctggtcatccaagagctctgagggaaatgtacaaaaagattaatgttgttttcatgcctgctaacataacatccattctgcagcccatggacaatctcacaataaaactttaagggatgaggagttacttcttttgaatgagcaaagaaagcggtttcttgagatggaatctactgctagtgaagatgctatgaatattgttgaaataacaacaaatttagaatggtacataaacttagatggtacataaacttagttgataaagcagcagcagagtttgataaaattaactctaatttggaggaagttctactataggtaaaatgctatcaaacagcattgcatgctacagagaaatgctttgtaaaaagaagagtcaattaatgtggcaaactccattgatgtcttattttaggaaattgccacagctgttccagctttcagtaaccactgcccttatcagtcaacagcccatcaacatcaaacactcaccaccagcaaaaagattatgactcgctgaaggatgggatgacctttagcattttttagcaataaagtatttttcttttctttctttttcttgtctcttcttttcttttcctttttttcgagatggggtctttctctgttgcccaggctggagtgtagtgtgcaatcacagctcactgcaaccttgacctccccaggctcaggtggtcctgccacctcaagcaatctgtctcagcctcccaaagggctacgtttataggtatgagccactgtgcccggccaacaataaagtttttttctttgacagagtttcgctttgtctccaggctggagtgcagtggtgtgttctcggctcattgcaacctccgcctcctgggttcaagcaattctcctgcctcagcctcccgagtagctgggattacaggcacgtgccaccgcacccagctagtttttgtatttttagtagagacggtgtttcaccatgttggccaggatggtcttgatctcctgacctcatgatccgcctgtctcagcctcccaaagtgctgggattacaggcgtgagacaccgtgcccaaccaatacagtattttaaattaaggtatgtacattgttttagacataatgctattgcacacttagtatactacattatactgtaaacatcacttctatatgtactaggaaaccaaaaaattggtatgactcaccttattgcaatatccacctttttatgatggtctggaaccaaaactgtaatatcttcaaggtatgcctgtatattctttgcactgttctacagacttcctatgcgttgaagcattgaaacctatcttcactttgcagatagggaaactgaagcatggagaagtaaatcacacagttagaaagcagtggggccggccgggcgcggtggctcacgcctgtaatgccagcactttgggaggccgaggcgggcggatcacgaggtcaggagatcgagaccatcctggctaacacggtgaaaccccgtctctactaaaaatacaaaaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaagaaagcagtggggccaggattcagacttcagtgatctgacatcaaagcttgctggctttattgctgcactactctgctagagactgtggctggaatagagtgtgaagcaccgctctcagggagggtttccaccagcatggcagtgacactgaaagcattctggtccttatttctttgtcgaaacacaccattcaaagttattttagagtatttgtctgaagattttgtaacaaatcaattccatttccaactctcagaatggcctaatgggacagctcattgaatatttggtcaacttggcgatgccatagaacgaagacatttagtcaaactcatctggatgttgctgtgaagacaattttcagatgagattaacatttaaatcagtagattttgagtaaagcaaattacttccgtaagttgggtgggcctcaaccaatcagctgaaggccttatatggaaaaagacggagtttccccaagggaaggagaacatctgattggttctgtttctctggagaaccttcctaatgtgccaaatactattaatttttgcgggaagggctccgaaaaatttttccttgtactcagctataatgtgttataagcaaagctgttgcaaaatctttgtttaccaatgaatggtctgaggtcatcatgtcctttttttctttctctgcacagtcctgcatgaccccttgttcactatcaaactgacttccacatacaggagcacgaaaggcacaggaatggatgccaatagactcattagcacctcctcaatatcacctcagtccacttaactgagaaacagctgttgaagatggcgagatccaaaataaaacccagttctcaaccaaataaaatatctctaaaaagaggagaaaatggttgtgagatgtcatttcccatttttaggagaaactataaaaggaacagccaacagttacacagaaatttaagattgtgcctacgttaattccaagcaatagtctttctatttataacccatgctaattaaatgttatcacttaccattcattattaacagaggttttctggctattgtcaaatctcaggtgaaagccttttagcttctttcattccttctcaatgaaaccaatttggcagtctctttcaaagcaatgtcttcaattggaaagtactacctcatacatgaatgaacaacgtgtctcctcttgtcattgataagatgaacttagaatgagcttgaaatgctatggtgatggtgctctattctggactgcagaaaaatctggaatgccgctgtgtaacaagagcagaacattatgggggaagaaaacccagaagactaatttttaaaatagctaaatttaagaaatgaacaaaagcatcttaaaatataaagctcaatagatctcaagagtagactggacgtagctaatgagaaaatgagttctggaagaaaagttggaagatatggaggatagaatgacgtgcaccagcatgcatctgagtgggccagtggtttaggatattaggcattttgtttctcctcactataaagataggtattctcagatactttgcaggttttaaaaatagttctcttgaaaattactaccttaaaagtgacattcataaagatactctgaagaactgatcacttttattggatgaatgcagatgaacaaaattattaattcaaggtaaccccttataggcatgacctatctgctaatttctcttgcaatcattttgttttgtttcttattcttacataatctcataaagcacctcaattcctcatttcacttcttcatgtattgaatgcctttctatttaataaataatatgatctagctgggtacagtggctcacacctgtaatcccagtgctttgggaggccaaagcaggaggatcacttgagcctaggagtttgagatcagcctggactgggagatgggagaccccatctctacaaaaatttaaaatttagccagcatggtggtgtgcacctgtggtcccagttactctggaggctgaggtaggaggattgcttgagcccaggaggttgaggctgtagtgggctgtgattgtgccactgcactccagcctggatgacagagtgagaccctgtctcaaaaaaaattatatgagctaacatgtattcagtgtttattattatactaagcactataaaacggtttacatttattatctcatttaatcttacaacaatcaaaagtggaaggtagtgttattttcttcattttacaatgaaggaatggagaacgaaataggttaagatacttgcccaaggtcatacagctactcattcataaaggaaaacaattcacatttgtttgtcaaggttaacccattgcaggagtgactcatctcattcctaattataagccactcttttatatgacctattttatactccttcctctcctcttccattacaactcatcctattccaccctcccttctccaaataagaaatgttcatagtctgggaaaaaaatatctagaaaagtcaatggctttgcttttattattttattttattttattttattttattttattttattttagacagagtctcgctctgtcgcccaggctggagtgcagtggcgtgatcttggctcactgcaagctccgcctcctggattcacaccattctcctgcctcagcctcgtgagtagctgggactacaggcgaccgccaccatgcccggctaattttttgtatttttttaaagtagagacggggtttcactgtgttagccaggatggtctcgatctcctgacctcatgatccgcctgcctcagcctcccaaagtattattttctttttagtagaagtatctggataatttccctcatttttcatttcgttatgattatagagacctggctaatggtatttcacatgtctactaggacttaaggaaaatccttcagacttggtgttctaggatatcaagacactttctttttttgagatggagtttcactctttttgcccaggctggagtgccgtggtgcaatctcagctcactgcaacctctgcctcccagattcaagtgattctcatgcctcagccccccaggtagctgggattacaggggtgtgccccatgcccagctaattttgtatttttagtagagatggggtttcaccatgtttgccaggctggccttgaactcctgacctcaggtgatccatccccctcggcctcccaaagtgctggaattacaggcatgagccaccgcgcctggcctcaagacaatttcataatgatccttaggtcaaggtttagatgagaaattcattgctatggtgtacagaggcaacaacatcctcctacatcctggctagagcagcaaagcttgctactgtttggcaaagtttctaggtggtatttttagaacaatatcctcctctgtttggtgctgctggaatatggctcttgattcacagatgggtgtctctggggtgactggggagctaaattttcaagtcttcccctcactggataaacagtgactctttccaatttttgttaaaatctttttttctttttttttttatttattttttatttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggagtggtgatgactcttaacgagcatgctgccttcaagcatctgtttaacaaagcacatcttgcaccgcccttaatccatttaaccctgagtggacacagcacatctttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggaccgggcggctggccgggcagggggctgaccccctacctccctcccggacaaggcgtctcgcctggcgggggggctgtcccccccacctccctcccggacggggcggctggccgggcggggggctgacccccccacctccctcccggacggggcggctggccgggcgggggggctgaccccccacctccctcccggacggggcggctggccgggcagaggggctcctcacttcccagtaggggcggccgggcagaggcgcccctcacctcccgaacagggcggctggctgggcggggggctgaccccccccacctccctcccagacggggcggctcgccgggcggggggctgacccccccacctccctcccggacggggcggcttgcctggcggggggctgacccccccacccccctcccggatggggcggctggccgggcggggggctgacccccccacctccctcccggacggggcggctggccgggtggggtgctgactcccccacctccctcccggacggggcggctggccgggcagaggggctcctcacttcccagtaggggcggctgggcagaggcgcccctcacctcccggacggggtggctggccgggtggggggctgaccccccacctccctcccggacggggcggctggcctggcgggggctgacccccacctcccttccggacggggtggctgccgggcggagacgctcctcacttctcagatggggcagttgccaggtggagggtctcctcacttctcagacggggcggccgggcagagacgctcctcacctcccagacggggtcgcggccgggccgaggcgctcctcacatcccagacggggcggcggggcagaggcgctccccacatctcagacgatgggcggccgggcagagatgctcctcacttcctagatgggatggcggccgggcagagacgctcctcactttccagactgggcagccaggcagaggggctcctcacatcccagacgatgcgcggccaggcagagacgctcctcacttcccagacggggtagccgccgggcagaggctgcaatctcggcactttggggggccaaggcaggcggctgggaggtgggggttgtagccgagatcacgccactgcactccagcctgggcaccattgagcactgagttaacgagactccgtctgcaatcccggcacctcgggaggccgaggctggcggatcactcgcggttaggagctggagaccagcccggccaacacagcgaaaccccgtctccaccaaaaaaatacgaaaacccgtcaggcgtggcggcgcgcgcctgcaatcgcaggctctgggcaggctgaggcaggagaatcaggcagggaggttgcagtgagccgagatggcagcagcacagtccagcttcggctcggcatgagagggagaccgtggaaagagagggagagggagagggagaccgtggaaagagagggagagggagaggagggagagggagagggagagggagagggacttttgttaaaatcttaacaggccaccaaggctgatgaaaaaagcttcagaagagaaacttcttgtaggcacctacaggtggtgtgtcatttagtgggaagtatatatttggcaatgcttttcttttttctttttggaaacagagtcttgctctgtcacccaggctggggtgcagtggcacaatctcggctcactgcaaactctgcctcctgggctcaagtgattctcccacctcagcttcccaagtagctgggactacaggcatgtgccaccacacccagctaatttttgtatttttagtagagacagggtttcgctatgttgcccaggctggtctcgatctcctggactcaagtgatccacccgcctcagcctcccaaagtgctgggattacaagcatgagccaccatgcctggccatttttggcaatatttcttaaacctcagtgtggctacgaatcacctggggatcctgtgaaagctcagattctgattctgggtagggtccaagattcagtatttcttttcttttatttttattttcctgtgctaattcacctgcaaagcattagatatatattaattacactattgttgaaattctgaagctgtcaatccatgttagtgtgctagagtctttttcacatttctaaaatttttgtgggtacatagtaggtgtctatatttgtggggagagtctgcatttctgacaagctcctgggtgatgctgacactactggtctctcaaccacaaggatatacagacctgtatggaggaagaatattgcctttcagtggagctagccatggctggtttatttgtttttgcttttcttgaaggcttgtgctaaataataaaatctacctcactttctttccaccttgtcacttgtgtttggagcaacacaatggaaggagcaagctgtaacttgtgaacaggagacacattaatgaaataaagctccagagagagaactcaagctggcctgttgccgtgacgctgggctaatgacactgagctggaagagtgattcccctggagtccttatcaagtgacaccatcttaattacccagtgaaaagacagcccgtttccagcaaacaattacttcctgatcgatacccttgtcttgttaagtatgcttcctgaccatttatagccaaacatttgatgtacttttcctgagaagaaaaatcaccttcttagctatctctactcagcagaagcccctgcccacatcacacacaaaaccatctacatttagatattctgaatggttggaaactcctatttattatccttcggtgacttttatctttagatgaagaactgagaagagcacacaagttcctctcagcaacatgatttatgcttgaggctaaggcctcaacttggggaagggaagaaggttgtttcaagcctgtggcctcctgtcactccccacccctggaaggcccttcacttttgggtgtggcctagaggcctcatggacagcagtcccttctgacacccagtgagatatcatctgggagggctgcgcagccctcagttcccctcatggctctctctttcacttccctccatgacaccacctcatcgagttgaagatgttattgatgagtgcagtgggtgtatagtgtcctcccaaaattcatgtccacccagaaattcagaatgcaaccttatctggaaatagaatctttgcaaatgtgattagttaagatgaaatcatactgagttaggatgaacctgaaatccaatcactggtgtccttgtaagaggaaaggtcacaaagagacagaggagatacacagaggagcccatgtaatgatgggtacggagactgacgtggcacaactataagccaaggaatgccagggaaggccagctagcagaagctagggaaaaacacagagggattctcccctggagcctttggagggagtgtggccctgctgacaccttggttctggacttctggcccccagaactgtgagaaaataaatttcttttgcttgaagccacccagtttgtggtgctttgttgcggcagccctggaaaactaacacaatgagtaagggaaagtaaaggaattaaaaggtgtgcaggaaagaatttaaagctatgtgaaaatcatgactttccctctactgtctaaggaaaaagaaatccctaagaatgaatagggcctactcatttgctcaccttactcaaggctcaagtcacagctttctgtgggagcatctttttcaaacctccacagttgaaatctccatccagtaggggattttattcatttaggactcttgggaaatctcgctcaattccattagggattggtctcaccctagggctgctttcccttcccccacaatttgtgataatagtccccagctgtgtttttctctaattctgaattatccagcccagaatcacagtacaggggaagaacctccagcaggatgtccagaacaagcaatggcgacttaggtttattcagggtctcctaccctgtagttgtagatccgccctgtcattcttttgaaggtccagagggtaactctgggactataaacatgtgaatgtgcgtacacacacacacacacacacacagccctacatctctctaggacaaacatccactctcagatacaacacaatccagcggaggaataattagcaaagccaccctgtggacttaatggacttgtagtggacataggacatcatataacataactcttacattactactactatgcagatgtcgataatacaggattttcaccttcaaacaagaggacaaaaatctgatcgtctttggatattttgtggcattgaaaaaagggacaaaaaatccttttggccattctctgtttcttcaaatcatattttcattttctagcagttaaaaacaagagttctggccgggcgcggtggctcatgcctgtaattccagcactttgggaggctgagacgggcggatcacgaggtcaggagatcaagaccatcctggctagcacggtgaaaccccgtctctactaaaaaaaatacaaaaaattagccggcctggtggcgggcgcctgtaatcccagctacaaaggaggctgaggcaggagaatgttgtgaatccgggaggcggagcttgcagtgagccaagatcgcgccactgcactccagcctgggtgacagagcgagactccgtcccgcaaaaaaaataaataaataaaaaataaaaataaaaacaagagttctggcacgaagaataaagccagcaccaatttgggcaaatcataaagcaagaaaggaaaaaaaaagagatttgaatggaacaaaaagaaatggaaagaaaaagtggacatgttggaactgggccacagagactgcatctaaacagtaaaaagactgtttagttgctcactttttctttggaattctaacaccttagataagtgtccttgctttacaaaaaatgatacgacttctgccacaagacgggcttggggagaactccggccattggtgttaaggtggattgcctctcctagtttataatcaggagtgttttgtgttcgttgagctcaaaattcattcaaatacactttcaaagttttcagttgattaaagtggctcagaaaaaaaattcctgtttgtgtctttttgctgtgctactcttaaacacttaaaaggctttttttttttttttttagcataaatactgcaggtatttagcataaatacaacagatagctctgttggtcaaggtcgtccagaaaaacagacccagtgggacataggagatataatacatatttataaatttatatctctatatcagaagaagatgagatgtcctagctcaagcagtgaagcaggaaaaagggcgatttcctccttcttccacctttttttgctctttttttgagacagagtctctctctgttgcccaggctggagtgcagtggcacgatctcggctcactgcaacctctgcctcccattttcaaacaattctcctgcctcagcctcttgagtagctgggactacaggcacgcaccaccatgcctggctaattccacctttttttgttgttctattcaggccctcaatggattggatcatacctcaacattggggtccaggaccatctgttttattgagtccactgattcaaatactaatctcttttggaaacaccctcacagatgcacccagaaatatctggacacctcatggcctaatcaagttaacacataaaattaaccatcataataggtaagcaaaataaagaaaataaaagcttatagcagcatcaatgcaaaaataactcatatttttactaatattactaacattcttccagaatttttcttttcttttcttttcttttttgagacggagtctcactctgtcacccaggctgaagtgcaatggcacaatctcggctcactgcaacctctgcctcccaggttcaaacaattctcctgcctcagcctcctgagtagctgggattacaggggcctgccaccatgcctggctaagttttgtatatttagtagagatggggttttactatgttggttaggctggtcttgaactcctgacgtcatgattcgcccgcctcggcctcccaaagtgctgggattacaggtgtgagccatcacacccggtcggatttttctgtatttataaatatcattaatatgttatttttaagatggaattatattttttgttttataatctgcttctctccctaaactatattgtgtgaatatctttcccttgtttacaaatgtgcctctatatttatttagtcaatcctgtggtgcgtttttactgtgtcaacttggctggaactatattccctagaatttccttcccttggtggctcttggttacagttggagaaatgtatgagtggaaattgatggaaggtagaaatgcagctgcagccgttttgttgatagtagagtgtgatgcagggctagtggcttttgcagctcatgcacattgttgctaatctgctagttccctctgtagatatgtacagctctgcagggaagggcacgagcttatcctgcaggttattgacatcattaaggttggcagtctgttctagaacccgtagaactagttacatcccgagttccacattctcctcccaggtttcagtttgtccttgcttcatattcaccgttcattcccaagtgctgggtctgctgatttcaagcccaacaccagaagcagaagctgccttcttacatagatggcttaaccacctcccacatctgcatatctatccctatgtgtcactcactcatggtagttctgcttctccttttgaatagtgtaaccaatctagaatttggtgccataagtggggtattctggttatctattactatgtagtaaaacatctcaacatatactggcttaaaacagcagtcatcattttattaactctcatggttactatgagttgggtatttgagaagcactcagtagggtgattccactaatggttccctcaggtcccttctagtttcctccaccacctagtcctaaagccaatgccatttgctttaggcttctcttatggcagcaccttacttaaggcaccaaattctcttctgataatcaattaccggcctaaaaaccaccctaaagcaacaataattattttattatctctcacagtttctgtgtatgatttggaaaggattcaactggcaggttttggctcagtgtcttcccatggttgtagtctgatggtggctggggctgggatggcaggagtatggagcagctgaagctgaccaggcatctctttctctctctctctctctctctctttttttttttttttttttttttttgagacagaatcttactctgttgcccaggctggagtgcagtggtgcaatcttggctcactgcaacctttgcctctcaggttcaagcgattctcatgcctcagcctcctgagtagctgggactacaggcgcccgccaccacaactggctaatttttgtatttttagtagagagagggtttcaccatgttggccaggctggtctcgaactcctggcctcaagtgatccaccagcctcggcttcccaaagtgctctgattacaggcatgagccaccgcacctggcctgggcatccttctctttacatatagtcccaaggcctctccatgtggtttttccacatgggctacctcagagcctggcagcgtcagggcagtgaggccctttatatggtggctgaaggctttcacagtgtgaatcccagtgaataagacagcacgtttagtgacttagagtttttttgtttcaagaataggatattctcttccttctctaaggatattgatgcctttttttcccctttcttgttttcatctccttccatagtttctttcttccaattttttggtttatgctctatcttttatgagtcttatccttttagtttgcatctatttcattagtaataaagttaaatctttaaaagctgattagtcacacgcattttttttcctttttgatctaccagttcatttcttttgcccatttttctattgtgtttgtctattccttgaaggtttcaaagaactctttatatgttaatgatagtaaatgtttgccatatatatgacagatattattttcccatatagttttcatattttccgaactaaaaattatgataaatgctatgtaaaaggatgtttatctggtttacctatgtatgtagatcggggtgtccaatcctttggtttccctgggccacaatggaagaagaaaaattgtcttggaccacacataaaatacactaaactgacaatagctgatgagctaaaaaaaaaattgcaaaaaaactcataatgttttaagaaaatttatgaatttgtgctggatctcattcaaaccagtcctgggccacatggcccatgggccgctggttggacaagcttgatgtagataaaaagatttacaaaaactcataaaaacaaattgtacttagttataatctaacaatatacctttaaataaagtgataaaaaatatcctgaaataagaacaattcttgaacatccatacttaggagatagtgtttctcagtcctagctgcacattagaatcacttagagaactttcaaagtactgacgcctggcacctgccctcaccaaagcttggtgtgggattctaatgtgcagccagggatgcaaacctctgctgtatgtaattgatcctattgatcaaagtaggcttcctggcttggcgtagtggctcatgcttataatctcagcactttgggaggccgaggtgggcagatcacttgagcttaggagttcgagaccagcctgggtaatatagtgagaccttgtctctacaaaaaaatacaaaaattagccagatgtggtggcacgtgcctgtagtctcagctactcaggaggctgagatgggaggatcacttgagcttgggaggtggaggttgcagtgagccgagatagcgccactgcattccagcctgagtgacagagtgaaaccctgtctcaaaacaaaaacaaaaacaaaaacaaaaaaaagcagccttcctatgggcaaagattttctcctggagaacttggagcagagcactgcctgtgagtcttctacttcctgggctctgagccagccttttttttttttttttttttgagatggagtcttgctctgtcgccaggctgaagtgcagtggcatgatctcggctcatggcaacctccgcctcctgggtttaagcgattctcctgcctcagcctcccaaatagctgggactacaggcgcgtgccaccacgcccagccaatttttgtttttttagtagagatggggttttgccatgttggtcaggatgatctctatctcttgacctcatgatccacccgtcttggactcccaaagtgctgggattacaggtgtgagccaccacacctggcctaagccagcctttttattgagaggtcacagaaagtccatttgctcatgtgtctccacttcctcttcctctgccacctactgacatttccaatattattgtccgtccttaagggctcttttcttctgaagaaggatattttcatttagttaagacatcatgttacctggaaggttaacacaatgtttacctcattttttgctgctcaaaatggagttctggagcagcagaccctcagacccaaccctagactgagtcagaatccacatttaagtcaaattttcagatgattcatatgcacactaaagctaaagaaagacaagtctataggaagttgtcctccaggaggcaagctataggaggcagggaccctgtctatcttattcacggttgtgctgtcataggaaagatttacagtaatatagagtgaatgaatggatgtgattagtaaagaaaattaagcgttttatttaatatgagtcatataatatgggtcaacaaggctttcgttggatgtcactacgataggcagagtcagatcctgtatataatgtactcaacatagcataatatttgtatccactgtattagtatgatttagtttgcttggcacacatgctgtgctctaataggtatagtgagtaattctatttgcattaacgctttataaaggacgttcatgcatcttactttatgtactctctacagtgtgcatagacttaactctgtgaatcaggtgaatatgggtatcttcacctaattacacaggaaaacacaggattaagagatttgtggagggttgggcgtggtggctcacacctgtaatccgagcactttgggaggccgaggtgggcagatcacgaggtcaggagttcgagaccatcctggccaacatggtgaaactccttctctactaaaaatacaaaaattagctgggtgtggtggcacatgcctgtaatcccagctactcgggaggctgaggcaggagaattgcttgaacccaggaggcagaggttacagtgagctgagatcacgccactgcattccaacctggcgatagagcgagactctgtctcaaaaaaaaaaaaaaaaaaaagattcgtggaaagattaatagtgagttaatgccacactagaatttgcactcaaaatgcctgagttgctatactactctctagctacctaccactgaaggcttccatttagaactccacattgtatattgtatgtataaactagcagtgtatatataaactagttcaacagcattgtatatataaactagttcaaactactatagaatgcacatgaaaaagtcataataataggtaataaaatgttttcatttcaagatacatttttctagttttatatatagttttttccatagttctgtgtaactaaatttatttatttatttatttatttatagagatggggggtcttgctatgttgcccagtacagttttgaactcctggcctcaagctatcctgcctcctcagcctccacaatagctgaggtttcaagcatgagatactgtgcctggtctgagtaaccaattaatgcctacaataaaactcctgaatgaatattggaactacaggtatgtaaagatttttaaaaaataaattttaaaataaagtcttattggatattcctcagacagctaacatgaaaatgctcttccttttggaactttatatccttgtgagctggagaagagaacacactttattttatggaactgtcactttattttttgaatcagaaagtaaaccttcatttcttttagatgacactcagaataatctccacatcatgtaattttcttctcagttcaccagaggatatttgtggcagtgaacctcaaagatggatgtttaagataatgttatgacgttagaagcaaagtagataagagacatttggaaggaattcatgccaatccaatacccttttataaattattctttcctcacctatttttatgtaggaatgtcattagacggattcagctacctgttcagtagactttcttgtttaaacccaagagtgaggactgtttcttagtcatcttcatatccctcagacctttgtatgtgacactgtcttgcattcaatatcagttcaaatatttgtttagttaaattactcaactgcattgtgagactccatatttacattccctagatgaatccccccaaaactctaaagtaataacaataaacactaaactgaattctaaaactatcctaaaatagattagaatgagtgttttcaaaatgtaatttaacttctacaaagcctgcccttagcgcgagcaccacacatggcatcccaggaggcttttctccccagcgccttctccatccctccactctgggtcaaagtagaaggacaataaaattggttaagactagcagatcatgcaccaaagatctgaatatgttttattctagaaataagtgacaaatgtaagcaaagttttacctgaagagacctgaagagaataaaacaatagcttccatatattgagaacttatggctgagcgcggtggctcacacctgtaatcccagcactttgggaggccgaggcaggcagatcatgaagtcaggagttcaagaccagcctggccaacatggcaaaaccccgtctctactaaaaatacaaaaattagccgggcatggtggtgggtgcctgtaatcccagctactcgggaggctgaggcaggagaatcgcttgaacctgggaggcagaggctgcagtgagccaagatcacaccattgcactccagcctgggtgacaagagcaagactccatctcaagaaaaaaaaagaaaagagaacttgttagactttgatcaataggatcgattatatacagcaggggtttgcatctttggttgcacattagaatcctcagacacacaggtactgtactgagttctttgcaaataacaagccccactgttattgtttcccatttacaggtaaggacatatggggaaaccaagacatacagcaagtgaataacacagctagtgagtggcagagctgggctttcaactcaggctctgggtcccacgtcattgctgtctatgctatgctgcctctccaaagggattgttaaacttttctttttcttgtaagtgaattaaaaccttttccatctctttccattcccacttagaactaatttgttctgcattccattcataaacctcactggataaacttattcatcatccaaattcatatgaaaaatcccactctaaacttattcataaacccatcatcaaaaatcccactctaaaatgagcatgggaagcaaagattttaagagattccagtgccaatcaactttcctgaataacacattttgtttagctggaaagccaaaggagcgatgctaatgtaactatgatattagtatgatattagtgggccatgatgcgtctgaataagcgagatagtccatggatgcccaggcagatggtttctttctggaactcaacatctttgtctttatgtcaagaattttgaactgcatgatggctaaggttccttccatgtctgtgttactgatctcagcttcactatttcccagggatgtgggtgggcacctgacacccagggttccattatattctgggagacacttgaagcaaatgtgaaggacaaaagtgccaataaagtgaaacaagtatatgtagtgacaaagcaatattcagtttatgaaaaataatgcaaaggaatttcatgaaacccaaacaaatgtaggcatttgttgattctcctcagtatagcaaatgaaacaggtgtcaacgtggagggcagaatccattgttgtttgtcaattacctcttcttctactcttgaccagggtgtcatcttttttacacagtaaatgcctatagggcacctgctatgtggcaggcactggggattatgtaataaaactgacatccttgtcctcatggagtttatattcattttggatggagccacactttgtccttttttttttcagatgcttatttatatttttagtgctcttactgggtaaaatgtatcaagttgtgtaaaattagacaggaataaaggtattacaccaaaaacatcttaaattccctgcctattgaatggcagtggagaaacccaggaagggatgagagtttgaagtgcagctttgaggtatcccccatgtgaacttgtgcaatggtacagctccatgtttaacttgatagtttttatctcctagaacaaattagcctggaaaagtggcttttgaaaaatggtctaacccaccaataccattactaggtatatagccaaaagaaaataaatcattctaccaaaaagacacatgtacgtgtatgttcatcacagcactgttcacaatagtgaagacatggaatcaacctaggtgcccatcaagggtggattagataaggaaaatgtggtacatatacactgtggaatactacgcagccataaaaaagaataaaatcctgctttttgcagcaaacgtggatgcagttagaggccattatcctaagtcaattaacacaggaacagaaaaccaaataccacatgttctcacttataagtgggagctaaacaatgggtactcatggacataaagatagcaacgatagatactggggactacaagaggagggagggaaggagaggggaagggttggaaatctaactactgtgtaccatgctcaatacctgggtgatggaatcactcgtaccccagacctcagcattatacaatatacccaggtaacaaacctgcacatgtatcccctgaaactaaaataaaagttgaaactattaaaaaaaaaaggactgagatatttataagcccagaatgaaaagcaaaacaccaactcactcagcaagtggaggcagaggttcctcttggtatttctccttcaaaagcaactgtataacagttgtctcctccatcttcccacccccaggaattccccagaatcattgcatccctgccctgtgctgtcttcccattatgacgtttctttctgctatcgaagagagctgactgcaccagattatgcagagaataaataggcccccagacttccctggagtggtccacggggcaatgctattcagaaacactggctgattgtaacaattgtggcctcttctcctacaacagtgatgctcttagctgctcatgtttctcaagacaacaatgttgactttggaacctgtgatctctctggtcacatactacactacagaccagccacctgaacttggaagcacagctgaactggaagaaaactgctggagactttgcttatttcatagtatatataatgaataggaaatataaagatattctttaagttaaattagttttgtcctctattttcctgaatatactatcttctgagcttctggactgggctgcctttcagtctccattagcttgtggttgctttcctagagaagctgggagccctttgggctttgccagggcaggagcttctcagagtgctttcagaatgtggtgcttacccagtgctaagatctagaatatattcacccagcacacttccactttcctgtccccacagcctaaggcaggggatgagggagtttggaatggaaggttgggcctcgggaagttctcttcttcttagcaagtaaggagtgatgcaaccactcaatcgtctacagggtatgactcaatggaggaaattgtaactcttccctccagatgcttctcaccccaggcccttagagctgcctgctattactcagggtgataagcagcaccatgttcccaaattccaccaggtttcaaacattcaatgatctacagtttcttattatgaatactgttgaattaagatctctgagatacagaacactacataacacggttgcgggttagaggtgccgaacatgtcctgaagaggctgctatttaattatttgttttcttttttttttttttttttgagagggagtctcactctgtcactggagtgcagtggcatgatcttggctcactgcaacctccgcctcccgggttcaagccattctcctgccttagcctcccaagtggctgggattacaggtgcctgccaccatgcccagctgatttttgtatttttagtagagatgggatttcaccacgttggccaggctggtctcgaactcctgacctcaggtgatccacccacctctgcctcccaaagagctgggattacaggcgtgagccaccgtgcccggccaaggctgctgtttaataggtaatttgaaagaatctcgtttgagctgtaaggcaagcctggatgtttgtttacaagaaaaataaacattggtgtgtttggagcgtaaggcaagtgtgtttttctaacattgtgcatctggtaataggaatcgcttaagccagttttccaaacatccctagttatggattcacctgggttagttgttattgatctggattcccaggccgctcctcagattccgactgagtaggtctgaggtgggacctgggagtatgcactttttacaggctccctgtctccctgccacccatctaagtgattgtcatcatcaggaaagtggacaaaaatgttgattgaaactagtggttctctaggccgggcatggtggctcacgcctgtaatctcagcactttgggaggtggatcacttgtggtcaggagtttgagaccaccctggccaacatggtgaaacccaacctctactaaaagtacaaaaattagccagggatggtggcgggcatctgtaatcccagctactggagaggccaatgcaggagaatcacttgaacctgggaggcggaggttgcagtgagccgagatcgtgccactgcattcaagcctggcgacagagtgagactccatctcagaaaaaaatgaatgaataataaataaataaataaataaacaaacaaactagtggttcccaaactatatcctgcatcagaatcacctggagagcttgttttaaaaacatacccccagagtttctgtttcggtagaccttggtgagacctgaaaatttgcatttctaacaagtacccaggtgatgttgatgctgctggaccagggaccccattttaagaagcactggtttaaacagccggatttccctggtggatcctttgcattggaagcacttttactgctccctttggcctgagggactgtttgtggtagggaggttcagaaatggtactatattctaaagatgcacttagcagcaatttctggacttcacagccctcttcccacagcttcttcctctgaagactgtgaaccaagtaaaacgtggcaggtagcttcctggagttgggcagaagcagatgcctagccatagtggtctgaggatttgctgcttgtgtatttcctccttcccactgacctctgtggggggtttgtctgtctgcctgttacaaatatcacattagtgtcgtttctcattgtcggtgttctcaagcatcttatctgcaattcaagaaagatgttttaataaaagagttagcttttaataagataatcctgacttactaaaaccactgtggcataatctcctttgcaatcacaacaatgaatacattttaaaattttaaatacttaaaaactcccattatattcagagacacttgccaatttgacaagtaatggtgctatatcattgttgtttgatgtggaaccctgactatgaaggaggtcaaggagattttcaggtactaactgactgtaattctgtaactgattatattctttgtccatttttctattaggttgttgatgtttttctcatcgacgagagctctttggtaagaaaattagcccttttatgtcatgtatgtgacaaatatttttctcaagttgtaatttgtcttttaactttatttagatatttatgccgtgtcaacattttatagttttaagtagcaaaatttattaagtatttttcttttatgatttagattttatattaatctgagaaagttcttccccaatccaatatttcattttaaaaagttttactcatgttttcttctagtacctttatggtttcatttttatatttaaatttttcattcatccagaattgattttcctgtaaggagtaagatatgacttcttttttttttttttttctttttttgggacactgtcttgctttgtcatccaggctgaagtgcagtggcacgaacacagctcactgcagccttgacatctggggctcaagcaatcctctcacctcagcctcccaagaagttggaaatacaggcatgtaccactgcaccccactaatttttgtattttttgtagagacaggtttcatcatgttgctcaggtgagtcctgaacttctgagcttgagtgatctgcccacttcagcctcccaaagtgctggaattataggcgtcagccaccacacccagcccaacttcttttcttctaaatgaccagccaattaacccaacaccatctatagtgtaaactatattttactcccatgaacttaaaataacatctttaacatgaatttatttctgggctatttctgcttaagtaccaaacttttaaaattcctctatctttataatacatttttaataataagaaatgcaaaggtattttaacaagatttagaccagcctggccaacatggtgaaaccccgtctctactaaaaatacaaaaattagccgggcgtggtggtgggtgcgtgtattcccagctactcaggaggctaaggcagtagaatcgcttgaaccctggaggcagaggctgtagggaggaagaggttacagtgagccgagatcacaccattgcactccagcctgggcaacagagcaagtttccgtcgcaaaaacaaaacaaaagatttagttgatcacaaagtggaggggattggggaagacactggaggcaaggtaataagtgagaaggcagttgagtcacccaggcatggcaggataaatgcttaggggaaaaaaggacctaccttcagcagaattcagtgatctgttggagactagggtcaagaagaacaaaggatgggccagattcaaagattatcagagaaaaggaactaagcctttatctctattgcactaaactgaactgaatcagtccaaagatacaggtttcggtactgggagaaagatgctatcatcaaacagtcatagctttgtatatcttcacttaggaattttgccaaatttcagatcaagtcatatttattggatttggctagtacaacttcttggaaattacacacactttaagcatttatattcctggtgaacaattagttttaatatacttattgggctgagttaatatgaagtacttacagttaattcaaagatcagctttgtggggtgagattcatgtgattattcagccatactgcctgaggagcatactctgatacttgtggagggcatatcctgataaagcagcgatttgaagtattgtgggttgcctactatttatagaacactagatatgaggaggcagatatgaagccttgactcttgtggtcagcctgactggacaataacacagacagcatcactctgttggtcttgactacttaattacacatatctagaaaagtttattttgaacaattgcaaataatgtttacaatacaacaactctttttctctttttttagactaaaaaatcatttagaaaaataacacacatataaacatactctctctgtatataagttaaatggtataaaccattataaagaaaaagtgtagggtccatactctccctgcctgagtcagttctttctctccagagatcaatgcacacacgttcacttgtatagcttttttattttacaaaaacacaatcatactctacatattctacaacttgcttttttcactctctctctatatacatagatattttgtaatttttgtagagacagggtctcactacattgcccagactggtctggaactcctgggctcaagccatcctccctcctcagcctcccaaagtgctgggattacaggcatgagccaccgcacctggcctcaatctatattgctgatgacttaaatatctgtgaaagtcttctgaggcattaatattacctgccagaaataaactgataataagtgaagttccttatattgttccacagcaaattggtaaagcctgtgattagtagttattgaatggataactacttaaaaattcatataatgtaaaaaacatccccaaattttttgaatctatgctaatgtagtcatagacttttaagaaaagcagcaatttaaagtattgtattgttactttaatcaagcatcattcagtgttttataacagaaacatggtgcaaagatacaagcacacatacatgtaaatatacacacatatatacatataaatatcacatacaaagatacaaatacacacacatatacatatacatgcatatgcatcacacatacacacacacacacacacacacacacacaagcatctgcatcctgtctggcataactttgcccttttctgctctgttcacatctttttggctaccgtacctttagcttgaattctagcttttctgttggtgaagatgaaatgaagtaacctgaatcctgagtcagtagggccaaatttgataggatgattggctccagtacgggctcctgatgaacagggctgcctgggtcttgggcagacccctgtatttgaggtcacacagatatttcccgaaccatgtgccccaaccaaggaagactgctctatgagttaactgaaagtggacaattagggagcctcatttcccaaagttattaacctctcccttctctctctttttcactggaaacactttccaaggaagcttataatagggtttagctttctggaaaatgaaacttttttaaacctttctttcatggaaacccaaactttctcaatgacttttacaaaaggttgtttttagagttgcactggctacacagaaaaactattattttaatgtgctacttattctcaagtatgtgtgttttgtgcataaaattgacttatatactagcatattattcatatcataatatgctagtatgtgagatttttaaaagctttttgtctttgcaaaaattttcactgcaagatcctttaaagcaatggcttttctactggtctaaagtaccagtttgctgatcattgcctacctgacaggagaggagagaaagaattaatataatgtccatcccttttcttcatcccctgtaagttaattagtttctaagtttcttgaatcttcttcccaaatttttctctaattcccattatggctttagtctgggttcttacacccaaacttagaattatagcaataacctgctaattgctctccttagagtagcttatcgctttcacttcaatccaacccgtgcattaatttcatacagatcatcttaaagcactgatatcattatatctctttcttgttcacactcaagggctgcccagtgtggatggcatttaatcccatcataacattcaaagccttttatcatctacctttcttatcaacttccgagttctctccatgatatcacttataaaaacattttgcaaatgaggtagtaggcagaataatgttctccctccaaaaaaagtccacatactaatccttgcaatgttaaatatggtaccttatgtggcaaaaagaatgtttcagatgtgattaaagttaagaaccttgggatgggaagagtctctggaattatcctggtaagcctcatgtaatcacatgagtccttaaaaacagagaagctctccaggttgtagagagaggagatgtgactctgaaagaaaggtcagagagatgcaacgttgctagctttgaagatgaagaaagaggccacaagcaaataaatggaaaaggcaaggaaataaattgtgccctagagtcttcagaaaggaacacagccctatcaacaccttgactgtagtccagtgagactcgtgttagacttctaacctacacaactgtaagagaatacctttgtgttgttttttattttttattttttaattaattaattatttatttgtttttattatacttcaagttttagggtacatgtgcacaacgtgcagtttgttacatatgtatacatgtgccatgttgttgtgctttgtgttgttttaagccattaaatttgtggtaattagttatagcagcaatagaaaactaacatatgggtaaatcactacatgtgtacatgcccagtgtttctatttgccaaacaatcctcccacctctaagccaggcccagtagtggttccagatatgttcccaggctggcctactgcccgaaatgccctcctcattccctttcacctacttaaatattctctgtcagtcaagtccagctgaagacctatttcttccagattactcccatcccttcctttgagggtattgtctgcactcaatcactgttttcctactttgtcaattgtttaaagtctgtatgtcttgcttccataattagatttcaggctattggaggaacagagaccacattttacatttttttgggtacttcgtaataattggaaaaattgcatacacacatatgatccaccctaaataagcagtttaatactagaacattttaaaatttaaaaatttaaaaatcaaattattgccattagaaaaagatcattgaactcattgatgaaattataatgcaactcagtgaggaaacaatcctattgtcaaataaccttccccaagaaaacatcactgcataaagaaagtcatttctgtgcatattttagtggcaaggtaagctgtaatagaaatgaatgagctatctccagttgcaaaagagttatatgttactacagataaacagcaaggtaacactttcttaccagctcgggaaagagatcagcctgcttgctaagcagaatggacaggtttattgtgagggcttgaaaagtaggataaaccctgaggggtgctgcactcacagtgcttagctactcctttgttcacacctttattacatttaattttattccttggaattggaaaattcaacctttgataagttgctacaattggcatcctactcggtattacatatcagaaaatgatttcagtccttatgttttgctgcaaaataggtatatatttagcactggaaaaatgatgaaaagcattcttgagcctcttaatcaaggaaagtaagatgaacaataatgtaagcatggagtgagacaaggatgagattattatttgatgttcttataatattcttaagattctgatacatccatctgctaatccctgtagctgcttatttgtaagagaacattcattatcaagatcctttggactttaatgattttggtaattattgattccatttgcatcctctttttaaccatgtgattgcactccaggacagaggaaaatttgcaacagggtctgaaattgagcagaaaacgtttatctctatatgaaaccgataagcaggagagagaatgcagagtgtgctgctaagtaacaactggtccattgctggatatctgcagtgtaatttggtgatgagatgcatgcctcctccacagtcatagccactgtctcccattttcactgcctctgtgtcttagtccattggacacctaaacagctcagcccagatggagtccccagaaagaaaaagtttcattttctgcttccctaaaatgggtgcccaggctctatttctcctaaattgtcttccacacattttttcagcttgtctgctggccttgcctggctgcttgcaatacgctgggaattctgctgggtatattggttccaatgacaagaaatgtatttcatccatcaaatgacaacatgtacatatactgcctgatgaacactcaataccagacatcagcacgaactcttgtttgtttcaatttgtttacactgaagactgttcaagagtctcagcttgtagttggtaattgatacaagtagaagatgggacttagctctggcatcagagacctttggcttggtttgggtgtggcactgaaggccgcctccaagtgcctcctaactggtgactgggtcaccttctcattctggtcctctgttttgtgattgtcagcatcttgtcaggagtcactgacttcttcctccttcttcccacagcaccttgtttgtgcttttcctacagcattttgcctttgggttaattttgattgtttagacgtgtgcctctatgataacaaaaattaagctccttgacagtagagaatctgttacttgtatttgaatctccctcaggacatagcaaagttctgtgcacctactagacagacaataaatatttgctgaggatttttgagtgaataatggcaactgaattgttaactttcagattcctatagtatcaactcatgggatcttcttttttaacattcatatggtttggctgtgtccccacccaaatctcatggtgaagtgtaacttccaaaattcccatgtgtcgtgggaggaacccagtggtaggtaattgaatcatggggaggtgattgaatcatggggcaggtaattgaatcatggggcaggtaattgaatcatggggaggtaattgaatcatggggcaggtaattgaatcatgggcagatctttctcgtgctgttcttgcaatagtgaatacatctcatgagatctgatggttttaaaaagaggagttcccctgcacaatcgctctctctttgcttgctgccatccacataagatgtgacttgcctgtaatcccagcactttgggaggccgaggcaggcagatcatgaggtcaagagatagagaccatcctggccaacatggtgaaacctcatctctactaaaaatacagaaattagctgggcgtggtggcacgtgcctataatcccagctactcaggaggctgaggcaggagaattgcttgaacccaggaggcggagtttgcagcaagccgactccagcctagcaacagagcaagactccatctcaaaaaaaaaaaaaaaagatgtgacttgcttctccttgccttctgccatgattgcgaggcctccccagctatgcggaactgcaagtccattaagcctctttttcttcccagtcttgggatctctttacagcagtgtgaaaatggactaatacacacatgcataacttcccaatatttgtctttacaaagccaatcgaggtcttgtttcttgacttctactatcttgttagcttgaggccactcatcaaaggaatgtacactatcctaagtggttatagcaacccctaatttcatcatgatgtggaagagttacctggtacctggttacatagaatctttactgtatccctaataaaattatatggaatataatttttaaaattctacttattcatcgactctaattctcttaataagtaatatatatctgagaatatactagaaacttaaatgatcaagcacattctaagacacctagtagttgagtagaatccattgtctatagaagtttcttggtatcttcaaactccaggtcaactgtaaagaaacacttatgaaactgccatcatcacagtgaataagaccaaaaatgaaggtaaacttgtaacacagaagtttattaattagaatgctcaaaaatattaatgagttcagactagcctttctttcctttttttctctttgaaaatgataatcagataatttgtgtagcattttacatagataaactaaaaaccaattctaaaagctatacctgtggtcattggctgatgaaaccaaactgctggttttcatcactgcaggctaaggtgaaggtgcaatgtgcccttatccacattgggccaccatcagttacaatcggtgtgcccttatccgcactgggccaccatcttcctacttgttacagaaaaacctgctctgtaaagacagttaagggtaaggaaatgagaaatatggcaaccacatgctgaggacatctcagtctcttcctgtccgttaatccagtcagagtacagtcgcactaaaatgtatcccaggcatcctggattatttatgcctatgataccaaattatcagaagttctataagaccatgtcacactaaaccaaataaaagaaatagccaagggtaaaagtaactgagaacatttggaaaatgaaatgaagtggataataaaactgtaaagattgtatttatgaatttaattctatagacatataatatgttaaagaaaaagtactagatctctgattactatgtgtttctgacattttatagaccttgagatcagatatgagtactcaatcgattcagcactgcgtatcgccactgcaattaagactaaatgaagtgaaaacgctttttaacaagtatgtcatacaaagtgctatgattcatctacttacaatggaattagaattctggaaatgtgtcgccagatttttttttgccattagagaggattaaattgtacaaaataagtgcattgtctgttatttatgactcagatctaaaatttttcttggtaaatgaataaaacctttatataaccattaatctgatctctggtatttcaatagtaaaaaggaaagtgttgacattttacaattcattgctgaaagaaacctataaaatggagtgccatcatctcattgtttcttgatacagaccggtcacaatttctatactaagttttaagtatgctgcagttttaactttcaagcaccatcgtataattgaatttatttacatacttttcagatcatattggaacctggacacatcccatatattttatttaaagattatgttgaataatataatctatgttgatgggaggttggctctgggttagaatcacactgtcacttactagctgagtgaccttaggcaggttacttaacctctcaccaagcctcaatttcctcatgggcaaaataatattggtgtcaaagcgttttcttttaactttttattttgaaataattgtagattcataagaagttgcaagaacagtatagtgaggtaccaggtatccaccacctagcttaccccaatggtgacatcttccataactacagttcactatcaaaaccaggaaattgattggcacaatgcaattaactagactcagttcatactcaaatttcaccagtttttgcacacactcttctttcgggagcaagggtagggttttacataattctatggcatttcatcccatgtatagattcatgtaactactattacaatcaagataaaaatatgtgtcttaaatacaattaagcattgaagtacttagcacaagaggttgcacatagaagaaactagtgaaatgttacctactagtattaattagattaaatcagatgatgttgcttattcaatgctttccaattatatgagttactttgttggttgacatagacagtattttagaagttagaaataaggctttttgtattaatcatgtttaattttttttttaaatttttttattttatgaagctttgtcatcttgggcccttgccgacctgaggagaaactgtccctcacagggcgcagctgattcctatagatggcaagcaacttgcctgtgagagcatacctttgatatgcaaaccaaccaatctgggcccataccccacccacctctttatatcaggcttctgcagcctgggacactatccccttctcctcagccaccccagacccaggtactggctaaccagagatcaccctgtagttcagagcccgccgagattcttcaatgtatccagtgcgtgcccagcctgctcagctgctcacccttcctcacccattccttccatggaaacacaatacaagcttttccctccttccttctctctcctgatcaactctggtgcttccctgtgtggctcgccccctattcttgggagctgtgaattttatttattctttttttttttttttaagacagggtctccctctgtcattcaggatggagtgcagtggcacgataatatctcactgtagtcttgaattcttgggctcatgtgatcctcctgcctcagcctttccagtacctggaactgcaggcaccactatgtccagctaaattttaattattattattattatttatgtagagatggtgtctcactagttgcccaggctggtctcaaagtcttaggctcaagtaatcatcccatctcagcctcccaagagctggatttacaagtgtgagccactgcaccccaccacaagctgtattttcaatggcaatagtcttctgatctatttgtctcatcctaactaaaccaaaacaaaatccctggtacattaaaaaatatccttcgagccccaattaactctattttggaaggatataaactagaacattcaaagtgagccaaatctgtctaacatggatgtgtgccttccctcagactgagaggtcccagtttagagcaaaaaattcaccaaagaaataggtgaaagaatttggcacatggtaagtacccaggaaatgttcagttcctgacttaccatctccctctttgaccttaactcacaaagcagatttccacagcatcagtgtctacatgagtaggagagaacctaattcttcttagcaagtgttcctcatgaaacaaaagagcttcatgcatggcccactgatgcctttgcttctgcaaagaagacttcacagtcaacctgttttccaggaaactcatgctggacctcttcctgtggcagtcctctgactcaagagactcaaggttcctggcctctgctatggggcaacccgcagtctgactcaccttgcagcctgcaccttcctgagcctcatccttatcatcctattagacttccactgcctgccaaccagtttgagacttcactacatggtgttgccagatctcactcctgctcttgagtgattccatcttggagcttggatcggtcctatcttatttcccttctgaatgacctctccatttcagctttgctttttatgctgataaccattcctattctgggttcatagatgggcttcagggggtcaatgaagcaatgggaaaggttgttgagtttttgaaaattcaacttactacgcaaatatgtagaatgatcattttatcctgcctttttgtgcgtctccaaatatattctttaccctggttgcccattggaattgcctgggcagcttttgaaatgtactaggccatatctccaaagtcctgcttcaataggtcaaggtgaaaccacacattggtcattttaaaagattctcaagtgaatcctgtaagcatttaaggtggagcttcattttcttggctgggtagtgggggcgggtgggtaacctcttagtcatgtcaaaaatctctgagagggatcaagctggaagaatgggaacatgtgcttttccacaaccctttggccacctccaggtcctcaaattatatgatcaaacctgagatatgcccattcaagtgagaatatttgacttcctataaattggtagaggcttgcgtgcagattcagtttagaattctggggcaggacaaatttgtaggtattgttatgggcctctgtcaagagacacataatatctggtttgcagatattgatgattgatatttaggtccattaatttattaggggctatgaaatgctgatattctaattccaccattccttctttacttatcacttgaaatctttctataaagagaaatttcccttcatctatcatttggtgagccaatggcatggttcatataggaagggaggataaattatacaagttacatgttttcaaatgaattggttcaccggtatcatctgctgtgattaattaaagctcctttgtctgctgttttgtaattattgtcttttgtctgtgatataatgctgtagctaacattattcaatttgacaagtgagcacaagatgcagacacagcttcacataccacttttctctacatcagtatgcgttaattcctgaattatccaatattacattcacattagccatcactgaaaatgacacctacaaggctgggcatgatggcttacacctgtaatcccagcacttttggaggctgaggtgggaggatcgcttgagcccaggagtttgagaccagattggacaatatagcaagactccatttctaaaaaaataaaaaataaaaaaataaagttagccaggcatggtggcattcacctgtggtcccaactactaggtgggctgatgtgggaagattgcttgagcccagaagtttgaggctgcagtgagccatgattgcaccactgcactccagtctgggcaacaaagtaagaccccatctctaaaaaaaaagaaaaaagagaatggcacctacaaagttaatgacacagaaagagtttaataagcatgtgcatacttaaaccccataaaaacttgaagatacttagcacgtctttgttctgtggtttttttttttttttaaataagggtcttcagaaggctatggattactatttaattatattttaatcttccagctattgtatcatcctagttagaactgctaaagagctaaggattaacctggtttttgaaagtcagggtgtaagccagcctacacgtctcccataaacacgcttggttcttcaagttcccagcaaaagcaacacagccataacacaggtgaggtacattgcttatcaatatatacagattaattgaagtaagaactgtgctgttaaagagaagtacccaaacacatgttcttataagtttatgcaaataaattctctaacaattttatattggaataaaatatatatggcaaaatatacaaacattcatattcccactgaatctctgtggctgtctagccacttggcagaagatcaaaactctgccagtttatgaagcagattctgcattaaattaaggtactgtcctgggcaatagggcaagtgcccatctgtagtaaaaatacaaaaattagccaggcacagtggtgcttccctatgatcccagctactcaggaggctgaggtggtaggattgcttgagcctgggaggtcaaggctgcagtgaaccgaattcacaccactgcaccccagcgtgggtgacacagcaagaccctgtctcaaaaaataataataataaaataaggtattgatgctctctgtacatttggacctaacaaagactctctccttgaccaaactttagtcaatctctcctgagccctcttctcaactaggcctcaacgtgcatagcccagttttcacaagaatcccacaaagtcaatttagagagaatcccccaccctcaatatttgatcgctgttgatgtcaatcaaattcctcataccctacccttgatatctcatcagcctttcctgccctcagcaagagccttgtttggccactctagcaagaatgccccgtctttgatttctcttcttagtaaatttccatccaccattactcccaacctgctccttggctgtaaatctccacttgttcttgtcgtattcagtgttgaacccagtctctctcccctattgcaatggtcttgacacttttacctattgcaatagttctgattaggatcctccttaccatgttaataagggtcagaatgattttttctctaacaaacctgggcccagcctactctatccagcactaatgtgcacctcccagaagtaagggagtcttcttaggatcctcttctttgattacctgagatagaaggtgtgggggaccaaattaaagagtacacccgtttctcccgacattctttcccattccttagatgaagaacaagaagacatcacattgctagatgcagtaaaatgggtacataggaaaacttcaccaaaggattaaaaataacataattacactatcacaataatcattccacttacacaataaagttaactcaagtggggattcttagtttcatgttaatttcctcccataatgccccaagatggggacatactcttcagataaatagtcctgctcctggagcaccctgagcattcctggagctccctgcgcattcctggcactggcatttatctcactacattcaagtcacctcttgtctgggctcctccagggtagggacacctggggtgatggtgggaaggtggggagttgctcctcatagttgaacacaggcctctaattccataatcatctgaagaacatcaggcccagaatgtggaccattagaagctccaggcaacattttggctcttcagatagacaataccgtgttagtccttaaacttgtgcctgaaaccttttgaaaatgtcaatgctttattgccaccttctggtcaattgtgttttgtgttacttcttcaagacgtcatttggtctcagtaaaaaggatctgagagaaatgaagtccctgtcagagcagaaatcccacttctccagtggtagccaacatggacagaatgttatatatcccttgagaaatttcccaaggatgtgaatgcatgtatatgtcacacaaatgaatactgttctgaatcttgtagggtataaaagacaggtcattatagcttacatttctacagagctttgtttttaaaaaacagtttacaaagcgctttcacatttggtcattataataacttgagaggcaagtaggatgtattaatagaatgatctgttggccatcctataaaaagacagggaactgtcaatgaactctaactttccttgcagatttgtgctcctattaatctttttaagctttctagaatggttctatatctactttttcattagcaagcccacttttgcacttaaaatgtaatttagtttacaagaataatgtacgcatcatattaaaccatctattgtgtagataaaactttaataatcaattaataacatgtatacattaatgcctcatgctgatgcataaacctgaatttatggttcatgatgatgacgatgatgagacagtaacatgtgaattaagagcactgcctctggaagcagactgtctgaatttgaatcccagctctgactctttctggctgtattatcttaagcaagttacttaatctctggacttcatttttgttctctgtgaaatggaggtgatgatgatgatgatggtgatgatgatgatgatacctatcccacaagactgttatgataattaaatgagttaatatcaatacagtgcttaaaacagtgcctagcacataaataattatttttgaaaagtaattaaaccagctcctggcatgtagcaaacactatttataaaacagaacaacaataattaatattcattgcaaacttgctatgtgctaggttctaaatttagagctttccactctattatttaatctccatctgacatatgaggaaacctgaaacacagagcgcttaagtaacttgcctaaagtcacacagctaatgtgggtaacagaactgagatttagttaacgtgtctctgtctagaagttgttactttactacataacacatgtctgtgttacaactaaagcatttcacccatttatcaagttaattctatactatttggaatcctctgtaaccctaatgagctacataagcatccaactttgtctttctcttctagggttttggtacacattcagatgaatcttaatttgttcatggctattttatatgcagacatattcaatgccaaatgaaatgccatgactatatttaataagtgtatgatgataataaagaagttgttaggcttacattctgtccttgctcatcaggagactgttccaagaaactaatctataactttggtaattaaatatttactcatcatgatctcagattgaatcctcatgaactaacacacggcgagaagtacatatcaataaacgatgggatcatgaccaggatcttccttgaaacagcaagaaggtaaatatgtagttgtggcattccaatgtttccttcgaatcattttaatttcctttcttatatttttaaatattttatattataagagaattgtcaataacttgctccacctcagggaaaaaagggaagggaggaaaggagaagactcctacagagttaaatgctttcacatttcttgattaattcagcaccctactccacccccaagtacaggtgggagatgcttcctcacacccactccactgagggtccaatctaggactccatcagtcctctccctctccttcggttcatgagtgtcttggggtattatgtgcattgggtagtgaagctggctccccagcttcactggggatgaagtgagtgttcctatgagtcagtgggggaggatgctggaggaatgaagtcctcgtgggcaccaagggaggatggttaccagagttccctggtgcaggcaggggtgacactcccatgaatgaaagtagagccaactgcagctgatggcccagctcccaagcagttcctgagcaccaatagccctcatggtggtcccttatcagatctgcccacccagttcttcctgggcaatgcgctctctctcttcttgaacaccttttcctaatgcccaacccagccccagaccctgtttcctctttactgtatcctcttgtttccttttggtcttggaaaaaattcttacttcctttagctcctaaccttctctagggtacttcttgcttttcctcaaactctagtcttttgttcttttctgataggctgatgttcatcagactcagaacccattcctttcctttcagacagaatctaagggaaaatgatactatattaattatatgacttataattgttatataacacacacatatgtatgtatacacacacacacacacacacacacacacacacacacacagtgagagagagagagagccttgctttgtcacccaggctggagtgcaatggggtgatcatggttcactgcagccttgacctcccaggctcggatgatcctcccaagtagctgggaccacaggagtgcagcaccatacctggcttatttttaaaattttttaaattattatttgtctccttatgttgcccaggctgatttcaaactcctgggctcaagtgatcctcctaccttggcctcccaaactgttgggattacaggcatgagccaccatgactggccaacatataattattgtcgtaatattttataatatttggacattatattgttaaattattataattgttataatattgttattattataacagtattgtataacacttgttataatattgtaacatgtcatcaccttataaactgttttaatatttattatattattataatattgttataatgttataaacattaaaatataaatttactttaaaatcatatacctagttattattatattaaaatggtttgaacattcctatctttctactctaacttgtgtgaatgtaactgctccagggagatcgtctgagtgtgggggaattgtggaaaggttctgagcacattttgtttacctagtaaggagagggtgtttattttgtcctgaaatagatatttcaggtatctattttgatcctctgaaagaaaatttgcattgctttttttttaacgtctagttagtataaccaaagaaattgttgcaagacttcacttactctattttctctaataatctgtagcatgtttgtcctttaaacataactcccatgacattcttagacttgtgcttctatagaataaattgcattcaatggatgatatagttctaatgctggtaatcttattttacaattgcactttttgtgatttcttaatttgtctgtctctcccactagactttaaatgacaaggacctaaacctattttcactcaaccttgtacccctccctcttagagccttgcaccaggcctagcacacagttggtgttccacaaatatttgttgaacaaataaacatttctctattttgccttcaaaccttcttgaagattttatctacactttagagataagcatgaacaagaatattggtagaaccatgttaaagatgtaagtttcctgtgccacaactctctaggtcttacccagatgacttaaggcttcatcccacatgacagtttcagtgattggttatagccacctggggcaattgtgttgagaaggattatggagccaagcctgggctcagagggaaagagccaagtacagaatggctatatccttgctgtgtatgtgctaatcacacctcacgttgacatgatcaccctgctgagagaagtgggaccaaggaataatcacacatatccagtgtttcacacaactttttttagctcataaactctgtgagttccacagtcctacaccacttcagacatctgtccataagtaactcgggtcttcctgtgcacttagtggtctttcaacttaattcagtagcatacgctcaacccttactatcatgggaatgtgttggtggtgctcaatacacagggattctgttcagtaatcattttaaaaataaattttatttctaggatagttttaagttaaaagcaaattttactactcattttgaaaagtctgactcaaatggtaatctgcaaatgtaaccaattgcaatttgcatcaacccatgtagtatatatatatgtgcatgcacatacacacacaaccagttaccctcttctttccactatcattacaacttcttctgtatatcacttcttggttaatatttgtcaaaggggaaggagaaaagcccaaaacttcaaaacacaccaggagcatttttatgtcatactggttgaaaaatattcacaaacatttctttcttttttttttttttttgagatggagtctaaccctgtcaccaggctgtagtgcagtggcgggatctcagctcaccgcaatctccgcctcccggattcaagtgcttctcctgcctcagcctcccgagtagctgggattacagacacgcaccactacgcccggctaatttttgtatttttagtagagacgtggtttcacaatgttggccaggatcgtctgatctcctgacctcgtgatctgcccgccttggcctcccaaagtgctgggataacaggagtgagccactgtgcccggcccttgtttgtttgtttgtttgtttgtttgtttttgagacggagtttcgctcttgttgcccaggctggagtgcaatggtgcgatcttggctcatggcaacttccacctaccaggttcaagcaattctcctgcctctcaagtagctgggattacaggcacgcggcaccacgcacggctaatttttgtatttttagtagcgacggggtttctctatgctggtcaggctggtctgcaacttccgacctcaggtgatctgccaacctcggcctcccaaagtgctgagattacaggcgtgagccactgtgcccagtctcacaaacatttctttaccaaatttctggtaagttttaaggtattaattgctggagacttgtcaattaatacaactgtcttttgtggctttacaatagggatactgagacattcatcagttttaggcgattttgtcattgtgtaaacattatagcgtgtacttacacaaagacttacacaaatctaggtggtatagcctactactacacaccaaggctacatggtataatctgttgctcctaagctataagcctgtacatcatgtgactgtactgaatactgtgtaaacatagaaaagttaatgcattgtgctatgacgttacagaggctacaacatcactaggtgataggaatttttcagctccattatagtctcatgggatcactgtcatatatatggtccatcatcaactaaaatgttatttggtgtatgactgcacttgacttctggggaaaatgttggaggacataaaactttcactctgagccaactgatatatttcttaactgaaaggtttcctaggtcattcacacagaggaagaacaaaagatggtcaagaagaaccctgcatgttctcaaatcttccacagctaatggaagtagcaccaggaagccagaggttcttaaacttactcttattttatcataatgtcagcaattattccttcagttggaattctcttaaagtgttcctagaggacagtacagtaaatgcttcacctaaaagttaggttagtaaaaattactaagatgtttaacaaagtagagatgtttaacaaagtagataaactacattaaaaaagactatgtcatttaggcattacattaggctgaatgaaataaaaaccctgctatggtgacttaatcaagaagaagttcagaaacaggtggttcacagtgacattaacatcccaggatcctcccatccttctggtttgctttctttagggtgtggtgttcatctcacagtcaggaagtggcttctccaccttgagcataatgtccatctttcaggtagggagaagaagaagaaagagaagggcaaaaacaaaagactgaatctatcttttttaaacaggtgatacggtttggctctgtgtccccacccaaatcttatcttgtagttcccataattcccacgtgttgtgggagggacctggtgggagattattgaatctgatcattttaaaaatgggagttttcctgcacggtttctctcttttgcctgctgacctccatgtaagatgtgacttgctcctccttgcctcctcccatgattgtgaggctttcccagccacgtggaactgtaagtccaattaaacctctttctattgtaaattgcccagtctctgctatgtctttatcagcagtgagaaaacggactaatacaacaggaaactacagcttttccagaaaccttgcctgtagtctactacttatacctcattggccaaaactttgacatatggtcacctagctgcaaacaagagtgagaaatgtagactttagctaggtgtattgctacccaaaacgaaattcaggttctcttgtcagaaagaggaaaatatggctgttgggttgacaactagcagtgcctaccacaaaaacactttttaaaattgcagccagaaagggcttaactcccaggaaccttggagactgtgagaaaatgaaataatttaatattttgaacataattatttacagccccaggctcatgttcaggttcaggctgagggcaaagatatgacctttgctcccaccagcaggcaattagacatagttgagcaagggctagcttgagtgatttttaaagaactaggcaggcaccttcctgcttatgctgtaggatacctgaaaggcaccagcaagcaacgaacaacctcagaagaatttaacaatgattgctgatttttgtatttggtatccaattttaacactaaaaaattcctgttggaatgggccagttgcattcaaaaaagcacagttcaaatagccaaaaaaactttttaaaataaaaaatccaaactgacttggcatttcttgagaactattaaaagggcatcatttcgcactgcccagtaacccttcttacatcccttattctctcctctcccattcactcacgcattttgttgtatcttacaaaaatattaatccataatgaactagaatttttaaaaacatcctcaccacaaagagtttaagtactgctctagtatgaaccattgattttgccttctaaagacctagaattggtccagtgggacagactgtcctttgagagttcgaattcttattattaagggagagtagaagggaggaggacttgggaagattcgtaacacagcaatgttttaactcattataccatcataaaaggaaggtacaaaatgtaagaattttagctgggggtggagaatagtgtcttacttagcttcctcgggcttcctttaccatcactccagtgttttaatgttatatccccccatttttttcttgggcctccaggggaggaaacgggtaatggtcaattgaccaaaagtaacatggggcaataaatcagaactattgaaatgctatggttcccccagatattctcctgtggcatcaaaaagttgaatcaggtaaggaaaagttggctacccaccatatccaatataaattatgacaggtggatattaattaaatataaattgatgacactctaaaagaaattggacataaatcagcttttattgaattgacaatattcttctgttgtggaatattataatatctcaggcatttgaactccagcctgattcaattcataggctcctggaatggctctagatcagattgagtatcaattagctattgctgcatactaaacaccccaaacctcagtggctttaaacaaccatccttcattatttctcacaagcctaggggtgatgtgtgggctggctgatcaccaccaccaggcttgctaatgtgtctgagggtttcctgaagtctctgctctagcctggacttagctggagcatctaagctaggagaggtctgctccctgtattattcatctttctcctgagaccagcacacatgcctgggtatgttcttcttgtggcaatggcaggaaatccagagggcaagcagaatcactaaggccttgggacttaggcttagatgtgtcactcttctggcacatcacatcattctgctgaccaaagcaaatcacatggccaaaccagctcaaaggtgaaggggagattcttcccttttagtgaggaaaaccacaaaatcacatgtcaaaggatgaggaagaagaccgataaagaactggggccattcatgcaatttccaaagtgtgatggttaattttatgtgtcagcttgattgggccacaagatgctcatttatctccttcaatattatttctggtgtgtgtgtgaggttgtttccagaagacatttgaattgccaaactaggtaaagcagatggccctccccaatgtggatgggaattctccaacccactgacggcctgaatagaagaaaaagacagagtagagttgaattcttgctctgcctgactgcttgagctggaacattgatcttctcctgcccttggcactcctggttctcagaccttcagactcggattggaatctataccattggctccctggctctcatgccttcaaatgacaccacgggctttcctaggtatccagcttgcagacaacagattgtgggacttctcagcctctataatcactgagccaattccttatgataaatcatatgacagccaggcacggtggctcacacctacaatctcagcactttgggaggccgaggcaggtggattacctgaggtcaggagtttgagaccagcctgaccaacatggtgaaaccgtgtctctactaaaaatacaaaattaattgggtgtggtgacaggtgcctgtaatcccagctactcgggaggctgaggtgggagaattatttgaacccgggaggccgaggttgcagtgagccgagatcacaccactgcattccagcctgggagacagagcgagactccatctcaaaaaacaaaacaaaacaaaataaatcatatgacactgaagttacagaaatcacttttctaatttgaatcatttttttaaaacagagagatttcacataaaaatcctgattgatttttttttttcgaaaaatcagaagctttgcaacacagggtccacattcccatatgtctccacagttcgcaggagctgagtagcagctgccctgtccattcatttgctttatctccctagcccttggagccatttgagtttgctttacacagtagtagttctacagccagatctgtttctcaagcttcagataggcttctgcagtgctcactatttactgaacacctcaaattcaatataattaacaatatcgaaactaaagcatcccttcctcctcatgcaacatactcttctccaatagtccctatcttcctcatccaagctagaaacctattcatcactttgacttttctttccctctctaatatactacagtatacaattttattcacaataaaactacggtgtgtctaggaaataacctaagaaagaatacccaagacctttcccgaaacaagtgttaaaattgtactaaagtccaagaaaaatattaagcaaaaatgtatgtgaattgactatctaaataaagttttatgttaattcccctaaataaatctatacattcaatgtaatcttaataaaaatcccattggattgtttgaggaactcaacgaactcattctaaaatttatatggaaaaatagaggtttatgaataagctgattttgaaaaagaaaaacaaaatagggccttgccctaccagttaaggcatactaaagaacctaagtgataaaaacagagtggctctggcatgggagcagactaatagacaagtggaaaagaatggcgagctcagaactaggcccatatataaagatgggaacctgatggaagatgatggtggtactacaaagcaatgcaaaggggatggtcttgagaaaactaggtcatgtctgaatacccccagctggaatagagaacaaatgtgaaagttcaaattataagatcaatagaagaaaatatgacttggggtaaggaaagtcttcatgaaaccctacactgtaaagccaaataaaattttaaaaagtaaaataaaataaagactgatttcatgacatacaaattaagaactcctggctaacaaagaacactggacaaagctaacaaatatatgacaaactgggagaagatatctgtaatatctaaaactgataaagaaggaataccttgtttatataaagaactgcaaaataacaagaaagaaatgggcaaaaagatatggataggcaattcacagaaaggaaaggacatatagccatttcaacatatatacatttcaacaaatgtatgagattctctagtaatcagaggagtatcaattaaaacagcaaggaaatagctcattatattcataatggcaaaaagtacaaaaaatggttcatatcatttattggagaggatgtgggaaaaaaacattacaaaacaaaatcaaatcgtgaagggtgtcaagtagaatgcttttttagggcagcgcctctgcccactatgctaagtacctcttagatctgaaaactaggtgtggcaaagactgctatttacatactcaacatgaattttgcccttcttccttacttgtagaacccctatattattaggagaataatgcgtctagcttagaaaaacacacatatacacataattcccagccccacttgcagcaaggggtggctattgataggtagacaggaaccattgagtggggctttgggaaagtcctttcatcccttgccatcttgcaccatggatcgacctggaggctctggaaacatgctccgagaatagcagagcagaaagacataccgagcctgggtccctgaagaactgtggagtcactggccatggactgcccctctctaggcttctgtaatgtaacaggataacaccctaatttgtttaataagccactatagaccacctctgatactagcaccttaatgcaattcctgatattcaaggctttttctaaaaaaatgtcattcttttctaatggtcagaggtaggatacagactggtattacaaggtaaagataacttagccttgaacagattaagacaaataagaggagcactgcttcaagtagcagtcaataagcttatttattttttctccagttaattactaaaaactgaaatatcatcttaaagatacctttcaaatggtatttatggaatttcttatcccctaaagaaaataggtggagaaagtagaaaatagcatctttttaaaaggacttcaatatgttcattaatggagtcataatgcatcaagggaagtcagaaattttttgcaatacatctttttttttgcatcacaggggacataccatgtcttctcactaaacttcctttgatggcttaaggttactcttgacatgacaataaggtagaatctctatgtttccagatacagtgccttgtgaagaactcttcaggcctaaggaggaatgtgtacaggccctagagagggcaggtctctgctggaaagctcactgtttatgaataatctagtgggcagtgcacaagacaaaaatacatacagagccatattttaaaatttagattttattattatttatgtatggtgaggccaacagatcaggagatggtctgctatcaaaaagacagtttattattcacccagcccaagaggaggatgcacaccaagccacacaaggcaatgtggagaagcaccaaggtccaaaggaggcagaaggagtgggaggaaacatggcaaaaaacattatgtgatttttgcaggaaggaatggacaaatcaggataagcaggtttagtttgcataatttcagtgggatctgagatgtaggagttgttcctagttgtctggtactttgccctggagtgattagggcaggggaatattggcatggagtgtaacagcctgataaagaaggtagatgatcagtgtgtggcatgctgggtgagttgtttgctatgtctaggaattagctaacccttggaggggttatctccctggtcagggagaccccagatgccagagcatcaagaatacaaaaaataagaaaatatagttaatggaagtggccactgatctaagacaccaaacaggattctcttgttcagctgtgttcagcatttacggatactgctctgcgacaggcactgtgctgggccctgagagaggagcatctgcatgacacagctgctgacctccacaaatctcaggcccaggactctgagctcatgatctaattctaaatgactttggcaaaggaaggaagtgtgttccaaagaaggccacatcagtttaaatattggcaaaccaatgccagggtcatgcagacaaaagaccaaataaatgcaccaaaccagagcatttttctccccttttccacagaatattgtctctctcttattttcccaccagggatgctcctttttgcgactcagacctaatgtacttgctctattttcccggggggtctaaactcaggaaccagaagaatgactaaatgagaaataaaagtaaaattctgagcccctgaactgactgaatagacccattgttcactacatagaaagccagtcattgagacaaggagtattgccagggaagaaggttctatttgggtgctgcagccaaggagaataggaaatcagtctcaaatccatctcctcaaccaactaaaattagaggtttatatggcaagggagaaatgtgactacatgtgagaaaacaggaattagtgagcggtaaggatgaggacttgttcaacaggcagcaggtggctggttaggcaatcatgatgggtgaggggtatggtgcctcattgtccagatgcagtgatctggtaagtttcaattccttgatactatctgggaggcctcatggttggtttcccaagaaaggaactcagataagaaagatgtaactttctgaagttttaagactgggagggtaaatttccaggtttattcaaaagaaaccataaacatcagttctataggacagttgggctgatttcacaccaaccagcattccttcctgataagagaccaccaaccacagagaagttctggccaatctaccagggactcacagcgagggttttcatgtcctctgctttgccatttgacatcagagggctgaaaacttcacactgggatcatgctaacaccaccattttttgaatatgggtcccatagagaggcaggaagcttaattgtgcatgtgcatatttctcctttcataaatattcatgaatcctcctacagctcattgaatatatttggccaccctgctcagcataaatttctgttccctttgtccttccttccaagtgtctgttctcagcttctgaccagaggctatgcttccaagcctgtcagaaaggccaccctgcaggctgtaacccttcatgagaaataaagcccttttctaaatttattaacctcctcattcttcagttgacataagtagagcatcatagtccccacaaatcatttctgggatactctgttcttatttgtaaaacaaggagataggaaatgcatgctatactaaaagtttgttcaaagaacatccgcacgtgcaaatgtctgagaccagaggctgcaagcctccctgtcgctcttagggcttcggtagccacattgccacagctctccacgccctcaggtaacgcccctccgcaggccgagacgtcggcacgtacactgtcaggtcttcccgctttccgtcgcttcctgttccgtcttggtcccgcctgccgctggcgccgttgtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtcatggccaggggccaccgcggccagccgggtgtgaggctgcctttcgctgcccgcgcgctccagtggtctctgggtccgccggcgtccgtttcggcctgaacgcagcccctccgcggcgacgagcagtctcgcgccggagctcatggcctcggaggcgccgtccccgccgcggtcgccgccgccgcccacctcccccgagcctgagctggcccagctaaggcggaaggtggagaagttggaacgtgaactgcggagctgcaagcggcaggtgcgggagatcgagaagctgctgcatcacacagaacggctgtaccagaacgcagaaagcaacaaccaggagctccgcacgcaggtgcgcggtcctcctcagccccgcgccccatccagcccaggcgaggccttcgaagcccgtgatagcctcggaaggggtccctggcaggggctcagaactactgtagagtacttaaagtaaataagtagaagctcagcgcagttacaattccaagtaccttaggagcaaacctgagttcaggttacttgatttaaatcaatgtctcgcggctggcgtgaattgaacttaagtactgtggctacattgtcttcattctcacttgacctaacatcccattggcagtaggcgcatttactgtagatcacatttgagtttattaaaatgctggacttgagtcagaatcccatctctgctattcactgggtgtgtgaacttatataccgagtctcagttccccattaaatgagaatgatagctcacagtagtaaaggtgaagtaaaacaaacaattttacaaacttttgaatgctatacctgtttaaggttgctcttctgggcgtttatcatcttcggctttcttgtgtaagtagggacgatatataactgcttttgttggagacgttaagcagcttatttcgtttccaagatggtaggggcaaatgttaatacttaaactgtcacattaaaaacaaccttggctggacgcggtagctcacgcctgtaatcccagcactttgggaggccgaggcgggcagatcaccaggtcaggagttcgagagcagtctggccagcatggtgaaatacaaaatttagccgggcgtctctactaaatacaaaaattagccgggcgtggcggcgggcacctggaatcgcagctagtcgggaggctgaggcaggagaattgcttgaacctaggtggtggaggttgcagtgagccgagatcgtgccactgcactccagccagggcgacagagtgcaactctgtctcaaaataaaaaccaaaaaaccaagagcatagtatttttttctaccttgttggcaggccctctctgccaacagattatttccacatagtaactagtttcaatttgaccgttgtctagtccttcataatttattggtggtttcctaaaaccagtatataggctgaacactgaaacgtcatcagacttctttgttttgttaccaaatggactatgaaaataactgttgagttgcaatgactttgtatgaccattacatggagttcctgacatgacattattggaaagtttttgtttagtcaatttaaacacctacggtgtgtaataactatgctaggaaaatacaaatatggtaaaaaaaaaaaaaaaaaaaaaacagggagaggtggctgggcgcggtggctcacgcctgtaatcctagcactttgggaggccgaggcgggcgaatcacgaggtcagaagatcgagaccatcctggctaacacagtaaaaccctgtctctagtaaaaatacaaaaaaaattagccgagcgtggtggcgggcgcctgtagtcccagctacaggctgaggcaggagaatggcgtgaacccgggaggcggagcttgcagtgagccgagattgcgccactgcactccagcctgggcgacaaagcaagactccgtctcaaaaaaaaaaaaaaaaaaaaaaatggggagacgggagcaaaatataacagccttttttacatgacagccttttgaaaagctcctttataattctaaattgttgaagtactgcttgcgttagagattctaaaagaaaacgttttttgctaatcttcagagagccagcattttggtgttactgttaatttgataaatcagactaaatgatgggactttgtgaacagatcctttatttcttacagaaaagaatgtttttatgctaatattttgagaggtcagcaattctccctaaagaattagaaaatttaagagctatcaattcccattcatgttatctaatatcattcaatgttcacgtggatttagttattaaatgttaatgcctcttataagctttaatacactttaaaaaaatagtagttctgtgactaaactgcagcagaagcgaacagaaggtaattgcctgagaggatcatctgtcctccacatgcctccattttagtccaatattaaaaatttaatctcatagaaagtcttgactctactttgaatagtgataactccttactctcctagtcagcctcccttggttggggagagggtggattcgattaactgtcattccaaattactgaatgtgttttatttggagcagttaaaaagttttgcttgagaatgataactggagaaccataatatgtatagggtttgtacaagaccccaaaatagccttgtgcaaattactttgtcttgtctgatattttatgtgtaaaattggggttaggacaacgaatatttcaggtggttttgtgaattaatgagatgttatctaaagcatcaagtatagtgcccagcatgtagtagatactaagtaatctaattcatagtgatagggacagtagccagagccaggatttagggcaaggcaatcaggctcctagggcgaggaatttaatggggcactaattcccagcgatgaactctgtacttgcatgaatcagaggagcgcctcagatttttcacgatcagtgtcttgcttccctcactgtagttcctgccctagtattagcaacagatcagttttatcacctttctctgtttaagctttatgtatcattaaataaatatttaaaagcttgttttttagttggtttcttgtgtgtagtagacattgtctcacattgaggtcctctcaggctgaggtgtattgactgaggcagcgtattgaccgaggcagcatgttacttgcttttgggcacttccacacacttgtttctctctgtcctatgtagtagcatccttttaagggtattttagtgtgtgaagtacatggaggacagatgcccctctcaggccgtcaccttccctgttctcttctgctacagttacttaattataggactactgtttaatgaaaaaatgtattaaagcttgtaagtggcattaacatattcaggtggatagttaattcccagtggagaataccaaatgagtattagataatccagtagggatgagaatttgtaaattttgaatttttgaattctttagaactgactttaaaatgttaacataaaagcattcttatttgttagaaataaaggaccttgttcacaaagtctcattatttagttcgatttttggaggagatatttggacatttagtaagagagattaggaataaaaatgccttttaaatgtataaagtaaaataataattttagcttttctgaaagggaaacttgctgctcttgacatttctctaaaacaattatttgtaacggtaggagactggtatatatattattagattgttacatgatttctttttcctaaagccttgttttctctcaggtggaagaactcagtaaaatactccaacgtgggagaaatgaagataataaaaagtctgatgtagaagtacaaacagagaaccatgctccttggtcaatctcaggtatttagcttatagtgaggatatgctaacactgttacattcaaatcatgctaatgttgcgttttcttttaatttaaaataaacaaagatcaaggtaaatgagaattgttaatactgttgacgtctctccatatgataatggtattttcggataatcaatttgttcttctggaggaaaaagtagaaatgtattgtcattcctgtgatttctataatgttgctaatgttttcagtggcacactcactgagtaatttttggcaggcagttagccatctacttccatatctgccttccttgtgaccaggggcatttgttttcttgttgatgtgttctaattagaattatgtatagtatcagtctctcacccttgtgggaatggtgagcccaccaccatggccttatgaatggcattatgttataaggcaaaatagctgagatactgagttttaatatatatgtgtcacaagaagaaatcatctttcctattaagttttgccttgcttcagtcaggacataatttttggctaaattgctaaacatagcaatagtgctaacttttcttatctgcatgatacgttttaaaaagtctgcatggggagagaaatttgccaaaaaataaatcaatccctaattccttgcctttatttcattatcagttgataagcaacagtattaaggtatccagttagaagttaagagttaagttttttaaatagaacacaacctatctacagatttttattttactcttgctgtagaaaatgtaaccaacttaccttttttttttctttttaactgacagctagggtcttgaaggagacattagaatcaaagatacacacttctgcagatttatctgtgccatctgttttaatcttttaaaatttgtacagttgtaaaaatcatgatttatttgaagtatgtgctttttgtgtttaaatgccagtgttttgtagttaagtcctttttatatacattattctaatatgatacgatttcacttcatttttttgctacagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggtaataaaatgctaaacatgaaactgttgatgcccaagaacctgtccttctttgttgttattatgtggaaagatagacttctttggtccgtcacagcatatataagggttataaacattcttatgtgtaattatgcaaagaatgttgtagtttttccaaaaccagaattagaacttcttcatatatgtagtggttttcctactacattgtgttccaaaattttgtgatctacataaactaaaacaaaatttgtccagatattttgactgaacaaaagaactgtggacaacaataccacatttacacctaaaaaaattttaatgttcctttatgtcagataccctgccactattcaaatttccctgaatctataaatttgtttttatagtttgtttgaattaggatccctattgtgtttgatatatctcatttaatctacagttttctccttcatttgtctttttgaaattttttttccaattgaacatataatcattgaagaacctagatctttgtcttagccaatatttcagggtctgtattttgtggatggcttccctgtggcatcatacatttattctcgaataattgtcactcatttttagtgccttcaaaactgggtcaaagttgaagttactgacacactagtaaatgttgtaataagtggttcaagtcataattgatagtcatgcttttcctttgtagaaattgaagtcgttacttaaacatagtctcaggtcttgagttcagccaactttttaattgatatacagaagcttttgtcttatttggcatgactatatcttttataggagccagcatctgcattagcaacagaagatacctccttagaaggctcatcattagctgaaagtttgagagctgcagcagaagcggctgtatcacagactggatttagttatgatgaaaatactggactgtattttgaccacagcactggtttctattatgattctgtaagtatctcagacctttttgttttgttttgtttttgagacagtctccctctgtcaccccggctggagtgcagtggagtgatctcagctcactgcaactttcaccccccaggttcaagtgattcttatgtctcagcatcccaagtagctgggattacaggcatgcaccaccacaccctgctaattttttgtatttttagtagaggcagggtttcgccatgtcggccaggctggtctcgaattacatctcagaccttttaatactgtatgatacatactcagtgcctgatatcaaatattaaaccctaagccgaagtaagaaagcaaaaagctgcatttaaaattatatttgactcaaaactatttgacagaagaattctaaaatagcttatgatgctacacttctaagtttttaaaataaggttaaggttaaaataaattttattgtgattattatagacaatgttttggagaagtctttatgtataaaaataacagacaaaaatactggagcttttgttaataaaagcagatagttaactacatcgtaaatattttagaacctaaaccagtatttttttcatagaattaatagagaagtgaggttaattttaggcttggaatgagaattttaaaaattatatcaaatactttatgaattcattttaggccacataaggagacttctttcttgaattcttagtagtatgtttattattagccagtgttttatatcctgtgccttttaactatttcactttaaacattcagtctgttggctaggcatggtggctcactccttgtaatcctagcactttaggaggctgaggcaggtggattgcttgagtcgagtgcaagaccagcctgggcaacacagtgagactctttctataaaaaattttaaaagtcagctggatgtagtggctcaccctctagtcccagctactcaggaggctgatgtgggagcgtcgcttgagctgggaagatggaggctgcagtgagccatgattgcaccactgccctccagactaggtgacagagtgagaccctgtctcaaaaaacaagcaaacaaaaatcaatctgttagcaatgagaactagggaattaatatgggatctaaaatataatggaccactgactaggatagaaccagaaaataaagttcttgatttataatacagtgttatagctgttgaagtctaataattatatttcgttgaagatttgatgacaatgatagaactcagtcacatacctcaaactcaagaatctagtaatgtaatctggttttctgaggaattatagaatgtggtacacaaaagtggagttgacgttcatcattcctgttactggaactattgttatctagagaacataagataatactaaatatctcaattaacataagaggtgtcattagtttgtcaatctgcatatggtaaactgtaagtcctttgtaaagagagggttttctttcatgggggttgctaattgacaatgctaattaataaccaggaaattaatgtttaaacacttatccaaagggagtagttatttagtttctaggaaaacaatagtttcaagtagacattagtctttgtcaatcttctgcctgtctttctgtatcttttctcttgacatcagttgttttgtaaatggttagtacgttctgcaggttatatttctgagtaaattaggaacttcattgtgttgccattttcattgtgctaatattttaataaattttttttatattttgaaaatgtctatattttggactgataaacagatttaaaaggtttgaattataaaagttccattattactagaaataaagattggaaagcctccactcagtttcttagttaagagaaagatggtgagaaatctaaatattttttgtaagagatctgcaaaatgcatggattaaagacaataaattgcaagtgtcaatagttagaaaaataaattattctttttcaggaagttttagttgctcaatctcagtacattaaagatgtttccgggtctggtctgcatggatttaggatgtaaataaaatatagactgttcaattaaatttggttttagagtactggccagtatatcataaatataggtgattacctaattttatctttctggtttttaaatctgtaatttgccaaattcatttatgcatggttgcttgtaagtcttatttactatagaactgattaattagtggagacagtttattgattgcattttatagaatgttattttttggtatgcatgaactttattttcaaaattttcttctctaattttaagttatgaacatcaaaagacaaatctttgttttatgacattgagaggagggtttaggggtttatactgccacaccattattgtgcagtcattaagaatcaggagtctagaattgcgctcatatggtcagctttttcttatgcttgctttagttttcatgcctttaaaagtattatcaatttttttaatgtattaagtggaaccatatgaaattgctgtttcttataagttaaaagtggtcaagtattgacaattttatatgattaaatttaatatttagatttacttgtttctcacactaggaaaattagatcagttattgaatggtaaagtattttggaagattaaagcattttttattgttatctttaattcattgtcttctgaaaatactatagttgttcaaagaaatatttaccacatttgaatgtatttggcattttcgttaagtttattttatcttacatgaatagaatttatttttttcttgactttcaaaggaaaatcaactctattatgatccttccactggaatttattactattgtgatgtggaaagtggtcgttatcagtttcattctcgagtagatttgcaaccttatccgacttctagcacaaaacaaagtaaagataaaaaattgaagaagaaaagaaaagatccagattcttctgcaacaaatgaggaaaaggtaatgtctttacaattttaaaaattgacataatggtgataacatgataattaagacaaaattttttatgaaactgacaatcattcaataactctgcatttcaaacatacccattaagataacctaggaaagtttagatggagcaaacatggactttttcataaactctgtcactagaaatagaaagcatttcttaaaatttgaaggagatagattaaggtcagataaaatatctcgtatatagtttggaagaagaattcagatcctcagttgataagttgatgtcaatgcacagttcataataaaagataaacacagtttataggtagacatagatacaggttcaactttcttagttatgtggagcaattttttacttactaggacaatttttttttttttttttgagacagagtttcactcttgttgcccgggctggaatgcaatggcgtgatctcagctcaccgcaacctccgcctcccaggttcaagtgattctcctgcctcagcctcccgagtagctgggattacaggcatgcaccaacacgtctggctaatttttttgtaatcttagtagagacggggcttctccatgtggtcaggctcgtctcgaactcctgacctcagctgatcctcctgcctctgcctcccaaagtgctgagattacaggcatgagccaccgcacccggccaggaaaatattaaaaaaaaaaaaaaaatccattgctgacaactgtggagtgagataacatatttattaggattaatagtttaaatggcctgcaagacaatggttaagaaagcgatagttacatttaatttaaaaaagtattatgtaggctttcagatggtacttgtaaagactaaggggaaccccaaaaatgcttatgatgatgcaatgttaaattgaaagaaggaaaatataaaaagttaacagtgttctttatttctactctctaaacaggtaagtttggtggtttataggttataaaggaggcttgtttgttttattgatattttatgaactgtggcaactatttgatatcttactcttgaaattttatctcatggtttcctgtcctgtcctttcctgtcctatctctgtcctgtcttgtccttctgtcctgtcctgttctgtccttctgtcctgtcctgttcttttttgagacagggtcttgctctgtcacccaggttgagtgcagtggtgccatcatggctcactgcatcctcgacctcctgagctcaagtgatctgcctacctcagcctcccaaagtgctgggattataggcgtgagccactgtgccagccagtttttcttttcttaaccaaagaaaaattacttgatactaaattgtaaagttcacataaggaattaggattctgttagattttttctgttctcctatttgatttgcttctgttctatttttttgtgaacaatacttaggaatagaagagtatgtgactaaaatactaaaaatcagttttctgtttgctttcaagatctctgttttaatggcttgtgcttgttactagtggtttgattgtttgaaaggctaggttgtaggtcgggtgtgatggcttatgcctgtaatcccagcaatttgggaggccgaggcaggcgggttgcctgaggtcaggagttcaagaccagcctggccaacatggtgaatccccgtctctactaaaaatacaaaaattagccaggtgtggtggcagatgcctgtaatcccagctgcttgggaggctgaggcaggagaatcgcttgaacctgggaggcggaggttgcagtgagccaggatcgcaccaccacactgcagcctgggcaacagagcgagactccatctcaaaaaaaaaaaaaaaaaaaagaagaaggctaggttgtgaaagcacctctccctaacaatagaagaagaatatgtagggctcctcaaatggccttgcctgaaaaactagagaatagacatggaaagcattctgtgatattttggtccagcctcgctcccataactactcatctttgccattcttctttgaaaatgtgcgaattccaagacaagaactttttttatttatttatttatttatttatttatttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccttttaaccctgagtggacacagcacatgtttcagagagcacagggttgggggtaaggtcacagatcaacaggatcccaaggcagaggaatttttcttagtgcagaacaaaatgaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacagggcggctggctgggcgggggggctgaccccccccacctccctcccggacggggcggctggccgggcggggggctgaccccccccacctccctcccggacggggcggctggccgggcagaggcgcccctcacctcccggacggggcggctggccgggcgggggggctgacccccccccacctccctcccggacgtggcggctggccgggcggggggctgacccccccacctccatcccggacggggcggctggctgggcagaggggctcctcacttcccagtaggggcggccgggcagaggcgcccctcacctcccggacggggcggctggccgggcaggggggctgaccccccccacctccctcccggacggggcggctggccgggcgggggctgacccccccacctccctcccgggcggggcggctggccgggcggggggccgacacccccacctccctcccgggcggggcggctggccgggcggggggccgacacccccacctccctcccgggcggggcggctggccgggcggggggccgacccccccacctccctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctgacccccccacctccctcccggacagggcggctggccgggcggggggctgacccccccacctccctcccggacggggcggctggctgggcagaggggctcctcacttcccagtaggggcggccgggcagaggcgcccctcacctcccagacggggcggctggccgggcggagggctgacccccccacctccctcccggacagggcggctggccgggcgggggtctgacccccccacctccctcccggacggggcggctggccgggcagaggggctcctcacttcccagtaggggcggccgggcagaggcgcccctcacctcccagacggggcggttggccgggcggagggctgacccccccacctccctcccggacggggcggctggccgggcggggggctgacccccccacctccctcccggacggcacggctggccaggcggggggctgacccccccccccccggatggcacggctggccgggcgggggggctgaccccccacctccctcccggatggggcggctggccgggcggggggctgatcccccccacctccctcccggacggggtggctgccgggcggagacgctcctcacttcccagatggggtggctgccgggcggagaggctcctcacttctcagagtgggcagctgccgggcggaggggctcctcacttctcagacggggtggttgccaggcagagggtctcctcacttctcagacggggcggccgggcagagacgctcgtcacctcccagacggggtctcggccgggcagaggcgctcctcacatcccagatggggcggcggggcagaggcgctccccacatctcagacaatgggcggccgggcagagacgctcctcacttcctagatgtgatggcggctgggaagagacgctcctcacttcctagatgggatggcggccgggcggagacgctcctcactttccagactgggcagccaggcagaggggctcctcacatcccagacgatgggcggccaggcagagacactcctcacttcccagacagggtggcggccgggcagaggctgcaatctcggcactttgggaggccagggcaggcggctgggaggtgtaggttgtagtgagccgagatcacgccactgcactccagcctgggcaccattgagcactcgacaagaacttttaagaaaaatcctgttggaattttgagaatttcctgaggattctaaaaggtacctgtgaggccaagagagtatcttcatctgttttctttatttttaaagatatttttgagcctcactttttgtaggtgaaggttatgtggaaggaagacagtaggggagataggagtaaataatttgaaatatacatatgtgcctcagtgcccataaataagccctcctttcttttcacttaatgactatctaatgttctgtactggcaaatagctttccctgcatatgttgttcagtaagtaataaatatacaagattggaaactgcttttttaagagtatatacagatagggaacttttttgctataattttataatgtaaaagctcctcatggtttttcagctccttgcccttgttcttgttctgggtgaatttgtattgctagaagtgtgtataatttatcacactgtgaatgtttagccagtctccaagctgaacttacgctgttatcaaagataggtatgtgaggtggatggatcatgaggtcaagagatcgagaccagtctggccaacatggtgaaaccccatctctactaaaaataaaaaaattacctgggtatggtggtgcgcatgcctgtagtcccagctactcgggaggctgaggcagtagaatctcttgaacctgggaggtggaggttggagcgagccgagatcgcgccactgcactccagcctgggcgacagagcgagactccgtctcaaaaaaaaaaaaaaagaaagaaaggtgtgtgagatgctctcatattttataaaataacagaagagcatatgaattcgcctcatgttgctctgaggtagaaagaaaagtgagagtgcgttagaaaccaagggaaaaaaatggaaaataattatttactttttctaaggctgaaatgatagatttgaccattgtataacacggtgactattgttaataacaatgtgttgtattattgcaaactgctgagagcaaattttaagtttcttaccacagaaaaataagtatttgaggtaatgtacatgttaattagctcaatttaaccactgtacattgtgtacgtatttcaaaacttcatgttgtacatgataaaaatacatcatttttgttaattaaaaaatgttcatttattataaggcatatcaactataaatgtacaataaataataaaagacttatgccaggcaagttaaaattttggaataagatagtcacagttaatttgtactttaaacttttatgtattatcaagctgaatctgaagtactaaattttagcaaaactacaattttgctacatattgagtacatttggatctttaaattcatgtcataagtaaagctaattctgtattttatttgtgttgactagctaattgattaccagtttaaaaagaaaatttagaataggtattctttaggcctgcactatccagtaaggtagccagcagctccatgtggctgttgagcacttgaagttttgctaatccaaactcaaatgtgctgttaagtgtaaaatacactctggatgttgcagactatgtaaactatctcattaataattttactttttaaatgtggctactagaaaatgtaaaagtacaaatatggtttgtgttacatttttattggacaccattggtctaggctatcccatagtccaggcagtatgtgatgagggcctgaactaggaatgttaagacattgagaatagagagacagatttggatatattttgagaaaagtctgtagcacttcgtaattttatatatggttaaggggatctcagagataactataggatttttaatttggataataagaagatggtaatatcattaaccaagaaaggaaatgtgagaaggagagggggaacagattgtaaccattgttattttactgacacatatcttcacgaattcgttgaaacttgatgtaatgttataagatagtgatgtttaagagtattctcccctgttccctcgtatctacccacccttctccaggatttgaactcagaggatcaaaaagccttcagtgttgaacatacaagctgcaatgaggaagaaaatttcgcaaatatgaaaaagaaggccaaaataggcattcatcacaaaaatagtccccccaaagtcactgttccaactagtggaaatactatagagtctcctcttcatgaaaacatctctaattcaacatcatttaaagatgagaaaatcatggagactgatagtgaaccagaggaaggtgaaattacagactctcagactgaggatagttatgacgaagccattaccagtgaaggcaatgtaactgcagaagatagtgaggatgaaggtgagtaaataatcattatttaagtaaatagcccagtctggtaactataaaagagcaaaaccattaaaaatgttagtgagttgtagtatatctgccagaaagtaaacattattttaatgatgttattgaaaatgttgtgggttgccacttggttattcttagagagtaggatgtgaataaatgactaatacttagaccttcagaaggtttcattgtattgaatggcatagtcagtagaatacaaagccaggttacctggattctaatcttaaaatatagattaaggctgttttagtgggttagatatttgtagtctacttttgtaactgagagagaaaaacaagttgtctttaaaaagtatacattatgaattcagctacatggatattatggtaaatctaatttttttttacttgaatatataaagacatacttttaaaacacaggatttcatattacagttggccttctgtatccatgggttctactttagtggattcaagcaacctcagatcaaaaatattcagggaaaaaaatggatagctacatctgtactgaacatgtacacactttttttcttgttattgtcccctaaatatggtgtacctatttatatagcatttacattgtattaggtgtaagtaatctagagatgatttaagttatacagaaggatgcacataagttatatgcaaatacgatacaatttatataaggacttgaacatccatagattttggcatatgaggagggatcttggaactaatcccccacagataccgagggccaactgtgtagtatatgagcttactttgttctttggttctcaatggcatttctcttgcattttttttgagacagagccttgctctattgcccaggctggagtgcagtggcgcagtctcggcttactgtaacctccgcctcctgggttcaagtgattctcttgcctcagcctcccaagttgctgggactacaggcgcatgtcaccacgcacacccagctaatttttgtatttttagtagagacagggtttgaccatgttggccagggtggtcttgaactcctgacctcaggtgatctgcctgcgtcggccccccaaagtgctgggattataggtgtggaccactgtgcctggcctttttttttttttttttaatggactcaatttttataacttaaaataatataaaaatatttgggattttttcagattctgaaaccttaaaaaagaaagagttgattatttgataactgtgatagatgctaaatatgcagcaacctttatgtggatcactttaataacagtgttaagccttacccattgctgcgtattatacagcagaatttaagaagtttgttttagtcagaattaagatttttgaccaacacatttttattttatggatgcctcctagttatccctatgaagttctttttcatagtagttaaattaatatttactcacttctttccttggcagatgaagacaaaatttggcccccatgtattagagtaattgtcattagatcacctgtgttgcagataggatcactctttatcattactgctgtaaaccctgctacaattggaaggtaaaatggttaatattattatatcattctttcagttatttcagaaaggctttattaagagcatgtatttttgtttgtttgtttgttttttgtttttgagacagagttgtgctctgttgtccaggctggagtgcagtggcacgatctcggctcattgcaacctccgcctcctgggttcaagcagttctcctgcctcagcctcctgagtagctgggattacaggcgtgcaccaccacgcccagctgatttttgtgtttttagtagagacgggggtttcaccatgttggccagactggtctcgaactcctcaagtgatccacccacctcaggctcccaaagtgctaggattacaggcacataagctgccacgcctggccattatgttaagcattattctatgtgctgtggatacaaagaggactaatgcaaaatgtctacccaaaggaagcacagtctagggggaaagaagacatgagtaaataatcactgtgtgaaagcacaggaaatctagagtagcagtaaggaaactggataatccataaccaggagatttactgttgatagacgtgtattttaacattatctgttttttaaaattctttccatgtcactttatataatatgcttcaaaaattattaaagacactttacttaactctgcagagaaaaggatatggaacatactctccgaatccctgaagttggtgtcagtaaggtaagctctttgatttatcaaatatagtcccctagatgtaattttttatattattattacagtagaaagcttagggatttttctcatttaataggaaggttaacatgcagtgtagtaatggtaataaaggcagtgcagatctgtttattccagtgcttgagaaaataattctttatcacaatttgaataaataaaattatgtttatttttaagaatctggacaagagtagaaagcatatgaagtcttaaagtagtacccacttaatgaatatttattgagtgaaataaataggctacattttatgacctttaaaaaatgaatcttacctggcttctggctactttagtaggtggttactttgagccggaggatttcacaacccaagaatatatcctataccactcagggttcttgtttaaaacttctcctaattgagcatctaatggtttcaggaaaaagaacaattgagttttcaaaacaaatagaacagaattgcaactcaagttataagtagaaaacaactaaaggtttagctgctgagattctttatatatttttactttttttttttttttttttgagataggatttcactctgttacccaggctggagtacagtgatgtgatcacgactcactgcagcctcatcttcccgggttcaagcaatcctcccgcctcagccccgaaggtagctgggactacaggcatactctaccatgcccagctaatctttatgtatttcatagagatgcagtttcacctgggtgttcgctaggctggtctcaaactcctgggctcaagtgatcttgcctctgcctcccaaagtgttgggattacaggcgtgagccaccgcgtctggctgaggctctttatatttctctttcctgtactatgttttctgtgttttctctctcctctcttatggttgttatcttttttcctgttttgcttttctctttttttgaccttccattgttcccattttgcttttatttaacggactgtaatgtggacctaaagtagattttatgtgatgtttgtctttttggaatataatttctcatttttaatttgaaagtccatttactttcactttctggggactcattcagaaagaggaaaaagtcctcttaattttaattctaagcagattatgttgcttttttacttttttactatgaccttgagtctcctgcctccaaaaaaataaaacaacacctaatctgtaacttaaatagcaaagcgatctgagatccttccccacctccagtctaaaccatagatagttctatggtggctttttctttttctttgtttctttttttttttttttttttttttttttttatagagacagggtcttaactgtgttgcccaggctggaatgcagtggcacgcaccacagcctctgacacctcctgggcttaagtgatcctcctgcctcagtttcctgagtagctagcactataggcacacaccaccacaccaggcttctggtggcatttctgttttttctttcatttaaactaacatccgctagtggggtggataatttgttggtgaagtcagtttgatagcacatataacatgtatccaaatagatgaaaaacttttaaaaaagaagcttaatgttaggggaaaaaacaagtatttgaccactagatagaagactttctgagtttaaaaaatggtaaaaattacaaaggacaaaatgatcttgctctttatatgttaagaaaccaatttagaaggcagactcggacaggcacaacaaatatgacacaatatacattatttatttttgaaaagttcatgcaaatttatgttttcaaactccactgtgacaccagtagataaatgagcaaaagatacatcaggcagttcacagtaaaggaaatatcatggttaatatatgaaaaaccatttagtctttctagtaatctaagaaatacagatgaagccaaggtgtgaattttcattcatcatttattaaatatcactccttttgggaatgtaatttagaaaagctttttggaatagggtttggcagtacagaaagacttattctaaacaatccagttggaaaaaagtgtacaaaggacataaaaagaaaatttacagaagaggaaacccaaatggctaataaatattaagagtttggggggttgggcgcggtggcttatgcttgtaatcccagcactttgggaggctaaggtaggcagatcacgaggtcagaagatcaagaccatcctggctaacacggtgaaaccccatctctactaaaaatacaaaaaattagccaggtgtggtggcgggtgcctgtagtcccagctactcgggaggctgaggcaggagaatggcatgaacctgggaggtggagcttgcagtgagccgagatcatgccactgcactccggcctgggcaacagagcgagattccatctcaaaaaaaaaaaaaaagagttttggtagtaatccaggaaatgcaagttaaaatcacaatgataaggcaatttcacacctcttaggctagcaaaaattaaaaattttggcaacatcaagttttggtttagtatacatagagcagcaagaattctcacagactgctggtgggaatatgaattgatacaaccactttggaaaacagttatgtagtaaagttgaagatttgcttatgttatgatttagcaattccattcctaagtgtgtattccagagaaacatttgcattttgtacacaaatagattgcaggtacaagaaggtttatagtaatatttttaaaaatagtaaaaccttggaaaaaaaccctgaatgtctgttttcagaaggatgggtggatagattgtggtatatccacacaatggattaccattcagcaaaatgaatgaacgacaactctataactgtgtataacaactggatgaacctcatgacttaatgttaaagaagcaaaataagaggaatagatagagtgttatggaacaaggagggaaagattagtcctaactattgaacatcttggaaacttctctgagaagttggccttgagtgtttcaaatcacattttgtattaagaatttttggccaggtgtggtggctcatgcttgtaatcccagcactttgggaggctgaggcgggaggatcacttgagctcaggagtttgagaccagcctgggcaacatggtgaaaccctgtctctacaaaaattacaaaaattaaccaggtatggtggcacatgcctgtggtcccagctactcaggaagctgaggtgggaggatcgcttgagcccaggaggtcaaggctgcaggaagcggtgatcacaccactgcactgtagcctgggtgacagagcgagaccctgtctcaaaaaaaaaagtttttgatgatatggaccaaaaaaaaaaagtttttaatgatatgtacaaatacttacattaggtcaaaatttttcaaattataatctctagtaccaaaggagaagaggtaggacatattctaaatttttcatggtaattaaaggtagatttatagatgacattttcttctatagcctctgtttctaccagaagcatataatagtttgtgtttctaaaaaagtattaagtataataaaatttaaattatcaaaggctcaagttaacatcatcatatcatacagaaattgtccatagttttgaaaagtataataattaataattgcttgatttcactttctaagtttcatgcagaaatttattttgaccatgacttacaaagttatgtccttgtggatcaaggcagtcaaaatggcacaattgttaatggaaaacagattcttcaggtgagtgtatatgtgttaatttgttacctgcacattatttttaaactgatttttttttatttctgaagggcataatctttatcatttggttcagagtagagttaagcccaaatgtgttacttcggaaggaatttccagaaaggctgaaaaaagtgtataatcagtgggtacttacttggctgttgagttttgacttctaattatgtatctatgccttattttcagttatgactccattgtaaagctattcagagtaagtgtgtaaatgtctcaatagcaactttgaaggtcgtccctttttttattgtcttaatggaaatgttactaaattgaaaactgtattaaagggaaaagctatgtctattcagttaacacttaacatcctcagcatgtagcaaagtatttggcataaataagaaaatataggggctgggcgtgttggttctgacgcctgtaatcccagcactttgggagcccgaggccagtggatcatctgaggttaggagttcaagaccagcctggccaccatggtgaaacctcatctctactaaaaatacaaaaattagctgggcgtggtggtgtgtgcctgttatcccagctacttgggatgctgaggcaggagaatcgtttgcaccggggaggtggaggttgcagtgagccgagatcacgccattgcactccagcttgggctacagagtgagactgtctcaaaaaaagaaaaaatataggaaggcgggaggccttattcttagtctgtaagagtaaaaatggaaataaaactgagttatcaagagagaagaaaagggagatgtgatgcatttatcccattctcttaacatttcatctttttttattgtgatgattatatgttttggtaatagattgaagtctagaattggatatttctgattggatagggagactggtgggtttgacaagttgctcagttcagctatcttcatctccaatagtagtactttttttatgggtcattaagttggggaagtgtgtgcatgtgtgtatgtgtatgtgtctatttcatttatagctattttaaatatattttaaaaattataatcagacattacttacagtagatgtaaggtaaccataagtgattgttttgatttctgttttgtaaaatgtttcccctctagccgaaaactaaatgtgacccttacgtacttgagcatggagatgaagtcaaaattggagaaactgtcttatcctttcacattcatcctggcagtgatacctgtgatggctgtgaaccagggcaggttagagcccaccttcgccttgataagaaagatgaatcttttggtatgtgaaacagattaaatgtggctgtgataacatttctctttcattacctaaatgttctaaaaaacatcagtcagctactggctacatgtctaattgatacgatactgcattgagagatattttatacaaagctatcagtcttgtatccagttgatctaataatagattgagatatatttcgtaaatattaccaaatgagactaagaaataacatatatttggaagttgagacctaggctaatagattataattgtagttgatttttctgtgtaataatttagcttcatgatatgtagcattggtctgctttttgaccaggaaagagattgataagctctctttctgctaatccagtttagtaggcttttgaggcagactgtagtggtagtcaaatgtacttaagagcagttgtaattgaaaattggtaagagagtagattttaagtgtttttaccatacacaaaaaatgataagtacatgaagtagtaatgggtatgttaatgaggttgatttagccagttaacagtgtatacctacatcaaaaatcatgttgtataccatatatacaatttttatcaattaaaataatttaaaaagtaattatgacttaagtaataatttaataaagactggtttccttttgacaggtatgtattgatgtaaaaaaagtcatccacagttgaactctgtcatataatattaacgtaggaaataataagccaaggcatgaagggttattgattgatacgttttctgtcctattgatagctcgtgctgtatattgtctatgtaccattattctttattataatagcactgtaggatattactgttttgctttcagcccagccatcgaaagctcttaaaatttaaatagatgctttgaactagtaagaggtcatcttttttgacataaattttccccctaaatgccaagtttgcatgttcattgtttattttttgttttctgatactaatttgaaaatgaatatgttgcattacacaataacatgaattttggtttctctggcttttattttgcatatggctatgttcctttgcaaaatttacttaatatttctgcatttgagattctattacaataatcatattgaaaaatcgagatgttcattgttcattttggtagctataagattcctattatctgtggtttttgctttacttctcaattaggtttagttaccaaaatgctgaaaggacatcatcacaacccaatatcctttatattaatgtttatttcaacttctggttaattggaatgggttatattagttttttattaattaaataacattagttttaattttgtacaaaatcagatttagtggcttttttttaaccaaactttttttctttcagttggtccaacactaagtaaggaggaaaaagagttggaaagaagaaaagaattaaagaaaatacgagtaaaatatggtttacaggtgaggatgttgaatattgtttcatttgttaagctgtatatctggttttgagtaaaaatgtctttaaatatgctcagtacattttatatataaatagttgtgtagtatgatttcgtgatttgtattagtttactgttctggtattcataacctaaaaactattgaagttggagtagaaaaatgataatagcctacatttgaatatacatttctggttttcagaaaacttgcattaagatgccttgacataactagacatgatagtgtctgtagtttgtagtccctggtacttgggaggctgaggcaagaagatcgctttagatcaggagttcaaggctgcagtgagctgtgatcacacttatgaataggctctgcactccagcctgggcaatatagcgagatcttatctctacaaaatgatgccattgattgaacaacatagttggagaactaatatgacctgatgtaaagacttattataattaaactgcagtgattaaggtagtatcatattggcataaagataaatggatggaacaaaataatagtccagaagtagatccatgtatatgtgtggacaattaatttttgataaaggtgtgatggcagtttggtggagaaagagtggtcttttttttttttttttttttgagacagagtcttactctgtcacccaggctggagtgcagtggcacaatctcagctcactgctacctctgtctcctgggttcaaatgattgtcctgcctcagcctgacaagcagctgtgattgcaggggcccgccaccacgccccgctaatttttgtatttttagtagagacaaggttcacagcgttggccaggctggtcttgaactcctgacctcaggtgatctgcccaccttcgcctcccaaagtgctgggattacaggtgcgagccactgtgcccggccaagagtggtcttttacaacaaatggtggtagaataattggatggccttaccaaaaaaaaaaacacagacaaaaagaatgttgatccataccttgaaccatctataaaaatgatccaaaagtggatcatagatataaaagtaaaacctaaaactttaaaacttctagaaactttttttttaaaggcaaagattctaacaccaaaagcacaatccttaagaacaaattgataatctgtatttcttcaaaattaaaaattaatgtttttctaaagacactattaagagaatgaaaagacaagccacagctggagaaaatatttgcaaatcatgtatctggtcaaagacttctatatctagaatatacaaaaaactttcaaaacttaataataagaaaacaactcagttaaaaaatgggccaaagatttgaatagatgcttcaccaaagaagatatgctgatggcaaataaacatctgaaaaaatgttcagtattatcagtctttaaggaaatgcaaattaaaaccacaatgagataccactacacatctattagaatgcctaaaattttcaaaactgactataacaggtattggaagggttgtggaggaactagaaatctcatacactgctggtgggaatgtaaaatggtgcggttgctttggtagtttcttaaaaagttaaacatacacctattttacaagttagccattctactctgagatatttacccaaggtaaatgcaaccatatgtgcataaaaagaccagtaaacaaatgttcattgcattttttttttgaataaccaaaaactgagaaaaactcaaatgtctgtcatatatggataagcaaactatggtgttatctgtatggtgaaaatactacttagcaataaaaaagcaggaactagtaatataggccacaacctggatgaatctcaaaatagttatgttgagtgaagccagataaaacacgtgtatgtgcttccacttgtggaacaatttcactattcactggtttccaacttgtctgaggtctgtgagacggaacacactctcatacaagttacatgaagcaaacttactacttacaaatagtgagcaagagatgacagaagcctaggatttattgggaaaccaacccccaaagctcagaaagctgccttctgggtgaatggagtctcaactgtgtgtgccctacttgcacagcagttgagcaaccctggaaagcatcgcaccttgggttatgtacctcagggttatttgacgcactgggctaaaatgttgaaggacatcctgtttccaggtggggactggaacagagcctggactgttttagccaatccctccttacctcaggatgttgcattcccagcacattctggttggtgttgagaactacaaacaagaaagtgggaagaactgttctgcaccatttatgtaaacttctaggaaagcaaactaatgtattgtgacagaaggaagatgagtgattgcttagacacaagggaggaatgctacacagggaaggtctggagagttggattacaaagagagacaaggacacttttgggagagatggatatgtttattatcttgcttatggtgatagtttcataggtccataaatcccaaaagcatctcattgtacactaactatgtatgatttatttatattaattatacctcaataaagttgttttttaaaaaagttaccacttaatcctgtaaatagaccaggaaggcaattaattaatatttctagtttacttttgagaaactaaagcttagtagcccagctattaaattgtagagctagatatagaatctaggtcttaagtatatttgtgctaaatttttatacttcaagaagatgtggaaaaagaagttgctgccaaaataacatattttttctgtcaaattgtatctttcgttgttgttgctgttttacttaggtagagaaatcatagaaaaaagcaagataggccaatttggggggaaaatagaagacatttaaggagagaataaaattgttttgccaaaaattttagctcaatttctttattgtcttctggaggaaaaacttactaggatagatagttctatatttttcttctctttttaaaagcaaaattaattaaaagcttctgtcgtaccttccttgagttgctctccagtccctagcatctctctggatgagtatcatactttttatataaagatcagcaagttataacaaagggaaagggaaggcttctatgaatgctgaattgactaccccttctttgtgccaccaccacaccttgtgtatacctttattgaaccactcgtactgcaacaggccaaagaaagattatgcatgtcttccctctggcattccattacctagcatggagcttgacatactctttttctagggaatgtttgttaagtgactaataagtcacttaaatggagctttattgaagcaaaaaactattgttgccagggtaaatgggttttttaaaagtctctacatttctcccttccaagaaacagtgtcaaactactataggtcccttggaactttcagttccttagagaaaaggggagatagatttttttccccccaaaccccagggattctgtatttttctttgaatactagtagttcatatgacaagatgagaacacagcattaagtcagaatatactgttattttcaccatgtcatcttcttatgtatatgtatgttgtggcataacttgaaatataaacattttaaagggaatagactaaaagtagcatatctaatatgacaatttcttcatatcttttttttataactttaatataaatcaagtagagatgggggtcttgctgtattgctcacactggtctcaaactcctgacctctagctatcctcttgcctcagcttcccaaaatgctaggattataggcatgagccacctgtaatttcttcatatcatagcttgttttatttcattgtttatagaggccacattgaatcatattcgttaagtaaggcacatgtacagaaattgttttatttatcagctttcttttcctgaatgaatattttgtgtttattaagaatacagaatacgaagatgaaaagacattgaagaatccaaaatataaagatagagctggaaaacgtagggagcaggttggaagtgaaggaactttccaaagagatgatgctcctgcatctgttcattcgtaagttttgaattacagtggctcgaaacatcctttgttcataataacattcatagggtggtctgatgttcagggctatatatcctgataggtggcctatttatttgtttatttatgagatggagtcttgctccgtcgcccaggctggagtgcagtggtgtggtctcggctcactgcaacctccatctcccgggttcaggcgattctcctgcctcagcctcctgagtagctgggattacagatgcgtgccatcacgcccagctaatttttgtgtttttagtagagacggggtttcacatgttgttggccaggctggtcttgaactcctgacctcatgatccgcccaccttggcctcccaaagtgttgggattaccggcgtgagctaccacgtctggccaataagtggccttaaaattaacactttaacaacaaaatggagacactaagtctatttatactttccactaatcttggaattctattatcccctaaaaaattgctgagcaaatacatgagcacctgtacttaaacacacatatatgtatgttaacagtctagccacacagttgagtgtatatacttttatatgctagatatctagaagcctagattggtaagaacttggtatggactggtattttttaataattcttttaatactcaaatacttttgttcttaatgaccctgaaatataatttttcttatttatttttctctgattcagttttctcttggcaaagtagtctggataaaaatgaaaaaggtgatttttgaggtttgtaatatgaccgtatttctgcatttaatcaaatattagctgcatttttttcctcagaatataaattttgagtttagttaaaatttaaatttttcatgtagaactgataactaattataaagttttgattcaatatcatattgcattgactctaagagttttatggttacaaatggcaacatttttttcttaatggtgcataaaataatggtgtaccttagagttgatggagtttgatccattaccaacattttatttgatgaaatataggattacaaagtaggtacactaagcaacatgacactttttttaagtttaatgtttaaaatataatcttggagagtataaagagtgcattcaaattaaataagacaaatttaaaataaaacacattggtttgacattgcttggttattaactgaagggctaacagcatattttgtggaactgaaaagatagaacataaaatactcttaaattagcagagtatagaatcataggacaaaaatgcaaactgattaagaagttttatttcaatttgaactttttaatatgtaacatgtacagaaaattacacaaattataagtatatagctcaatgatacatcataagattaacatattgcagaatacacatttcttggacaagaaataggaaattatcagtaaccccagaagcttattctccctgtgccccacctaatcactgtcctgctgtcctcccgaaaggtaatcaccatcctaacagcaatagattaatttcacttattttaaaattttaatgaaatggaacaattcagtatttattttgtgtctatattttttgtgttccacattattttgttaggtatggtttatttttattgctgaataatattctactgtatcactataccacaatttatccattttaatcattgccagacatctggatcatttctgatttgttgctattagatttgctggaagaacattgttgtatgtgtgttttggtgcacatgcacatgcttttctaagtaggatatgtaccagtggaatttgtgtgtcttcaactttgttaggtaatgccaagcggttttctaaagtagttgtaccaattacttttaattcatgaatttattataaatgtgacctaaaagatcttttataaatcaactatcattttaatattccttaaagtgaaattactgatagcaacaaaggtcggaagatgttggagaagatgggttggaagaaaggagagggcctggggaaggatggtggaggaatgaaaacgccggtaagacttggattttcttttattcatttattcctagagcagacatttaccgtgtacattaatgtgccaaacgttgccttaagtgctaagaatatagtagaaagcaaaaggagacatgattactgcctttgtggcattcacaattaccaaatatatacatgtgctttgttttgtgttttatatttttagaaagcctctttttgagtttttttccctacattaaagctagggtgagaagtgctgtttcctgagccaaaggttcttctgtgttttagagtcatttttaataactgtcagagcactcaagaacaatcacagtgttagtttacaaacaggtggattgtgtatgagctgaaaaatctgtttggttcaagaatcagagcatgtaacatgaaatatagagaataatctctggaaaatgacatagtggtttaattaatggtcccatggttcgtaggaggtttaggttatctttcacacaaaccttaataagtaacctgactgtagaactttctggataatgaacttagtacctaaagaaataatagatggatcagtgtgagtatataccagctttctcattttttttgaggtacagtggaaagaacaaggattttgtagtcagacctaggttagaatatgtgctctatcatttactagctatgtggctttgggcaagtttggactttagttttcttatgaaaaaatggggataagaactctttttcagggttgtcttgaagataaagcccctaagcattgtaccttacattaggcactcagtaaatggtagctttgaatgttcttaaaatattgagaagtgctcccctcctgttatgaaaacaatcaaattctttttatggttattaatgtttaacctgcttgttcacttacttagataaggataggacagtgggtttaaacatatccattgcctttatttctggttagggtggaatgacatactctgcagcatctaaatgaaatttggtgattgctagttaaggagcactctattttctgtaaagtaggctgtacttattgacaaggcaagacaacatagaaaaatgaatgtaagttccatgtataaaggtatatatattcctgtatgtatttgatgcatctgacaggtttttcttttgcatcaatctttaataaatcaaaaaattgtagagtcctaagttggacacagcagatttcaatgtgtttagactctaaaataagtcctctgctcaacttttggtaacagatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaaaaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttgtcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatgaaaaagagtgattttttgaaccggtgatttaaatgtattgatctgctttgaattttcaagcagccagaattttctagtttaaattggcagagttataacaaaggagagcctcaaatattagacaattgcagtgcggctttctgggcacaggtgtcactgctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataaaatatctctttgcattcttcttggccacctgcatagtctgacacatacgtatgtacagttagacttgcaggctgcaggagtgccctgcattgttttcttttaattagaaataaaaagtattagtctaaatgtggttctggtgctggtgccctgtatatatgtaacaatataggacccctccaaataggttttgcttctggtgaatcttggtcattgggttagtatatgactgtctataatattttccatttgtattattatattggggaaaacattttttatcattttctattaagaaaatggaaaacttaaatatggtgttaaaaatggaaatatatgtgatatttgcattattaaacccctttgcagatctaaagtctcagggttccactattagtggttaaagtactgaataatgtctgggtctatttccatctgtaaaataagaatatttgtctcacgtgtctgtcatgaatagcaaatgagaaaatgtatataaaagcactttgtaaattgtaaaagtagtacagatgtgagcttctatttgtttagaagcataaatgtgaattatatacagtttgaattttgcataaattttttgtgtctaattttaaatatttgtttaatcacactacacattttctgagtagcgtttaagtatgtattttaagtggagctgcaagttctgaattttaagaaatctaacatctaatatttttgccagaacataagctggcaaagttgagaacagaagaaactttcaacattagagtaaaatagaaattttttccagtattaaatagaggaagcacccttatcctcaaaaagaggaacttttttctgcttttgaaacaagtgttacttctgatgtgtcatttttatcctgcatttatagaacgtaatggtttacgcaaatcaaaaaccttctgactttccatagaatatttttaattttttatgatttttatttatttatttttttgagacagaatcttgctctgttgcccagactagaatgcagtggtgcaatctcagctcactgcaacctcaacctcctgggttcaagcgattttcgtgcctcagcctcccaagtagctggattacaggtgcatgccaacatgcctggctaatgtttgtatttttagtagagatggggtttcaccatgttggccaggctggactccaactcctgacctcaggtgatctgcctgcctcagcctcccaaagtgctgggattacaggcgtgcgtgagccaccatgcctgtccaaaagattatttcttaatttgacatatttttaaagagcaggcaaagaagatagaaatctcaaacaagggaaagcaagagacgttggagattgcatacgaaggccattctgtaaagttgcaggacagagggatgtccttggcagggggcaagaaagcacttgtggacccaaaactcaaaggcagtctcaggaacagttgaaagtattttccccaccatcttgttgtaagtgtgcttcttttattagggcataacttatatttctgctctgaatctttgattcaaacatttcattttactttttcagcctttaaagtggaaatggattttgattctttaaaatgaggcagtggttacttatatttctgtgtgtttcagggcccaggctatctcttctgcttttctgttttactaatcttagtgttggcttatggccttgtagttgcaaaatggcttttgaaatttcagacatcatattcatacctaaagcaagaagaaagaagaaagagcagagtgtagtgttagttctctttttttaggaaaacaacagcttactcagaaactgacttcttagggtcattagccagaaccagatagcatggctacccatagaagagatgctataaaagtgggtaacaagatggtcacatttggcttaagccagtcatgaaccatcacctgcagctgagaatgttgccgttggaatgaaataggttcagtgaaccaagcagaagggggcagtggatgttgaatgggcaggtagaggtaactgccagataacgtacttgtccatcagtggggactacagggttgcttaaattgtgatgcatccctactatgtaatactttctggccattgaaatgaataagatagaactgtgtataccctagtgtagaagaatatctcacaaagcagattgtagcaaagtatatatggcataatcccatttttatttttaaattacaaaggtgtgtattgagttgctgataacccagagtgagcagactttcacattttattatttctatatttgaacttttaaaaagtaaacaggtgtgtggttaatgtgtatgtatatacacacttgtggtaagaatttacccagaagtggttaaatttgtggttaagccttcatggctcaaacccaggcatttttctcacatatatacccagtttcacttaccatctataaactcatgacttctaggctgtcttaggttattgattctgagcttatgacttacatatccatctcagagtcactttaaatgcaactccaagactaactccataatcttctccaaacctagtctcttctagtttactctctccagctggtaacaccatccatccagttgtgtgagtcagaagcctgagtcagcctctgtttcacaaccactagcttttctcccctttgtctgtttccaatatattaaatcagttcactgttaccagtcaccaaaattattctgagggcttcctaactggtcttcctgcaggcattctttcctccatcttccacactgcagacaacttccatctcatcgtctcctgtttggcttcccattactttgaggccataaaacaaactccaggcccataaaaccctaagggatctggccactgccagctttcctggtctcatcttttgtcactttcctacttgttctctgggccctagcatgctggcccctttttcagtttgtcaaacacagctgccttctctcatcacagagcctcttaacattgtattacatgtatggaatgctcttcctcccccattttacatagttaattctcacatagtcttcaggtctctgctgattgaatcttcagggatgcctcctttgaagccctggactagattaattgcctttgataagtattttgaaaaaccatttctttcatttagaccacttagcttggttcacagttacatattagtgtggttagtgtaatatttctcagtttctctagattgttaagtgccatgtgagcaggaccttgggtatgcttactattgcatccgtagagcctagcaccacatctggtttatacaaccataggcactgaagcacacaatgggtaactgcaagtggcttgatggagtcttatcaagctgtgactgaagaaacatgggaactgaggctacatagaggatctacaacaatggctttcaaactattttgatgatgatctacaatgtgaatacaatttgtattacagttcagtacacgagcatgttcatagcatatgtaacatagattttgtataccagtactttgccataagctcatgtaatacactcgttttccacatcactgattgcatccactaaattgctttcataatgcactaatgggctgtgtcctacaatcagattttcaaaccttttcaaagaacccattgcattgccttaggagctgcagctgtgtgagtctatgtttgtgtgatgaggtggggagagtttaggatgccaaactgtggtgactccagttctcaggctcattaactacaataggtctacattcatctgatttgcagttcaagcttccagataggtttgattgcataacaaagaaggggtgaacaaaaccgagcctcttacctgtagccaaaaccgcatattgtgttgagaaatttacataattaagaaatgaaggattttatctgtgagacaatgaggaatccactgaaggattttaagcaggaaaggaacctcattagattgctttatagcagaataactatggttgattgaaaggcagagtggtgactggaaatcttgagtgtaggttgacctctttgagagtttgttcaaatatttattgagcatccaccaaatgctgtgcacatcttggaaggcaggaaccttctttgtcttattcactgctctgtcttcagcacctagcacaggattggatgtttgggaggtcctcaataagcatttgttggtggaatggatggaatgcacatttgtgttgcatctggcactgtgctaggcccttaacatacattctttattctggacaccattttatgaattagaaaactgaggcttaagaggtttttattttgctcaaagtcaaaaagccggtgtgacagaagtggcagggctgaggtttctatcttgattctttccatcccacagggatgattaagagcacaggctgaagagtctgactgagctgagtttaaattaaaattctaccacttccaagctgagtgacctttaaaaatttatttgaacctctctacccaagtgtcttctatggagtttgtaactgcccatcgggttcgccttgcctgctgcccagataaagccgatttatcaagacaggggaattgcaatagagaaagagtttaattcatgcagagctggctaagtgggagatgagttttattactcaaattggtctccctgaaaatgtggagactgggttttttttttaaggataatttggcagatgggggctaggatagtggggagtactgatgggtttggtcggagttgaaatcatagggggtcaaagtgggttcttcttgctgtcttctgttcctgggtgagccaggactggttgagccagattatcagtctgggtggctccagctggtgcatcagaatgcagggtctgaaagatatctcaaccaccaatcttaggttttacaatagtgattttatccctaggagcaattggagaggttcaaatcttatggcctctggttgcataactcctaaacaataatttctaatcttgaggctaatttgttagtcttacaaaggcagtctggtccccaagcaagaagggggtttatttcaagaaagggttgttatcatctttgttttaaagttaaaatataaactaagttcctctaaaagttagtttggtctttgccgaggaatgaacaaggacagcgtggaggatagaagcaagacggagtcagttaggtcaaatctctttcactgtcataatttttgcaaaggtggtttcaagttttggtgaagattaaatgagataaggtttgtgtggcactgagcacactgtctggtgcataataagcctccaaatattagtgattattagcattgttattatccatgctagcaataccaaggacatggttgtaggagtagaatcccagagtagagatggtggttatggaagtcaggtaggatgaggaatgaggctagcaagtagtggatgggtcatcctcattccacaaggcaataggagatagatgtggacaagaagactgagtcaggagctggctttctaagtgaatattggagaatgaggaggagattggtagacaatagtgagaaaggacagaagttattgtaggtgactctcatcatccttaaaggaggaggaatggattctacatgactttggaaatggagtcgtctggaggaatgatagggagatgtagccaggcaaccctggctctcagtactctatgggagcatgagagctacagggagaattccaagaagtagatttccggtccccatatgtaaaaatctttcaacagcatacattaattcagcaaatagccatgaagcacgtagcataggccaggcactgttctaggcactagggatacaacagtgaataaaacagtcaaggctccctgccttcatggagcttacatttatttttagataggatttggcagaatgtaaggcccaagtaatacatgcaggccttgatagttccagagagtattaatccaaaatagtttctgttcattccaaagtcttaaagccaacattttaaagcaaaaatttgggtggagtgtgtgacgcgggaaggatttggggcttttttcttaatgttctcagactgtttctaaaccagatctatttaggggaatcttataaactgtgctttcaaaatctttttagtcatgtgtttgagagttctgggtatgtagacaacagacctcattgaggctgcagccccttgttcaattatgtatctcctctacctgagaataataactgcctgcccagacatctgggttctatggttctaaatctgaacactaagtacagtcatgtatcacttaacgatggggatatgttctgagaaatgccttggtggttatttcgtcactgtacaaacatcgtagaggtactcacacaaaccaagatggtacagcctactgtacacctaggctgtgtggtatactgattgctcctaggctacaaacctgtacagcattctgtggtctgaatactgtaggcaattctaacacagttaagtattcgtatatcaaaacatacctaaacatagaaaaggtacagtaaaaatacagtatggtaatcttacaggaccaccattgtatgtgtggtatgtcatagactgaaatgttatgtggtgcgtgactctaccaaaaaaaaatgaaactgcattatgcagttcataactatacaaaaaaagatgcaacaggaatcaggtcactggaaactggaagtgatggaaaacatgtaaatcaaaaagtctttggagggtgaagagcaaacagatcagaaagttaatgtgaatagaggcaaagaatatctgcctgctatgtaagaatgtctttttttttttttttttttttttttttttttttttttttgagacaaggtcttcctctgttgcccaggctagaatgcagtggcatggtcatagctcactgcagcctccacctcccaggctcaagcaatccttccacctcagcctcctgaatagctgggatgacaagagtgtactagcacacctagctaaaaattttaattttttgtagatacagggtctccctctgttgcctaggctggtcttcaactcctaggctcaagcgatcctcccgccttggcccttccagtgtgctgggattacaggcatgaactaccatgcccagccaagaatggcttttggaaattcttcctttaaaaaactcactcttcatctatgttaaaattctatggtatttcattgcccagcatgtagaatacagggagaagctggtggaatattatcaaatgtatttaaacatgtgacaacgttttacttagcttccaattactagtagacttcagagggcagaaggttgccagcttattcatctggtcattacttatcttgaccaaaagcccacgagaatatatactgaaagaataaagctttcattaccatttaatgtttttccttaaagcctcattttaatactgtgaaaccagatttcagagaatgtcataattaagatttttataaaaagaaacctttaatactatttaaacatataatgactcccagtgctacctgaattcattcacatcataaaccaactaaaatgggctttaatctgtatggtgaccatgctgcctttacttaaccttaatataccactatcaagaccaatttatgagccacactaaaataattatcattgttttattataatctcaccttattaaccagaaatgttaatctggttaatcatctaccatattcaccagactgaataattggcagttcttttaaaaaatcaaatttatcctggaaagaggagtatttgccaactcaaggatgttttaaagaatgtgctagggactcatggccactctaaaagaggagttccagaaatgttgaagcattttgggaataactgtatagtcttccaggtcttctactttgaagagagatgacttagatggatagatttttatatacctttgggattcctcagattactttgtagtcacaagtcagattgagttttgactggagcaggtcatttggcaactatttgatagaaaaatatttaatagtatttatcagaaagagaatgtcttggcagatctctgaggcttgtgtgtaggtgttctcaggaatcctcccagggaacctgctcttgtgggttccttgggaatgatttcaggtgagcagcaggagcccttaaggccaaagagactgaaatgcattaagtaggctggagtcagatgacgcgccacagtcaccatctcctgacagtggacaagtcactctctagaacctattttcctaatctatcaaatgatggagttggactgaacaagggctgcatttctttctgggattttctggaaatggggattatatccatgctttcgttggagattttattttaactaaggatgctgaatgctgaaggagaggaatgttgtctacaaacaaaatttttttatcataaaagtaattcatactttgtgtaaaaaattacaacaatgcagaagtgtataaagcagaaagtaaaaacctcttcccttaactcagcactcaggttaattgttctctgtctcctgaacaggacattcaggctcgcactagccatctttgagggagtagttaagattctaaatcctttcctatgttttaatggttcttacaattggtgagatagaagagtaacatttgtggaagtctttttttttccttctaaaaaggaaattcagatcatctagcccaatttataaatccatatgaagaagttaagttccaatacttgaaaataacttagagtaatataaaaattgcaaaagacaaaagaaaatatattaaaatgttaattaatagcagttttacagaggtgacaggattttggggtgttgtttttttctgttcttcttccttgactgaggcaatacattttgtgttacttgtataataaaaaagtagatttacataccagaatggttgattggcttcaaaccaaacagtccaataactgacgcattaaatctttattgactaaacagcttaaaaaattactactatttccttttatttgttgttgtgaattttactcagaattaaagataaatgattagtaattacaggaaaactaacttgtaaaaatcttaaagacattgaatgggttaatgtactgagcagctacggaatgcaaggcactgtaggagtagggtgagtatactccccacaagggctcagggtcaggcaggggaggtgagataaaaacccacagccatacactagctggcctgtcctgagggttgtgaggcacaaaatgctaggagactagagaagtaagaaatgtcttgacatgaggagaaatcaaggaaagcatggttttagaacatgtgtgggatgttttttgtatcgagactgaagaggctttttaaagtggagggaaggcaaactgaggcatagagatgccaataccaggtcttgtcaggaagaacagagtccaatttggctgcaggatagggcatatgtaggggaggggataagactggcatgggggcagagggggacttgaatgtcaggtgacagagtcaaagcttgcactcaagtaggtgattgataggtgatcttgggggcttttgagcaggaagagtgataaatcaacattggcttaggacaatccctttggctttggcgaaattgtgactcaggtaagggacagttgggggagacaaggatgggaagatgcatgataaatgggccctgagcttggcaggcaacaggaaggcagtgcaatgttttgtagaaatagacttagcagagcaggcgcccagcattcagcgagaccacagattcttagccactgtatgacttgaaggtgatactaactcccctgaacctgtctcatctacaaaatgggcatagtagcacctatgtcatagggttgctttatggcaggtaattattcttgtaaagcatttagcacagctctgatgacacatggggaatgctcagtaaatattaatgtcactaattccagtcaattccattaactggaattaattagttggagttaggaaggaaacaggtgtcagctgggtcgactgaaggaagcagagatctcaggaagcagtacatggtggtacagtgggagcatggcatctgtgggggagactgtctgcagtgggatcccacctctattgctggccagctgtgatcttgtacaggatacttaacccctttctagctcagtttctttagctgtaaagccagcgcaatgttaccatggagctggtatgtgaaagcaatgcatgttaagtgtgtagtatgtgcctgatacattgttagtgcccagtaaatgttagttatcaggtgaggggtgggatgtggggttgagtagatttgcctcgtccactcatagaggcaggatgtgcaaggaggggtggagacatgcagcaagggattgggcatgaaggttttctccaggcccggggagaacactcggcctggagatattcaggagtccctggcccagaggagattacaactctgcagggatatgagccacgagtggagtgtagacataggcctaaggaagcaatcagacacttccagaatagaggacatttgctaagacagctggcctggatgcttcaaaaagtatcatgggaaaatatgttggggttgttgtagactgaaagtgactagagttgaaaccaaaagaatgtatgaaccttgatgggacctggttgttgtcgttgtttttaaagacaaacattctggagacaattgttgaatactgattaagggctctgtattagaggctataaagaagttactgtttatatttttaggcatgatcatcttaatgtaatcatgtagaacggtgtctttgtgctcaggaaatctatgtggtaatactcaggggtcgaaatgtcattctatgtacacatgcatggggtggagagaatagtaaatctggcaaaatgttaacaactattcaatccaagtggagagtatgtatctgagtattcattgtgctagcctttcaactttttctggatgtgtggaatttttcaatataaaaaaataagaaaaaaaagaggcctatggaaaaactgggaaccagtatgcaacaggaaaaggaattctttgaaggaaaaacaggatccacctaccaagagagcaatttcaagggagagattaagcaaaatgaaggctgcaaatagatcatcatatttggtcactgggagattgtggcagcttggaaatagtctggtgaagcatagaaaactgacatgcaccctagaacttaaagtattatatatacatatatatatatatatatatatgtatatgtatatatgtatatatatatgtatatatgtatatatatatgtatatatgtatatatatatgtatatatgtatatatatatataatatatacacacataaagaaaaaaagaaaagaaaactgacccagagtgagggagtaaaaactggggaggaaggataggcagccaggacttgttggcccttctgggttaagtctttcttttcagtaagaaagggagactgcacattgctgaggaagaagagcctgggggaaagggagggactgagacagcgaaagggggaatactacaggaggaaagacccagtaaacgtgggagaggaatgggatggaaaatgacaggtagatgtggccttaagcggagggatgctttccccttcagcccagaggtgagcactatgacgacatgtggggaagaagccctcttcctagtgacaaggggatgaggtgatgtcttgctaaggtggcagatgtgaggcctgaaagtggacatatgtgccacacttgtcattaggtctgaagcaagggaaggatggccgaggggagacagagtgcacctggtattggttgaataatatgggcagtaaaaaagcgggctctgggactgccccgatgagggctagagatgatgcgggtctacagcagtcatggaaactagaggggacgtccctcacccacccttcagaacttggtgttgggcagattatgcattaggaactcttttttttttttttttgggtaaaaagctttctcatttccacgcaccctccaccttgggctgctgggtgtataggcacatggtgtgataagtctttggtatggaatgaagctctatcctttcaaagtcaccaggttcgggttcccagccctaagtggccatggcactgggtggtctgggttcacggggctcctggagctctcgggtgtcccgtgtgccaccccaattccttgcgtgcatgcccacgaaaggccgcccaggcacccccggtgaccccatggaagtgagttttggttctgctctggcttcgaagtgcttctcaagctgaagccttagggtgtggaagatcctacagttagctggagcttccgagtgagtagcggctgcgggcctggcttcggttacggcttcggtcccagcggggtctgaaggcattggcattggacggagaagcgctgtcctggggtggggaagtggccacacccctacaggaggacctttgtgatgacgcagccgtccctgtcaccctcggggtcgtccttgagcggcggcggcgcagcgggggcccagcccagggcgccctcacggcggctcacatcccgcagccgcgcctgcagcgcctcccgctcggcctgcagttcccggcgcgcctgggccgcggcgcgctcttcctcctgcagcgccctccgcctccgctccagggcgcgctcgccctgctccacggccagctcgcgccgctccagctcccgctcccgccggctgccgcgcacggccagcgcgcccatctgttccagcaggcgcgcccagtcgccctcgggggccgcagcggggccgggcggcggcgggcagggcgcggcaggtggggagctcccggcgccgctgctctccagctcccgccggtgcgcgctcctcaggtgcctccacaacgccgaggtccccgcgtggaagcccgggccgcggcccacctgctccccgcacagacggcaggtggcccagtggcccgacggatgcccggggcgccccggcgccaggtggaagtagccccaggcctcggagtatggcgcccccaggcggccgggaggcgtcggcgtcggcgccggccccagtcccggacactgaccgccccgcgccgccgcgtcgtccagcccgcgggcctggtccatggtgcaggccggctcgccactcctcattctgcggcgcccgcacgctggggagcaggggaagaataataatgagtgttaggatcacgcacacagctcctagactacagttagcctaagaaaccatgccgccctccattttcttaccgatgaaaagcctatagtgtgtgtagatagtctaagtttctttctaattaatcttcagtattaagtgttgattcctcagaaaaaactgttaaaaatatctagcccttcctatactaggaatcctctttgaaatcaagtgggtccccagtcaacaagtatttattctaatagcgggaggctaagctgcttgaacagaaagaactagctaactccgtgctgtgtctgtattagctttaactagtctctgctttcttaataacaacaacgacaacaataaaaaaggtactgtcttcagaataacagctaggctcccttatgcagtcttctctgggtgctgcacagcacacttgagcaatgaccagaaaagacagctttgggaatgaaaattttgtttcttaaacttcaggagtggaagagccagtggtgaacagccttttaaaaagctttcaaagactgtatgtttttcaagataaaaatatgtttttgtgattataaaaacaatctacttatgagaaaatcggcagtactgaaagcaatgcttttaagatatgcacatttaggaaatagcaatatccaaagcagcattctaaatttttacctttaaattagacagtgggtaatttcccaaggattctggggtccctgtcattgcctcagggtttccaaccatctcaggtgggtagaaacaatgcatgcaacacgattcctgagttctgaagaaccatcagcagtgctaggagtaaattcagaggacaggcaggccagtgaaagaaatgcattcaaaccaccttaaagacagatactagaaatactgagcagcgccatgccctggttcactttttctaaccctttcatagatacccaaggcataaaacaaataaaattagttttctttattgtttgtgctaactaaaagatcccctctacatatttgcaagatacaaagtttgctcaatacttttaattaaggaagaaaaagaaataaaataacgtcttgctttgttcaacacaaaatctgttaaaaggatccaaacataatgcaatgtcattgcacagtcttttttattaggaaactaattcactactgcaataacctattaaagaaaagggaatacagaaaaaggtgaagtttattagttaggaaataagttcacaaaggaccaaatgtgtgattctagataaatttgctttgaaagttgaaaaacaatgagaagaaaacacatgacagacttcttgagctcttctgagaacttagggagaaaatcaagggcaaggtgagacccaggcacagtgagatcaatgctgctcatactgtcagattttgaaccagcagccatggagatgacaaagttccagaatctttcttgttaaacacaactgggaaaaactgaagacaaagatgagaataggaaaaataagctgctatagttacagtagcatttagtgtaaactatgaattcagttgctaatagtcttgttgcagatgcactgtacttttctaaacctaagtattctttttcccaccaagcaagtccactccggatcaggtatgacatttaacatatcatttttttaaaaagataacaaatataccagaatcatcaaaaaagacaagtaccatgcgtcttctaacaaagaaatggctatttacatgtcttctgatacacaggcattgatttaaatatggtcactcatgataaagaccaattagcatagaaaatctttagaaattaaaggctacattttcccccaagagatgtattacattgctaaagtctcaaaagtgggggaaagtaggatgaggagttacagaccaccttcaagaatagtgtttttatggccagtaaatattatggttatataacattatggttgctaaacagagtaagatttaagtgttataaacatttttaattatctaactttacctaaaatttttcctatacttttttcttttttaaaatttctatttccttctatattgaatctgatctttcctgaggtccttttttattactggacaaacacaaaagtgcagagactattataatgaatctttacgactaatttactttataaattaaaagggatgtaaacgtttcctataacatcaagagtattgctttgcattctgatatgctttcttgagccaaagcttggaaactgcacataaacccgcagattctcttacttgtgccaaagtctgagagtcatccttactgatgtgcccctgatagtgccagaggtgactgattactgtcatgctttttacctctctgggtttccttaaaaactggaatgcccagagggagtgtcgcacaggtgaatgccatctgttaggagttaaagtgggcacaaggatgagaagcactgacttcgatgtcttaatccttttgacctagtggaagcctcacctgagccagggacaggctgcatcacaaatgtcggccagcacagcgctgcccctccaagggtggcaaggggacatcctctgcctgggcagcccttcgattttggaggtcttaaccggtggaaggcagcacggggcaaaactgcctcaccttctcagtcctccacatcatgcggctatattctagctcaatacaatcctcagtctcagtatctgctgagtgaccagcagtctatggccacaggccgtaacagcctggttagctgagcaaactatcacaaggacagaaaaccaaacaccgcatgttctcattcataggtgggaattgagcaatgagaacacgtggacacagggtggggaacatcacacacaggggcctgtcgtggggtggcgtgggagggatagcattaggagatatacctaatgtaaatgacgagttaacgggtgcagcacaccaacatggcacatgtatacatatgtaacaaacctgcacgttgtgcacatgtaccctagaacttaaagtataaacaaaaaacaaaaaactcgagtgcatttcagctgcccctgcaatgtggagggggagaaacctcttcagacacttcagccacaaccgtaacacacaaagagctcttcaaacacaataaaaagacaaaaagaccgacagaaaaacagacgagaaatatgagtaggcaaatgacctaacagctccactggccaggaaatttatgaaaaggtgcacaacatcacttatattcagggaaatgctattaaagtagcaataaggtatcgttttacatccatcacaccaagaaacattaagaggtctaacagccaaagttacaagggaggtagagaaaaggcacactcctcaattactagtgaagatgggatggattttaggaaagcattctggccatttcttttctttctttcttttttttttttttttaattttttttaagacagggtcttgctctgtcacccaggctggagtgcagtggcacaatcatggctcactgcaacctctgcttcccaggctcaagaagtgatcctcccacctcagcctccaaagtagctgggactacaggtgcatgccaccatgcttggctaatttttgtattttttgtagagacagggtctctgttgcccaggctggtcttccttgaacacctgggctcaagtgatacacctgcctcggcctcccaaagtgctgggattacagtcgtgagcatacccaatgagaatgcatgtcattaattctgtggttagctaataagaagaaaatgaaaagtaagagatccctcaatttttccttgaacattttttaaaactaacacaaaggtgccaatgaatttgagtattttgcttacatccatccactccatccaactctcattcaaatgctcattgtgcacctgctaaggtcaggtgcgtgctttctgccaagcattccaagaggaatgtcacatagtctctgccctcaggaagcgtaccatctggtggggaaagagatgcttccaacaattctgatacctgtgtgatagggccagctgcaatttctatattaattaaaaatagaggctgggctcggtggctcacgcctgtaatcccaacactttgggagttccaagcaggtggatcacctgaggtcaggagttcgagaccagcttggccaacatggtgaaaccctgtctctactaaaaatacaaaaattagctgggcatggtggcgggtgcctataatcccagctacttgggaggctgaggcaggagaatggcttgatcctgggaggtggagattgcagtgagccgagatagcaccattgcattccagcctgggtgacaacagcgaaatgctgtattgaaaaaaaaaaaaaaaagataacctgagattctactcctggggatctcttctatagaactatcagcaccaataaacacagtcttgtatcaggatgttcacgtagaatgacatcagaatctacatcagaatcatgtagaatgacaagaaactggaagcaagggaatgcctaccaccaggaaaatggctgagtatataacatatgttcataccagggaatattatacagccattaaagaggaaaaggatgaagttctgttcaatgtcttacaaggatatctggaggaactgttcagggagaaaagagagatgcagaagagtgtataatatgatcccactattattaagtaatatacatatctgtagaggcaatatatagctatagatgaagaaaaataaggagatactatggttgaggcaatggtaactgatgtgaaaggagggagaaggggaagaggtaaacacaaaagtaaaagcaatgaggtactaagaaagcatgcatgtgatcacgtgtatacatttagggaaagtgtgtatatcacaggatctctacataaataaaaaataattttataaaacaacccttgggcctgggtgtggtggctcacacctgtaatcccagccctttgggaggccaaggcaggtagatcacctgaggtcaggagttcaagaccagcctggccaacatggtgaaaccccgtctctactaaaaatacaaaaaattagctaggcgtggtggtgggtgcctgtagtcccagctactcgggaggctgaggcaggagaatcgcttgaacctgggaggcggaggttgcagtgagccgagattgcacgattgtactccagcctgggtagtaagagcgaaactccatctcagaaaaacaaaaaacaaaaacaaaaaagcaaaacaacccttggctcctcaagcatgtgagctcaggcagggccagcccagccttaactgtggaggctggtgggacagtcccatggggaagcccactgctgcgccgcttggaggaggaaacccagcatgtgaggctgctcattgtcacgtggtttgctgtgctctgcagaaggagattctgtgttcacacccaggatgtcatggaagaggagctcatcccattcatctccctggcacagggtagacacttgggggatgctgcattaagtgaagtgaacctgactctgtttctttagccccagcccacccgagtctcaatcttcccatctgtcaagagaaataataagattatttgcctctaaacaggtggctgagatcatagatagtgcaaatgatgtcactgttggactctccggtgttatataaatttaagacatgaacaataaagaaactaccgatatttactgctcagacatgcccacgttaagattttaatggctaaaaggcagttgtttttccatctgacattatgttattcaacagagtaagtagtctaagttggaggaatccccttgggaattgactacaaagagcaaataaaaaagagtaacagatccaagacccttaccccttaaatttattttcacttcctaaattgaacttcatgcaaaataggttatttatcactagggtaaaataagataatggggaggtttaattagccaaagccctgtgataacgcgtttcttccttaccaaatacccaatgagaatgcatatcattaattctgtggttagctaataagaaaatgaaaaaagctcccttaatttttccttgaaaaaatttttaaactaacacaaagatgccaatgaatgagtattttgcttacatccattcactccatccaactctcattcaaatgctcattgtgcacctgctaaggtcaggtgcgtgctttctgccaagcattccaagaggaacgtcacatagtctttgccctcaggaagcgtacggtctggttgggaaagagatgcttccaacaataattctgatacctgtgtgatatggtttggctgtgtccccacccaaatctcatcctgaatcctactcccataattcccacgtgttgtgggatggaactggtgagagataattgaatcacgagcgcggtttctcccatactgttcttgtgctagtgaataaatctcacgagatctgatggttttataaacgagaagcccttttcgcttgaccctcattatagctcatgccgcagccaggtaagaagtgcctttcgccttccgccttccgccatgactgttaggcctccctagccacgtggaactttaagtccattaaacgtctttcttttataaattgcccagtcttgggtatgtctttatcagcagcgcgaaaacagattactaacacactgtggtaaaggtgaaatcagtgctcactccttcgggtgaattccgtcacataatctccactggggaaggggtgggcatgggcagctcctgggagctgatgtcttaggggccctaacacaaaagttcatgcagttcagcatcccttcccctcccatgccccacagggcacaaacgcattgttgtccatcaccaaaacacattacccttagtactcgactctaatgaagttccagttcctcagttgtataacgaggcttccaagctcctattttaaaagaaagtttcttgaagctaaataaaagcactgctaacatgaaattaacagtggaaatttttgagtgtaatttcagggtgaaaaaaactgaaaagacaaatgtagattttagatatttcaaggaaggagagagagtagtgttgctggtaccatgcctctgcacttgctatagctgagtttcatttgagtatccattatttggaaggagttcttaaatctaagcctgtggaagacaataaattcacattaattatctctccatttgactcaatttctgaagaagttctatccttctgatgaactatcagattaaatcccagattcctcagtatgatgtccctgaataccaatataaagaataaaggaagagatcaaaacctggatgaataatctgtataaacatgggcatatacacaaggtatgactataatattgagactcatcctataaagcacctacaaaagttgattgtattattttatacttatgcttgtgcacataaaaaatatttggcaggctaaaggccaaagaaccaggcactgttctcaaaaggacatagcagattaactacacctctatttgtccttctatactcaaggctacttactgtagttgggttgaccaggcagagtttaaatcaatatatgttggttgagcctggatcttagatgagaaattcacactaacgtgaaattcacacagacatatgtggaaacactaaaaacattttcttttacttcatccaccagtgactttaatgaaagcagagcataataattaatacaagtaattagagttgacaactgaagtgtcaagaaaaccacagttcatctgttatccgtccatctctgttgaaatattagtttactgccatatattaatctatttataaagagatccagacaattagaaaaattagtctggaatcaccaggctgaaggcttagctgaagttaaaagacaagtaaaaatgcctccaaactgtaaaacctgagttggggaataaatggtaaaatgtgtaaaaatttagaaaaaggttatatgtggactgtaaaaaatacactggactcacaggtaattaaggggtgaatcagagttgtttcctaaatggcataagccaaactcttagatatttctaccattagctaaaaggcagagaagcactctctctctctattaatgcacttttaaaaatgaaaattgtgaagtgttctgcccttaaagtggacctttatttcaggtctgcattactttgcttaatagatatggtcctaaagattaaggtggtgatccattttatcttgtaaaaatgcataatttaatctgagttataggaatttaaagctgccctactttgaaggcctttgtgactcaaagatttttttaatttaatttttaaattgagaattacctggcttgggcttttggtctttttataatacgtattgctgtctacttttttttttattcttggctgcctcaagctattcttgcctccaaaaggtgtcagcatatgaataaaaacagcagaaaataattaccctaattaggtcaatgtattaagctgtttctacaactgtttctcttaaacaccttatctttgtagtcttggctcattagaaattcgactagtggtaagtatttatttttttccttcaagggggtttttgctttgctaagcctcgggcatttggttcgtgcaagaaatcacagaaactgctccagcggactccgaaaggagcggaaaattcttttgtttgggggccatgaggggtgggggaggggtggggattctggtgtaagcttttggcttgcattcgctttctccctccgaaagtgggcgacatcaagcaagtcccagttacagaaagaacccactgcagggcgtccagtcacttgcccagtgaaaagactgtaatcagacaactttaataaagggagagcaggagagtggtgacgaatttccacattccgaacaagcttgtcgaaagaggagtgcagggaaggagcaagaatgaggcactggaagacggtgagcggggccttgccacagaatcccgggcccacctgctttctcacagtcgcgacagccggcccggagaagggcagcccagcgaagggcacgccccgcgcgggtgccagggaggccggcaggggcgtccgcggtcgctgctcacctgcgctccccgctgcccggcccagcccgcctcgccaccgagtctggaagcccacactcacccctttacccgggaaacgcggccggagccggcggcgggtcgggagtccgagatggtagatccccctccaggcgcctcgctgacattttgtcccggacggaaaacctccgcgcgtgccccttaaagacacagcgctgcattcacacgtctgcggggaaaggggggccgtcacgtgtggccttcgcccgaaagcggtaggggagtcgctctgaaaccgccaaggatcgcgagcgacagatttgtgttggccagggttttaagatgacgcaatagctgagtgtggttgaaatgtaactattgttttacaactttgcattaaccttccaagacctgaattcccgggcctgagtctcagagcgcggtttgcatctttgcaggctgtaggcgcatgatgtcacaagttattggaagaaatccctccaacctaggttgggacagatgaaggcggcgcttattggtgttcaccaaaacaccagcatggtgtaccagctttggctagatgatgctcaggtaacgaacaacccctgcaactcagtggcttaaaggtccatttctcaagcgaattactgtggctgcagggagctttggcagtactccaccagttttcttcactccaggctgaaaggtcaacttttctgggccatgctccctgctgggctggtaaaccaactttgagggagaagggggaagtccagatatgtagtgtttgctatttctatgatgtaaatgctcccacaatggccgatttcaagctacaaacagtccaacaagtggcttgccaagttcctggaaatttaacaattagctcctgtacatgactggcacaagctgctttccaaactcacattccgcatgcctcagttctgctcactttctattggtcaaaacttgctgtcagtgggtggggaagtgtacccctctcttaaggaagccttgcaagtcttgtgacaatgaaacaggagagttccctgatttcctcccggcccccgccctcccacagccctttgcaggacgtgcaacagggttgtggctcgtgtgttcggtctctgcctgctgaaaccccttatgggaggtggagcatgcagacggacgggtgcaggagccagggtgcaaaagctggggcgctgggcttccagccccacggcagtgtccaggggcaggatcccgtgattcccggagcccaaatgggcgtgtgttacagtgtgctcttttagccttaccatcagctgacggcttaagtgttaaccagctcaatagaccctctgcctttttgcaagcgcagagggtcagtgtgacagtttctgtatctcagctcttgtctcacctcccagaagaatcaggtcacacatggacttgaaggatggtgagtgccggggtgggggcgggggtagaggagttgggggaaggttgggggtgtttattaggtggtaggggtggcactcagtaggatggatggggagctggaaagggggtggagtagggagatgatcttcccctggagtttaaccgtccagcggtggattctctaactgtccccagctgaactccacccaatattccttctcttttctctttatctgcggctcttctgctcttctgctcttctgttcatctgctcatcttttgctgctggagcctggtgtctggagtttatacgggtacaggatagggggtcatggagggccaaaaggtaacttttgggcacaagaacgggaatgcctctcttcatttagggccatgggtttccaggcttgagggtggggcctttgccagggaacggccttattctacccagtagttccctgtctactgtccctatcaacaataagtgagctgaataatatccttaaaagaagaacaagaaataactgggtacaataatacaatccaccattccaataatggttttggaggaagaaactggttgggtatcttcaaaggcagaggtccccaaccccgggccatgaaccagtaccctttgtaccctgttaggaacctggtggcacagcaggagttgagtaaggggcaagcaaatgagggaagcttcatctgtatttacatccgctccccatgactagcattgccgcctgagctccacctcctgtcacatcagctggggcattagattctcataggagcacaattgtgaactgtgcacattcaagggatctaggttgtgtgccccttgtgagaatctaatgcctgatgatctgtcactatctcctgtcacccccagacgggcctgtctaattgcaggaaaacaaactcagggctcccactgattctacattacggtgagttgtataactatttcattatatattacaatgtaataataatagaaataaagtgcacaataaatatgatgcgcttgaatcatcccaaacctattccccacccctgtccatggaaaaattgtcttccacgaaaccagtccctggtgccaaaaaggttggggattgctgttcaaagggataattttgcaatgtgaaggccaactattaggttactacttttcttctggcccaaaggacacttacagctacggacatctgataaaaagaaaagtaatgagtacactgttggtgggaatgtatagccatacacccattatggaaaacagtatggcggcttctcagaaaactaaagatagaactatcatatgatccatcaattccaccactggttatttatccaaaggaaaggaaatcagtgtatcaaagggattcttgtactcccgtttatagccacactattcacaatagccaagatacaaaatcaaccaaagtctatcaacagatcagtaaagaaaatatgatatatatacacaatggaacactattcagccataaaaaagaatgaaatcctgtcatttgcagcaacatgcagggaactagaggccatcttgttaagtgaaataaatcagacacagaaaggcaaaaatcacatgttcacactcatatgtgggagctaaagaagttgatctcatggaggtagagagcagaagggtgtagaggtgggggagtgaagacaggttggtgaatgggtacaagcaaacagataagatggaataagttctagtttttgataacacggaagggtgactgtatttccaaagagaagatttttttctttttttcttttttttgagacggagtcttgctctgtcgcccaggctggagtgcagtggcacgatctcggctcactgcaagctccgcctcccgggagcttgtgtggagctagtgtttttattcatgccattctcctgcctcagccttctgagtagctgggactaagggaactacaggcgcccgccaccacacccattaatttttttgtatttttagtagagacggggtttcactgtgttagccagtatggtctcgatctcctgaccttgtgatacacccgcctcaacctcccaaagtgctgggattacaggcgtgagccaccgcacccagccgaagagaagattttttttctatgagtttgactttaatttctaagattccacatatatatgagatcatgcagtatttgtctttctgtgtctggcttatttcacttagcatactcttctctaagacatccatgttgttgcaaatggtaagagttcctttttctttaaggctgaataatatccgtgtgtgtgtgtgtgtgtatgtgtgaatacacaccacagtttctttttttattcatcagttgatggacacttagattgttaccatatcttttggcttctgtaaataatgctgcaattaacatgggactgcagatacttcttggagatagtatttttatttcttttggaaatatacccaatagtagtattagtggatcatatggtagttctatttttaattttttgaggaacctctctatactattttcaataatggctgcaccaattgacatttccaccaatagggtacaagcatccccatttctctaatcttcaccaatacttgctgtcttttgactttttgataatagtcatcctaacaggtgtgaggtgatgtcattttgacttgcaatttctctgctaattagtgatgtcgagtagaagagaagatttaaaatgttcccaatacaaagaaatgataaatgttcaaggtgatgggtatcctgataaccctgacgatcattacacattgtatgcatgcatcaaaatatcccatgcaccccataaatacatacaaatatttcgtatcaataaaaaaatgaaaaagaaaagtaactagtataaatggccaggtgcagtggctcacgcctgtaatcccagcattttgggaggcccaggcgagtggatcacctgaggtcaggagttcaagaccagcctgaccaacatggtgaaaccccatctctactagaaaaatacaaaaattagccgggtgtggtggtgggtccctataagcccagctacctgggagcctgaggcgggagaattgcttgaacccggaggcggaggttgcagcgagccgagatcgtgcaactgcactccagactgggcgacagagtgagactctgtctgaaaaataataataaaataaaataaataaataaaaaagaaaagtaactagtataaacaaatcaggttaaagtcatctctaattcatgtttcaatatttgaacaattttttacagtttattgtatctggtaattcttttaagaagaagctttattgctttgagtgtctaaaagaatccatttaactttaaactgaccacgtaatgagatacatgatattttcattagttcatagaggagtttttagtaagtgctggttatgggcaaagcaccatcttaagcctaagcaggagtctggagactattcctgccctcaagaggattacactccagtatgacagtaagacatatgcaactctaagaagaaagtgaaaaattatataagaggaaatattcaagtgccataataaattgagaatggctacatatttttgaaagtggcagcatttaatcaaggcttgaaaaagagtaggatttggattcctggcattatatgtttattatcttaacaagatgtattttttatttatttttaaagtcagataaaaggagcttagcttttttgtgagtcagtgcttaaattttcttaaattttgtgagtcaatgcttaaatttaataattttctaaattcttaaattttcgtgtaatcagaaatctctttcttgtgttaaatttaaaatcaaactacaaaatatgtctcaaatatctaataacttttcttctttgccctacatcctttgttcaagtttcagcaaaaaaaaacaaccttcagttcttgctttcttggtagtggcagttcccctaactttcatcacgcgtgtaaccataaataaataacatttaattttcacaggaggatctcatttctgtaccctgccctggaagttggcaaaaagtaaggacctgcatttcattggaaatacagaatatttactctccctattctcttcagaaattacagccttgaaatctgctatcagaaacccactttgaggctgggcccagtgcagcggctcacacctgtaatcccagcactttgggaggccaaagcaggcggattacttgagcccaggagttcgagaccagcctggacgacatggtgaaatcacctcttaaaaaaaaaatacaaaaatcaccccagcatggtagcacacatctgtggtcccagctactcaggaggctgaggtgggagcattgtttgagctcaggagatgaaggctgcagtgagacctgatcacatacaccaatacactccagcctgggtgatggagtgagatcctgtctcaaaaccaaacccagtttgagaaaaatatttatcaagattgtctcaaagacatgcaattatggagctgtgtcctttggaccacactgttctggtgcatcccagatgtgcttttgatctgtaggtttctttcttgggctgtttttatcttgtttttggtataagagtaatgctagcctcataaagtgagttggcaagtgcttttttctatttttgaaagagtttgtgaagaattgctattaatttttctttaaatgtttggtagattcaacaatgaagccatctggacccaggctttgatttatgcataggtggttgattactaattcaatgtcttcatttattatatgtctgttcagattgtctgtttcttcttgagtcagttttggtagtttgtattttttccaggaatttgttggtttcatcaacatgatctaaggtgttggtatatactttttcatagtatagtattttttatacttttttttatttctataaggttgatggtaatgtcccctctttcctttctggttcttggatgtgcttttactaaactttgtttattctgctcttctgcacagctgatctgagcacagtggttttggcacccaatgagtagaaactttgctcaactaaaatttttcagtgagaatcgtgtgagctgacccagttgagatgtctttggtgttgggcattgtttgtgctattcatcgttgttccttttcagttagggctcaaacaagatgaatccctgtggtaatgccaactaccttcagcaaggcaccttgtaggaaacagatgcataaacttcattatcagatttagtgtcatgatgtcatctgctacagctatctactgcatcccacagtgttttctctgtaggatctagaggagacctttctctgatctctcggtgtcatgaaaagctctgcatgccctgaacaaatgggaccttttaatcccactgtggattatgtctcctgctttggccgccgggagggctgagtccaatgttgaatatctactctatcagtttcctagagctgccacaacaaagtatcacaaacagattggcttaaaacaacaggtgtttattcttccatagtcctggaggtttggttagaagtcaaaattaaggtgtcagctgggctatgttaccttcggaacctgtagggaagaatatgaggggacttcaaaaaggttgtggaaaaatggaattaaaagataaaaatgagaaatatacattttatttctcaacataaactccattaagttcaagacacttttctaagtgatgacaccagccatctagtccattcccagcatcctgggaatttagccatgtcaatgcagtctttcttacatcattaactgaagaaaaatgggtacactttacatactttttttgagagggagtctcactctgccactcaggctggggtgcagttgtgtaatcatggctcactacagcctcgacctcctgggttcaagcaatcctcccacttcagcctcccaagtagcagagacaggcaggcaccaccatgcctggttaattttgtattttgtgtagagacagagtctcaccatgttgcccaggctggtcttgaactcctgggctcaagtgatcctctcattttggcttctcaaagtcttgggattataagcatgagccactatgcctgccattttttttaaatattagtgtcttagtccattttgcattgctatctgaaaggaggtttatttgactctcagttctgcaggctgtacaagtagcatggtgtcagcatctgcttctggtgaggacctcaggaagcttccacttatgataaaaggggaaggggagcagacatcatagcaagaggagaggaaagagagagtagagggaggcaccagactctttttaacaaccagatctggagggaagtaagagtgagaactcataccccccaggtagggctttaatctatttttgagggatctgcccccatgactcacatacctcccattatgccccacctgcaacattgggaatcaaacttcagcgtgagacttggaggggacagatattcaaactatatcaattagaaaaaaaagaagtcagacagagccacgtcagctctgtaaggtagatgcctaaagattttctatgaaactctcaaaaaattgcccttgtttgatgagaggaatgagcaggagcattattgtggtagagaaatactctctctggtgaagctttcccagatgtttttttttgctaaagctttggttaactttctcaagacactctcataataagcagatgtcatcgttgtttggcccctcagaaagtcaacaggtgaaatgccttgagcatccccaaaaattgttgccaggaactttggtcttgactggtctgcttttgctttgcctgtgtaactttcttctcttgttagccattgttccgattgtgctttgtcctcaggatcatcctggtaaagccatgtttcatctcctgttccaattcttcaaagaaatgatcccattgtttattctgctcttctgcacagctgatctgagcacagtggtttcggcacccattgagtagaaactttgctcaactaaaatttttcagtgagaatcgtgtgagctgacccagttgagatgtctttggtgttgggcattgtttgtgctattcatcattgttccttttcagttagggctcaaacaagatgaattttttgcttgcaaatcgacatagatggcctaccgtgatgggcttcatcttcaacattgtctcatcccttcttacacttatccatttgtaaacatctaatttctttggggcattgtccccataaactttctgtaaagtatcgatgattttaccattcttctccccaagcttcaccacaaatttgaggttgattcttgctttagccgacttcatattgctctgatatggactcttttcaaactgaagtcttatccttcttcatgcctcaaactagaccctattcagacatgttatacaagttagtaccagcttattggtgtggaaaagcattgaaatccttgcataattttttcatgatacacatttttttttgagatggagtctcactgtgttgcgcaggctggagtgtggtggtgtgatctctgctcactgcagcctcagcctccaggttccagcaattctcccacctcagactccccagtagctgggactacaggcgcacgctaccacacccagcgaatttttgtatttttattagagacagggttttgctttgttggcaggctggtcttgaacttctgacctcaagtgatctgcctgcctcagcctcccaaagtgttgggattacaggcatgagccaccgcgctgagcatgatacacattattgatgaacttttttgaagtaccctttgtacttccttaccattccctagcttctggtggtggttggctgtcttagtccatttcatgcctactataacagaacacctgagactgggtaatttataatgaacgggcatttattagctcatagttctggaggctggtaagttccctatcaagatgccagcaatgggtgagagcattctggtttcatcatcacatggcagaaggcaaggggtaggaggagaaactcccttcatcaagccctttataattacattaatctattaatgagggtagggctctcatgactgaaacatttcccactgggctcttcctctcagcacattggggattatgtttcaacatgagttttggaggggacaaaaacatttaaaccatagcgccagcagtacctcgtgttcctcggtttgcagttgcatccctccaatcgctgcctctgtcaccacatggcattgttcctgggtgtctatgtccaaatttcccccttcttataaggataccggttatattggattaggacccaccctaatgggtgtcttaacatgattacatctgcaaacaccttatttccaggtaaggtcacactcacaagtacccagagttaggacttcaacagatcttttgcagggacacagttcaactcaaagcacctacaagtgtcacatggtcaacttctctgtgtgctaatattacccttcttatttcatcttttatttttctctattttccttttgtccctattacctagattacttagtttttccttaattatatacatctttggctggatttgaaaggaagaagacagaaaggaagggaaggaagaagagaaggagggaggaaaagagagaaggcgaaggaggaagaaaagcctgtcccctaaaattagacatgaaaccaggggaacagagttgctggaatggggagccacggtgggagagactgactgggaaagtgtttttgctgtgtgcttcatcagaacctcagaattactttttttgaggggatggatgcagtggctagcagctgcttgaagcttagctgatctaggaaaagttggaagatagtttgatgaattaagaattaggagagtaaaggtattgtccagctacttttatatgattattagtagacacaatatggattgaagttttgtggtaataggaagcttatacagtgttgaagactcatgtatcctagctgttgtggacacagacccataaatcattgatttactgcatgcaatttattctggaggacagtatctcatgtttgcagggtatcatcctccaaatatcactttagctgaaactttaataggctattccaattgtctatcagactagctgtttgtggagattttatatatctatatatatatatctatatatatatatatatatatatatacatacatatgaccagctaaagctactgtataaaccaacatttccctttccacctgttcctcatcttaacccatcacaggtaagagtcttaatcctaatactacagcacaccaagggttaccatcaacccacttaccactagaaatgaggtccttgttactatttggtgggtgaatgatcccgtaccggaattctatcctgaggtttgtaggttcagacctacaagtagctacaggtagcttctattttctagggccactctctacatgctttcttagtttggatttccctaaatgcaatggctaagacaaggcctaggatgcagataatttgagggccgactgcaggaagcaggtctaagggagcaaggagagtaatggaagaaacgtatgtcaaaataaagaggctttgcttttctaactataaatgattgtgtgtctttcaaataatgtcttcattttatactgatgatgattgtaacaaaacccattcccacatggtgaattgtttttaatgttcacctttaggctttttcagacccaccttcctctttttttttttaaaaaaaaaaaagaaagtcttgttctgtcacccagactgggatgcagtgtcataatcatggctcacttcagcctcaaactcctgcgtgccagtgattctcccacctcagcctcccaagcagctgggacttcaggcacatgccactatacccacctaatttatctatcttttgtttttttgaaggtagagacagggtctcactatgtttcccaggctggtctcaaactcctggtgtcaagtgatccttccacctcagcctcccaaaatgctgggattaaaggtgtgaaccactgtgctgggccacttctaccccattgtttaacttaacattgtcttaatctgttttgtgctgctataacagaacaccagagactgggtaattaataaaaagaagaaattgatctggcctacagttctggagccttggaagtccgagatcaaggagctgcatctggtgagagcctttttgcattatcccatggcagaggcagaagggcaagaaagaatgagagagggagagggagagggggagagagagacagaaagagagagagtgagaaagagagagagatacagtgagggagagtgcactaaatttgcttttagggcaaacccactcccacaattaatccattcaagaagagtctgcagtcacctcttaaaggtctcacctgtcaacactgttgcactggggaattaagtttctaacacataaattttggggacacattcaaaccatagccatcatcttctgccatttattattagaaaaacattaatgtatactttatgtttattttgttggttggcttttggcttggatacttatgaaatttttaaaacttatctttgagactggaaatttttactgtaattatatatgtgaagtctctttttgcttgaaacatagtgcgctaagcttggagtttatcctgaggtagttttaggcaagagagttacatggtgagaactatgttttaaatataccacctcaggcaagtatgagggatgtgtttggaaaaagtacagactagagctgagtagaccagttggactgttggaatactgtaggccagaactgagatatttttaagattcagcctgttcaatatgtagcaggaagtaataaacaagagaatagatgggagatggagttggtaagaagtaactccaatgtggtctgcggttcccatgtctcactgctgtgtgttactggcctcagtgtacttgaggaacctgagctgctgtgcagaggacagcattgctggggcatgcgactctagggagtagtgctccccagggtgaccttttcttttctttttttttttttctttgtgagacggagtcttactctgtcacccaggctggagtgcagtggtgcgatctcaactcactgcaacctccgcctcccaggttcaagcgattcctgtctcagcctcccgagtagctgggactataggtgcacgtcaccacacccagctaatttttgtatttttagtagaaacagggtttcaccatattggtcaggctggtcttgaactcctgacctctggtgatccacctgcctcagcctcccaaagtgcggggattacaggcgtgaaccacaacgcccggcccggggtgaccttttctatgtcactggaatgagaggaaaatactggttgcagaaagaaatggctcttttcctatggaaatcatcagcaaggcatttgatactgatttctatttctcagaactgttaggaagaactggtacagagatttatcccagaatttcaactccttttcaggattcattactctaccaccctgtattgttttgttgtggtttatgtacatctattcaccataaactactactactactgcctaagaatggaggaggctggcaggggatccaggcaggactcactcactgccatctcacgtttttcctctcctagggttctaggatgcctcataaaggcccgtagtgtactttctgtctacttcacttagctccgcatttgcaatttctgttaacatgcatacagttgaatggatggccaggatcaaagctatctgctgtgagacacaatgagaaatgcttttgtgtaaaggtaggagtacttttatttactgctacatcatacagggaaggtggggaggaaataaaaagaaagaaaggaaagaaaaggcaaaccaatatgaccaacagtggtacaggccttcttgttcttacctctctatcagggtccctaaatgaggcttatacttggaaaagcaaaagacagatccggtgggaggggatatggaaaagacctgggaggcaacccttgtacagagagccttgtctccagggagcactgctccactggtgcacttgttcaaagagctggcaggctgggggccgggctccctcctgcttgtttaaagggtggtatgactggttagagtggacatctggaggcttatcccaccgtgatttcaggggtctcactctccaagtatagtcagggttgatgtgacctgaccctggtgttcagacatccacacaagtttcagaagtgtttacaaactttttgccaaaggaaaaataaacttgcacaggagagctggtttagctgttttctgagacaattataaaaaacagtagtaagccccaactcccaatcatctaaaaattttttttccttttttttttttttttttttttgagataaggtctcactctgttgctcaggctggagtgccatggcataatcatagcccattgcagcctcatcctcctgggctcaagtgatcttcctgcctcagcctccctagcaggtgggaccacaggcacgcatcaccacgcctgcctgtttttttttttttttggtagaggtggggtcatgccatgttgcccaggctggtcttgaactcctgggctcaagctatcctcctgcctcagtctcccaaagtgatgggattacaggagtgagccgctgcaccaggtcaatttttttcttttgcatttcttttgcaataggagaaaagcaaaccattatctgagtatgtgtggcttggaggcacaagcagatctagggtatatcgctctgtcctcagagaaactatcagcatgctgttgcttttggtgttggctggcactactcaggatgatccagcttgcctgcttggatttatgattcagttcatccaaaatcctcctctctgcccaaccaaacctcctactcattcactgagtcatcacccttatgaaaactacttagattgcactatgttagaaggatctctccctcacctaagtttctcttgtcctccaagctagtatcgtgcatctgacacgttgtttcttagaagctagcctgctttcacagctcaactagaatgatctcggtggcaggaatgagagctcatacatttcgcccataaagcctagcacaatgctgggcaaagtattcagtgaatacttggagtgattgaaaacttgccactaaaaacatatactgtgtaggtacttacatgaggtgcttagggtagtcaaatttatagaaataaaaagcagaatggtagctgccagaggctgcggggtgggggagagatggggagtcattgtttaagaggtacagactttctgtttgtgaagatgaaaatgttctggagatgcatggtggtgatggttgcacaacaatatgaacgtacttaatgccaccaaattgtccacctaaaaaggtaaattttattttatgtgtattttgccacaataaagtttaaatttttaaaaagcctatactgtagaaatttgaggctcttccctaagtccaccctcagctgccctccctggtgcccatgtgcagaatccatatcgtgtgcgagtgaaatgtccagttggatggccgtgctggccaggccccagatactgggctcagcttcccacttggcagctccatttttgttttgaaaatggggtcatttgcaccaggcttttagtttagatttttttttgtagttcctgtctgcacaagaattgttaggaaagagtccagatctagagcaagcaaggttatagtttccctagggtaatggagaaaagcttagtgatggtgagatttcttgacatctcacagcctccaatttagtttggttttgtttttcatctgtaaaatgaagatttcaatagtccctacctccttaggttgttgtggggattaaatgaagtgagttgcatcaaataccttgcagagtacctgaggcagggcaggagctaggaagcgttgttcattatttatcaatggcagctgagaattcttggattctgtgactccagcttgggttccagaaggacagaagcagcccacagggctcctgacacagtgccttgtctatgacgtgtgatcctatgtgtaacaaaacccttgggaggcaccaggttggtggctggggaaacaatctggtctggagagtcaggggttttttggtcagactttccccactcagccagaaacccagctgccagccacgcctaggctcctgtgttccctgcggtgctctctttctttagttcacattagaaaaatcttgagaaaggacttgaagagacccgcttggctggctttctcacctgcgtggccaagatgccagcactcacttgaccacgtggtcagagtaggtcgggcagctttccatgtgaagaggagtggtgggcaaggaaaaatgaagcatccacccctcactgaactgcatgccctggccaagccagagaaaaggcagccatggccccaccgccatcttgctcttcagtgacgaatgccctatgcaccatgatatctgtttgcaaacaaaagatgccttatgttccttcttttgaaagggagtcaagcacattgatcttaaggctttccaagttagcatctaaaattatttgaccttggtttaatagggagaaattgatcaggttgtggaaatgaaaaatgaaaacgcttaatggaaaatacttgaaataaattcaaggccatattaacatttaatttacacttcctcccagaagctatttttactttcctatttactagtatgatatgcagtagttatttttctccgtgactcaacacgatgggatatttttttcctttctgcaaatacctctcaattcggatatgacacagagttcccattttccccataaattacatatttatagcacacgggaatagcaggaatgctgtatgtctcttaaaagtacttctgtatttgaattatagagaaaatgacttgatgggagtctgaactttgggcactcttgatgtagctggagcagagaggggaacagaactctgtgttccaggcccaggcactgtctgttctgaacatgagcctgccactgccaactgtgtgcatgtggggaagggtgatgagggaaggatgggcatgagcaaccaggatcaaaggtcatgtggtggtgagaacatagcttggacatcctgcatcttggattctgttctgctgtgtactagctctgaaagcttgagacagcttcttagcctttctggtccttttgctttttcctctgtaagctggcataacagaaggagttacacttagagttatgataaagatttgaataaggtaatgcatggaaagcttccacactagtgttttcattgagagagtcatcaataaaaaaaataaatgcttgtcattctagagagttctaaagcaagacaagtgtcttctgttccttgcacccttcttccccttccctttggaagcctggtggctgaggacagctaagttctttacttgggaggaagtacccttccttccccacagaaagctaagtgggatccaagagtcaagggagcatagagcaggcccctttagcctacctgtatcccaggcttcccgtagaggtttatgtggggcctatcgctcttccacacagtaaggaaccacgtgaaggcttgggagctgaagtacatgtttgccgggagggagctcagtatagtagatgttccctttataaccctgcacccagtgtgacaatgggcagtgctatggtttgaatgtttgcgtctattcaaaattcatactgaaactaaatcctcaatgcaataatagtattaagaggtgggacttttaggaggtgattaagtcataaggctccttcctcgtgaatgggattaaggcctttataaaagaggcttctcggggtcttcatctttttttccccttctgccttctgccatgtgaggactcaatgatcacccgctccagaggatgcagcaaaaaggtgccatcttggaagcagagaccagctctcaccagacgctgaatctgctggctccctgatcttggacttcccagggtccagaactctgagaaataaatttctattgtttataatgtactcagtctgtggtattttgttatagcagcaggaatggactgagagaaaagcagctagttgaggatttgagaatttgggtgtttttttggtttttggttttggtttgagtgaatctttttgcaaaacattttagacattttatgtacaataaaatgcttccattttaaatatgcatttgagtaggctttagaaatgtatacaaccatgtaaacaccttaatcaagacacagaatgttttcataaccctcaaaagttcccttgtatccagttgcagtaaatctccccttctccccacccccaggtgactcctaatctgctttctatcagtttagaaaagtttgcattttctagaattttgtatagagggaatgagtcagactttcatgtatcataatgcttttgagattcacccatattgttgcatgtatcagtggattcttccttttccttgctaagtttcattctgttatatagatatactgcaatttattgatcaattctctgttaatggacatttggattgtttctagttttggtgtattttgtataaaccgacagttcctgacttatgatggttcaactttaacataatgcgaaaacaatacacattcagtagaattcatacttcaagtacccatacaaccattctgtttttcactttcagtacattgcttaataaattatgtgagatattcaacactttattataaaataggcttgtgttagatgattttgcctcgccataagctaatttaaatgttctgagcacatttaatgtaggttaaggtaagctatgatgtctggtaggttaggtatagtaaatgcacttttgatttatgatattttcaacttacgatggctttattgggacataactccattgtaagtaagccaaggagcatctgtatattaaaaagctgctatgaacatctgtatacaagtctttttgtaaatgcatgttctgatttctttcagataaatacctggagtgggattgctagatcacatggtaaatatgtatttaaatttatgagaaactgccaaagtattttccaaagtaatagtaacattttacactcctaccaggactgtctgagagttccaggtgctccacatccttactgacacttagtattgcctgtctctttaattttggttgttctagtgggtgtgaaatggtatcttggtttagttttaatgtgcattttcctaatgcctaatggaattttccttcacctaatggctaatgaggttggggtctttccatgtgcttattagtcattcatatacctcctttagcaaagggtcttttcaattatcttgcttatatttaattggtctgccttcacagttgagttgtattagttctttatatattcaacgtacaagtcctttgttagatatatgtttgcaaatatttttttcccattctgtggtttctctttcatcttcctaatggtgtttttcaatgagcaaaaattaattttataaaagcttagtttaccaattatgtttttaatagtttgttggtcttatgctctattcaataaatatttgcctacactaaagttgccaagattttctcctaggttttcttctaggagttttatagtttttacttttacatgttgtctattatataatttgagttaattgttgagtatggtgtgaggcaagggccaatacttatatcttttgcaatgaatgtcctagcaccatttgccgaagcaccccttttcccccattgaaatggcttggcacaaaaatcacttgaccatacatgtttgggtctatttctggactgtctctgccacattgatcgcatatctatgtttttgccattatcagatcttgattgctatagttttatagaaagtattaaaattgctttggttatctaaatcattttaatttctatatagagtttagaatcagcttgtcaagttttttaaaaaaatctgctggatttttgacagggattatgttcaatctgtgagccaatttggggagaatctccatcttaacaatactgaatcttcagatccatgaatatgatttgtacctccatttatttaggtcttatttaatttttagcaatgttttatagttttcagtgtacagatcttacataaactttgttacatttaccccaaactatgtcatattttttgacggcattgtaaatgaaattgtattttttattttattttattatttatttatttattttaattattatactttaagttctagggtacatgtgcacaacgtgcaggtttgttacatatgtatacatgtgccatgttggtgtgctgcacccattaactcgtcatttacattaggtatatctcctaatgctatcccacccctctccccctaccctacgacaggccccagtgtgtgatattccccttcctgtgtccaagtgttctcattgttcagttcctacctatgagtaagaacatgcagtgtttggttttctgtccttgcgatagtttgctgagaatgatggtttccagcttcatccatgtccctacaaaggacacgaactcatccttttttatggctgcatagtattccttggtgtgtatgtgccacattttcttaatccagtctatcttattttatttttcaaatgtccattgctggtatatagtaatataattgagtttatacattcaccttgtatcgtatgaccttgctaaattcaactttttcattctagtagctttttctcctccatagattccttaggattttctaacataaaaatgttatgtgtgaaaaagatagttttattattttttttgtccaatatctgtgtcttttctttatttttcatgccttttttgcaatggttagaacttctagtgcaatatcgaatagaactgatgagagagggtatccttgcctgttcaccatcttagggagaggtattcagtctttccctattaagtatgatagttagctataggctctttgtagatgtcctaaaacatagtctgcttttaattattatcatggtctggcaattctaaacaaagccaatgataaaatacttatcactcctaaaatatcttttgctggtctgagttccaaataattgctgaaattacttctgagtttgattaatatatatctaaccttcaaatttacatatttgtatcaattatcctttagtagttgtattctatatggaagttaattaagagaattcccagttatacagggaattcgtattcccctccccctcccaccactaccccacacactgacccagcagcatgctttctttggagaagaatttgtaacagatcgcagtcattccagcttccttcaggggtagtttgtgcctccaactcctgggatgcatatattcctgcatttacactgcagagtccaaagaaacagttatagcactgggattgcaaagatgaagaaacagaacctcacttgcttcaattctatcatctatatgattccttggagtttttggttttgtgtttagaatttaaaacagtgaaactgtgaggtataatatttttatttggtaagggcaaatttttattcttatgtgaaatattttgagtgatattcttaaaattgacattcattttaaattctattcttgttatttattatttaattgtaacactattcatttctttgacaggccattatataggtctaaggttttttccctttaaaaatatattaatgcaggccaggcacatggctcatgcccttaatcccagctctttggaaggccgaagcaggcagatcacttaaggccaggatttgagacaagcctgggcagcatggcgaaaccccgtctctattaaaaatacaaaaattagccgggcatggtggcgcacgcctctagtcccagctatttaggaggcctaagcatgagaatcacttaaactctggaggtggaggttgcagtgagccgagattgcgccactgcatttcagcctgggtgacaaagcgagactctgtctcaaaatatacatatatataaatgcaatgaaaaaaatatcaatagttatttttgcatatttgtgctataatatgttatttttattttttactttttgtaaagtaaaaaatatttatctgcaccacattcaacaaaagataatttttgttgtcagcattgcttttttggttattgttatgattcatttcagttcatgattatttgtgacaataattttagtatagagaagacacatttgctccaggggttggtatgttgcttctgccattggtaagatggagtctgtgcaggtccagccccaggcaattgtcagcccattgaccatcctacaagtcagatagagtggggtttggttggttgcctctgattatttgtcttctagggactattttgagttttgttctgaggcaaaggcacagataaaacagacagattaatgatgcatagccatgaaatgattttgcaaagttctatcagaaaaccctgcactgagagtcaggactctgccctgtcaccacattatctgctttctcccccttggggttgaatgagacaatctttatttcttctggtcctgaaattcaatgagtctgttatcccactatgaaatataaagggttattattactcttgtttttgttgtttgtattaatgaacaaagaagaggctctggaaactttgaccagtggggcagaaggacagcaagacagttaaatatttaaaaatgttctaaagtaaaattcgagagtcttgtcctcagctgtttgaattgggcttactgtcactggctgtgaccttatacctcattcccaaggctatgggatctttactaagttaaattgcagagggcagactgcagtggtggctaaccaatgctatatctgcccttcagctcaagcccatctctacctgggaattttcggtgtgctcagacagcagagacagagacccatgcccaatgttgtcctgttgctggcaaagccaggtacaacaccagaggtgagagctctgtgttcatggatcaactgcattagaatcatggaatgcttccagagctagtgaatctaaaggcagggcccaggaatctgccataaacatgtttatatgacgattagtatcatgcattctgaagtctgagcaccattcgtatagaagaatggccaagagagtgaggattttaaaatgattcaaagctgatacaatagaaatgaatcactaaaacatattttactgcctttgtatttcagttttttttttttttttttttttttttttgagatggagtctcactctgtcatccaggctggagtgcagtggagtgatcttgactcattgcaacctctgcctcctgggttcaagtgatcctcctgcctcagcctcccaaatagctgggattacaagcatgcaccaccatgccccagtaagttttgtttttgtttttgttttaagtagatatggggttttaccatgttgaccgggctggtcttgaactcctgacctcaagtaatctgcctccccaaattgctgggattacaggtgtgagccaccgtgtccggcctcacaatatctttaattattaaatggccagcgctttttttttctccaaacttgtcattctgcaaaatcaggagatgtcactttaagttgcatcaagtactgtgagatagatatgactgatatgacaaattataaggtgacattcatcacatggaatccatggcctgaatgaaaggttaggaaaactatgggtttctaatgagaaagtcaagtttaattaattatcctctgaatagatttgcactggaggtttggcacctgaagcttaatagctaattacaagggctgccagtgaatagtgggtaatctgcatccccaatttcatgttggagatgtcataattgctgtatatcacaggacagcaaggcagagcaaatagatacaagctgcagctttctaaaggaattccatgatgctgctctgagagttggagaaaaggtcccagttgtcaaccacagactgcgatgaagtcagcagtttcaagtaatgcagtgtgtacccaattgcctttgaatcatggaaccagagagactaccgcatggcctctagctgatccccttccactaggccattgatgcatccagttatttcagactataccattttcccctatccttccaaacctatctgctattcagccagtttcctttagtagttagatatcaggcagggttcctgcaattcaccatatcgaaagaatttggcaaaattcaacaccccttcatgataaaatgttataatcaatcttgaatagaagaggactcaacttgagaaagggcatctacaaaatatttacaggtaacattgtacttaatgctacgaaacaatgttttcccctaatgtcaaaaaatcactttggttgcagaatgaagaatggcttgtggagagatgggtaaaagtcaatgatataattgcatctaggaagttatggcaatagttcaggtgaagatgacagcttagacttggatggcagcaatagaaatgagaggtatttgggaagatggggctcattcacagattggggattattcacaaattgagggagagatccaaacataactgctaggtattagcttactcggctggatggatggtgctgccattcattgggcagaaaaatcaggatgattttctctataccatggcccccaaaagtcaattagaaaagtctgatatctgtggaagatatccatattcaaaatggaggtgaggtattttcaagtacatgaaattgtgtttacatacacagggctccctgactgcagaaagcaattgagggaaaaagcaggtcttatgaaataaattactgggaagacatgccaatactgaaatactggagaagaggggagaattgtatatttcaaggtgctttacaacaagctctttaacatattatctgatttaagtatgaccacatccatgtgaggtagaatttttctgatacctgtttttagatgatgattggagtcccaatttattaagtgatttgtccaaaactattcaatggtgaaaggcttttaagtgtaaatctcctgattgcagtgtccctaatcttttcaatgctacagtaaaagttaatttcagctaagaagagagtcattggaaggaattcaggtctgcagactgggtcctctctaataggctatttctcttttctcccacccagctaaatcctactcatccttcgagactctgttcagattgttcatctcctgtaaatcttttgcacccattcctacttactgattacttccatttaaaaaaaaattaaattatatgttgtttaatgtaatatgttaaaatagtataatttcaacatgctatcaatataaaaatgatacttcacatttttctgtaccaaatatttgaaacccagcacgtattttatatttacaatgaatcataattggaagtaggctcatttccagtgcttagtggctagtggctactgtactggacagcacaggtttacaatctaaccttcagtgtgatactcaccttaaaatgtacaaaaagaggtacataatagttgatccaaaattaaataatgctgtgttaaaatgggaagtgaaagacaaaatatcgtagcatttggacattatctgattaccaagagacattttactgtgattgaagagtggctaagcaaatctttttgacatcatttttacaaacacattgcagactggttttctctttccattatctcgttgaaagtctgtctgggcacctagttattttgttctatttctccacttaacagttgttgttcattctgacctatctcaaaataataagagctatttgtgacaaacctacagccaatatgatactgaacgggcaaaaactggaagcattctctttgaaaacaagacaaggatgccctctctcactacttctattcaacatagtcttggaagttctggctaaggcaatcaggcaagagaaagaaataaagtgtattcaattggaaaagaggaagtcaaattgtccctgtttgcagatgacatgattgtatatttagaaagccccatcatctcagcccaaaatctccttaagctgataagcaacttcagcaaagtctcaggatacaaaatcaatatgcaaaaatcacaagcattcctatacaccaataatagacaaacagagagccaaatcatgactgccctcccattcacgattgcttcaaaagaataaaatacctaggaatccaacttaaaaaggatgtgacggacttcttcaaggagaactacaaaccactgctcaatgaaataaaagaggacacaaacaaatggaagaatattcaatgctcatggataggaagaatcaatatcatgaaaatggccatactgcccaaggtaatttatagattcaatgctagctatccccatcaaaccaccactgactttcttcacagaattggaaaaaactactttaaagttcatatggaaccaaaaaagagcctgcattgccaagacaatcctaagcaaaaagaacaaacctggaggcatcatgctacctgactatactacaaggctacagtaaccaaaagagcatggtacttggaccaaaacagatatatagaccaatggaacagaacagaggcctcagaaataacaccacacatctacaaccatctgacctttgacaaacctgacaaaaacaagcaatggggaaaggattccctgtttaataaatggtgctgggaaaactggctagccttatgtagaaaggtgaaactggatcccttccttacactgtatacaaaagttaactcaagatggattaacgacttaatgtaagacctaaaaccataaaaaccctagaagaaaacctaggcaataccatttaggacgtaggcatgggcaaagacttcatgactacaacaccaaaagcaatggcaacaaaagccaaaatagacaaatggaatctaattaaactaaagagcttctgcacagcaaaagaaactatcattagagtgaacaagcaacctacagaatgggaaacaatttttgcaatctacccatctgccaaagggctagtatccagaatctacaaagaacttaaacaaatttataagagaaaaacaaagaaacccatcaaaaaatgggcaaaggatatgaacagacacttctcaaaagaagacatttatgcagccaacagacacatgaaaaaacgctcatcatcatggtcatcagataaatgcaaatcaaaaccatagtgagataccatcacaccagttagaatggcggccattaaaaagtcaggaaacaacagatgctggagaggatgtggagaaataggaatgcttttacactgttggtgggagtgtaaattagttcaaccattgtggaagacagtgtggtgattccttaaggatctagaactagaaataccatttgacccagcaattccattactgggtatatacccaaaggattataaatcatgctactatgaagacacatgcacacatatgtttattgtggcactattcacaatagcaaagacttggaaccaaccctgatgtccatcaatgatagattggattaagaaaatgtggcacatatacaccatggaatactatgcagccataaaaaaggatgagttcatgtcctttgcagggacatggatgaagctggaaaccatcattctcagcaaactatcacaaggacagaaaaccaaacaccgcatgttctcactcataggtgggagttgaacaatgagaacacatggacacagggcagggaacatcacacaccagggcctgttgaggggttggggggctgggggagggatagcattaggagaaatacctaatgtaaattatgagttgatgggtgcagcatatcaacatggcacatgtatacctatgtaacaaacctgcacgttgtgcacatgtacgctagaaccgaaagtatattaaaaaaaaagatttaaacattttaaaatctataatagacgagaggaaagttaaaaaaataaaatccaattgaaattaaattctagaagattaatgttgccagttatattttgatgacaacaataaacataatgcaattttgttaacttattgctttaaaatgcaagttgataaccaacaatggtaccattttagcacaggtaactaactacttgtgtttgagtttcccaagagataacctgaattgcaataatgaagaggcacataactcattaatgttttttagtctcttaaataacattaaaattgtctcagagtctctagtatatttaacaattatataaagaaaaaaaaagagttgttcatcctgccattcagtaaatacctgctgacaccttattggccaaatgtgccagatgcagggatgtgaaatataccccatgtctgctttcacaaagcttccaaagtagtgataaagagaaagagagtgaaagacatgggaaaacatatctttgtgttttatttgatgattatcattctgtgtctattatttgtttgaatattagtttacccccatttctttaactggagtgagaggaatggactatatcttcttattctttttatcttcttgggacctaggagaatgccttaataaatacgtgtggaatccactgcaatggatgaataaatgtgtgttattttctagaacagaggtccctacaaagcatactaggaatataaagaaacatttcatctttctgatggagaatagaaaggaatataaggcagaggggacatatggtccaggccttgaaggacttgacacaattgaagaagctgataagaaggaagtttgagggaaagaatgaataggagttttcagatgagaaagtctgggagtagaagtacatcacttatggtgggtactttctgaacgtttgcttaataaatacacaaataggtaaaagaaagaacctgaaggacctgaggatgatctactttgtggaattagaaatggagggagtgaaggggtggtggcacagcagaaggaacatgggaaaaagtgacagccacgagtcggccgttgccattgttaacatttgaaagcaaaacaagacaacagcaacgaccctcttgacgctggaggtacagtattgtgtcctgttctcttagctttgggataatgcctattgtatccatctgagaacttaatgattccataatctctcattaacgtgaacaatttcattcaagaaggtttatgggcagagtgaaaaataagaaacctagcagagtgacatgcttttattttactgtaatgcatataaaggaagacaaatatgccaataatacccttctaattcgatagaacggtctcacaagaacttgtgctatttagaaaaagagatacagcaatgacgaacttgttccctgggcaaattaccaagtaagacaatcaaagacacagattttcataggttttgtttccaggaagatagcagtttccaaagtcttcagagtctgagaagaccgagttcttctatatatatatatatatatatttttttttttttttttttttttttgagacagagtctcactctttcacccaggctggagtgcagtggcacaatctcggctcaccgcaacctccacctcccgggttcaaacaattctcctgcctcagcctcccgagtagctggaattaccagcatgtgccaccacacccggctaactcttgtatttttacagaaatacaaaagagatggagtttcaccatgtcgtccagtctggtcttgaactcctgacctcaagtgatgcgcccgccttgacctcccaaagtgctgggattacaggcgtaagccaccacgcccagcctctcaaattatatttctaaggacacagttttaatagagacaacaaacttaaaactgttagaaattttcacctgcctctatattgtacagtaaagtaaaattgatattccttaaaagttccaagttgagagcaaatgtaagcctgtacagcccaatttttccataaacagaaactaagaaagtaataggattttactaaatactagtgaaaaaaagaacatagtattaatcttccacataaacaaggtcacatgcaaacatgagcaaacccccaaagttgtactgtttgtgtttctttatggaactcttctctaggtaacatatctgacactccaaccctcttcaattcccccatcacaatcctgagaaaagcatttcttctctcaccaccactgccagagtaagtgccctttccccccaggctctcagccagtccagctttacttctacacccggtttccacctggctcatttctgcctctggccttttgttcagctttccctgcttggggcacacaccccattctctttagttcttccacgattctgaactcttatagaaatcacccttcatctagattgtttgcctctgaaccctctaggccttgctaaggggcgggtagaggttggaatgagagcagagggggcaaaaagttctggtagtctgtttttcaggacaagcgctctgtctctggaaatggtaacaagagccacattaaacagaaaggcttcctttcatggatgtttctgttatatatatgcattttttttcaatcggagagaagaagtgtacttcccctggcattcagtcatgttcaggatgaggaagtcagacaaacagggaacctaggttttatgtgaacttgctgattgagactgacaatgcctggtacttggataggactccatctttacctttaccatgaagacagggtctcactgtcaccccaaccacttgcctgatagtatggttcctgggtgctgggggacagggtaaggagtggagaggtgtttagggggaggaatacggttaggaatcttttgtgtgttggcaggaaacctgggtccaccagttccggagatccttgtttactatataccagacagcgaggctggtgatgatctggaagatgtttattcagaagccagcagccaaaaggggtggacagagccagaggcaggaagtaagaaaaggtgacctgagagcaggaagagcaatggagtcatataaatcacatactgtcttgtactgcgattgaaatatgcatccattcgtttatacattcattttttttcaaccaatagttactgaatgcctgtgtattcacattattgaatgtgaattcaatgcatctttttaaggtggtagttctttttgttttttgtttttttggtggtggtggttgttttttgagacggagtttcgctctgtcccttaggctggagtgcagtggtgcaatctcggctcactgaaagctccgcctcccaggttcaagcaattcttctgccacagcctcctgagtagctgggactacaggcatgcactaccacacccggctaattttttaaaaatttgttttatttttagtacagatggggtttcaccatgttggccaggctggtctcaaactgctgatctaaagtgatcctcctgcctcagcctcccaaagtgctgggattaccggtgtgagccaccacgcctagcctaaggttttggttttgtatctaagtttagaagcatctaaattttaagttttattgttgttgttgttgttgcaggaaaacacagatcctggtgccgaacatgaggacagggcaggccgaaggagaaagtggaaggaggggagcttctctctcagcctcatccttctgggcctggatgctggagagtcatgaggtgcttcagagtactctgggtgaggagggaaagatggtgcccaccacatggaggccagcctaggtcttgtatgaaacctgtgaggtatgaaggagtaatttttctttctaagccatttctctgcttatttctcagatcagtgccctttatgtttgaacttggtgtgaatgaccatcttagtgattcttactgcaatgacaatagggagttaaatgacataagtttctttttcatgggaaaggatataaaaatgtatctgcatgtggtcagtgtagaatattcccagccagaggtgcagttttctggatccctcccacagacattgtgtggaagcacacctattaaccgataaggggcgaaatttcaccagaatagagaagcatcctctttgcccttttcacaggggtggggatgaggttaggggtggggttataccttctttgctcacccagctgcttctatatatcttagcctggatatgcctaaacttaagccaaaacaaaaactcatagacaggtagtttatttgcaaaatgatactagggatcaggagtaaggaatgagagtaaagcaggggaggaagaaaagccactgcaagcatgcactgtcaacagaggaaggaccaacaagcacatgaaaggtctcagtgttactagtcaccagaattcaaatgaaaaccaccacgagatacctactagatgcctattagaatggctacattaaaaagactgcagcaacaaatgttggtgagggtgtggaacagtcagagctctcatcaattgttggtaggggtgtaaattggtacaactttggaaaggtctggcactttcttaaaaaactaaacacacactttctatgacccagcaatttcattcctagatatttgcccagcagaaatgaaaatatctgtatataaacagacttgtttaagaatgttcatggcctggcgtggtggctcacgcctgtaatcccagcactttgggaggctgaggcgggcggatcacgaggtcaggagatcgagaccatcctggctaacatggtgaaaccccgtctctactaaaaatacaaaaaattagctgggcgtggtgcaggcgcctgtagtctcagctacttgggaggctgaggcaggagaatggcatgaacccaggaggtggagcttgcagtgagcagagatcgcgccactgcactccagcctgggtgacagagcaagactctgtctcaaaaaaaaaaaaaaaaaaaaagagtgttcacagcaagcagcattatgtgttatagtcagaaactggaaacaggccaggcacggtggctcatgcctgtaatcctagcactttgagaacctcagataggaagatcgcttgaggccaggagttcgagaccagcctggggaacatagcaagaccctgttttcacaaaaaataaagacattagccaggcatggtggcacacatctgtagtcctagctacttaggaggctgaggtgggaggatcacttgagcccaggagttcaaggctgcagtgacctataatcacccaccctgggtgatacagtaagaccttgtttctaaacaaaacaaaacaaaacaaaaactggaaacagcccattaacagaagaatggataaaaaaactgtggtatgttcatgcaatggaatattgcccagccataaaaaggaatagagtattgatataataatatgggtaaatattaaagcatgctgggtgaaaaaagccttacgcaaaataatatggtattttcctatttaaagttctagaataggcagaactaatctgcaatgaagaaaaatcaaaatagtgatctgtgcagatgtgggcgtacaagtaggagttgacagagagcaggcatgagggaatgttcctctacatcttcaaaggagtttgggttacacatgtcaatgtacttttcaaaacttactgaatggtacacttacaagtgttcattttattgaatataaattttgccttaaaagaaagacatcataaatgaatactgaagtttagttaatgatatgcatgctgaagtgttaagggtgaattatactgttatctgaaaagtactttgaaatgcattaaaaataaaatagattagtagatggatagaataatagataaatggatatacgtatgataaaagaaatagaataagatattagttgtacaatctagatagggatatatgggttttgactgtagcattctttcaacttctctgtatgcttgaacatttttataataaaaagtgaggtaaaaacaaaaacacatgatcacattggctacaactgagcaactgttgtacaagcctgtcaggaccgttgaggagttttctgaaatctacttcagaacctaacacctgggtggtggaagggaaaacatttatctgttggcttctttctccttgtgtcagtgcttaaagccctcttgcaggtgccctgcaccttagagaattcccagggtagggagctagagtacacagcatgcatgggctgatgtggcatgcttcagattgcacctgtgtgtagctggtcaaagcctatgcagaaccaagagtcaaacaagaggatggaaagtgctccagaagtattgtgttagttactcattgctgcttaacagattaccctccaaacttagtgtcttacaacaaacgaacagctattctccacaattcctgtgggtcaggaattcaggagtcacttagctggctggttctagctcagggtctgccatgacattatattcaatatttcaagccaaggctgcattcatcggaaaacttgattggggctgaaagatccacttgcaaggtggtgcattacatggcccttggcaggaggctccagtgtccctgccacatgggcctcacagtaggtctgctgagtgtccttgtaacatggcacatggcatcccccagagtgagtgattatggggggaggaaaaagtcacaatgtcttttatgacctggttttggaaatcacccgctgtcacttccaccaccttttattatttagaagtgaatcactaggtacatttcacactcaaggagaagggaattaggcttccttttttttttttttttgagacagagtctcgctctgttgcccaggctggagtgcagtggcacaatcttggctcactgcaacctccgcctcccgggttcaagcaattcttctgcctcagcctcccgagtagctgggactacaggcgtgcgccaccacgcccagctaatttttgtatttttagtagagacggggtttcaccatattggccaggctggtcttgaactcctgacctcgtgatccacccgcctcggcctcccagaatgctaggattacaggtgtgagctaccgcttccagcctagcttcactttttgaaggaaggaacatcaaagaagttgagaacatgtttggaaaccacaacagatttccattacgtttcacctttgcacttcttaggacttttgtgctctgcattaagtccagtctgcccagagtcttcttctagagagtggctagctccaaatcctacaaacactaaatacaggaaggtgaatagaacaagttacattccctgctgatgcaacaggttccaaatccataaatagtacttgtcatctccattttccaccatttgctctagatttcccttaaccttagccaattatttggctgatgtaggttgctttcctgatggctgactcaaaactttacctctgaggggtctgagcctttagttgaccttgtaaagtcatgatcactgcgattgcccatccaccatcaccagtcatggaatcatcaatagatgtccctgtgaatcttctatgtcctagacacagtccttcctgcacacataatgtaacagcagccttagctcttcatggtaatcagagtcgattactcttttcagcataggaacacctcttttttcttgctggtctactgccatgaggaacccaaaattcaaaaacaataatcacactttaaggtgaatggaagcgctatcatttctgctagtgcgtacattcacccacctgaaagtgggacaattaattcagcagaacctaggctcatttgatgggaaatgcacaacacttttaagtggatcatgagaagtgatggtgaggggggcaatcctacttctacctcatgtttcctggaccaatgttgctagacactgggaacataacaccatgtatcagctattgttttagcacatatatacaatattttggaggacagtgtcattaccaacaggtcgttctacctgagcctgagctgacactaaaaatccttttcaaaaacttctgctttcaatcatgaaggagtaagccagcctgcaattacattttgaaagtaagcaactagaaaactaaacaaaatgtaggaaaaaaactattttaagacattgggtaagagtccaacgagattgtgatccccatgaaaaggaaacgaaaggggcaaaatacaccctggtgtaggctttctgcctgcaggtagctccaagattgtgattcagggagatgaaattatacaaagtgttgtcattgaattgaacagagattatagttcaagaagaccaaggtagctatgatttataaggcagagcacctgtctaagtccattttctgttgttataaccaaatacctgagactacttagtttatcatgaagagaaatctatttctcacagttctgaaggctgaaagtccaaggttgagggggtgcatctggagggccttcctattggtaggcaatctctgcagagtcccgaggtggtgtagggcatagagaaggagctaagcatgctagcttagctcctcacgaagccactcatgtcccacactcgtgactttatctcattctaatgacatccaaaggtgccgcctctcaaatactatagttgaattcctcccccaccgccccccgcttaatattgttacagtggggattaagtttcaacatgagtttcagaggggacaaacactcaaaccatagcattacttgagaggagagctctcaagaaatctttggctgggtgcagtggctcacacctgtaatcccagcactttgggaggctgaggtgggtagatcgcttgagcccaggaatttgagaccagcctgggtaacatggcgacatcctgtctctacaaaaaatacaaaaaattagctgggtgtggtggtgcacacctgtggtcccagctacttgggaggttgagggggaggatcccctgagcctggggaggcagaggttgcagtgaaccatgatggtgccactgcactccagcctgggcaacggtgagactcttgattctttgcctgaacaccaaactagtcaggaataggatgaaatcccataggactggacaagaacaactttcaaggaaagaatagttctgtgtaagctgtgagacaaataaccaataaccagagttcacacagagctgggaatcatttgagttccctctagtcagagtaaacagaccttggtgaatacacacgacattcagtaaaaatcctggaaaggcaacagtttgaagtggggctaaattatttctcaaataaatgctactctagaacacgctaaaagagcctagaacatacctcaaaaggatcaaactaatctgcaagtaaaagtccaacagaaaagattcaacactcttcaaagaaatacagaatttcagcacccaacaatgtaaactttacaatatctagaatctaatctgaaattaatagacatatgaagaaaaagaaaatatgaagaacagtcaagagaaaaattggtcacaagactcagacccagaaacaacagagactatggaattatcagacaagaaggttaatatagctattggaaatatgttggctaggcctggtggttcacacctgtaataccagctctctgggaggctgaggcgggtggattgcttgagcccaggagctcaagaccatcctgggcaatgtgaaaatccatctctacacaaaatacaaaaaattattcatgtgtggtggtgcacacctgtatcccagctacttgggaggctatgatgggaggatcgcctgagctgaggaggttgaggctgtagtgagctgagattgtgccactcactccagcctgggtgacagagtgagacactgtctcaaaaaaaaaaaaagaaagaaagaaagaaatatgtttcttatataaagagatgaaaggacgtgaaagttataagaaatagaagatttataaaggactaaactcaagcttttagtgataaaaatacaacatccaaaattgaaaatacactggatagatataatagcagattagacactgcagaagaaaagaacagtgaacataatgacacaggaaaagaagctacccaaagtgaagcacagagaaaagatggagaaacagcacatcagtgagctggagaacaatatcatgtgtgcatctgaagtaaaagaaggaaaggaaaaaggagggagaaaaatgtttgaagaattaatagtaaaagaaatttctaaattcttcacacctgttaggattttcacgttgttttgtttcacttttgaggaaaaagagacagggtcttgctctgtcacccaagctggaatgcagtggcactcatagctcactgcagcctcaaactcctgggctggcttcagtgattcttccacctcagcctctggggtagctgggactacaggcatgcaccgccatgccagctaaattcttttattttaatttttttttgtagggatacattctttctatgttgtccaggctggtctcaaactcctggcctcaaatgattcccccgccttggcctcccaaagtgcttggattaccacgccccactgttttctttaaaaaggaaaataacagttgttggcaagaatgtagagaaattggaactcttgtgcattgctggtgggaatataaaattgtgcagctgcaatggaaagcagtttggtggttcttcaaaaagttaaacagagaattaccatatgatttagcaattccactcctaagtatatgcccccaaagaattaaaagcagagactcaaatagatacttgtacaccaacgtccacggaagtgttaatttgcaaaagccaaaaggcataaacaattcaaatgtcaaaacagacgaatggatgtatacacatacaatggaatattattcatctttttaaagacaagaaatttgggtatctcctacatcatcctttcaaggatgaaccttgaaaacattatgctaactaaactaaccacaaaaggaaaaatattgtatgattccattaatatgaagtacttacaacaaacaaattcatggagacagaaagtaaaatagaggtttccagggtctgggggaatagtagattgggaagttattgtttaatgagaacagagtttcagtttagggtgataaaaaaaattctggagatggatggtgggaatggttgcatgacagtgagaatatacttagtgccactcaactgtacacttaaaatggcaaattttatgttctgtatattttaccacaataaaattaaatctcttaaaagttagttacagccgggctcagtggctcacgcctgtaatcctagcactttgggaggctgaggtgggcggatcacgaggtcaggagatcgagaccatcctggctaacacggtgaaaccccgtctctactaaaactacaaaaaattagccaggtgtggtggtgggcacctttagtcccagctactcaggaggctgaggcagaagaatagcttgaactgggaggtggaggctgcagtgaactgagtttgtgccactacattccagcctgggcgacagagcaaggctctttctcaaaaaaaaaaaaaagttagttactactgttcaagaataaattgtgccttatttgccaatatacgtcatttgaggaggatgacaaaaattgaagagcttgatggaattcagttttgaaaagtgagatctatctgtgtttcctacaaactttattttttttgagacagggtctctttctgtcacccaggctggagtgcagtggcacaatcacagctcattgcagccttagtctcctgggctcaggtgattctcccacctcagcctcccgagtagctgggactacaggtgtgtgccaccatgcctggctcttttaaaatttgttgtcagggtctctccatgttacctaggtggtattgaactcctgagctcgagcaatcctatctgccttggcctccaaaaatgttgggattacaggcgtgagccacagcacccggccctacaaacttttaagaagataaatgcttgtagaaatttaattacattttgcttctatgaattcctgatgaaaactttctgaaatctgtcataaatacataatcaaaagaaaaaataaatatctttaatattttcacatccctgagctttctgactccttccttagtgctatggcaagctccagtccaggcaagttgcagcttctggactttatttattataggccactattttgtccaagcctcaagaaatcactcttgcagtgtattgctacaggtatccttgccaggacactgagttttctgatcaaggaagggtgctcccaggtcaataaattcaccattatccagctttctattccactcacccaccctagtgcaacatcctcaagatccactttcacaagcttatccaggttcctgcctgtatacattacccaggtgaatggtttggctctgtgtccccacccaaatctcatctcgaattgtaatccccatgtgctgagggtggggcctgtaatccccatgtgttgagggagggaggtgactggattatgggggaggtttcccccatgctgttctcgtgataatgagtgggttctcacgagatctgatgattttataagcatccagcatttcccctgcttacacttctcactcccgccaccctgtgaaggtctttgcttcctctttgccttccaccatgattgtaagtttcctgaggcctctgcagctatgcagaactgtgagtcagttaaacctctttcttttataaattacccagtcttaggtatttctttatagcagtgtgagaacagtctaataccccaggtccttcagtttctttagtaaactatttcctactgcagcagggatacatttccccacctgcttgagccaaaacctgactccagttatcatggagtcagttaattggagatggaaggagaccttgaggaagacagacatcactttgcaaagcaagattcaggtgaggtattttcagggtctcctggcaagatgaggctgatgtccccagcaaggagaagaaggctgactttgctctcctagaggatgaaaattaatctagtgactcaatattctcagacttgtctatcctatcccagctcttaagattttaagcttttcctatcagggttctaactttgaaataggagatctgtgaaggcttggcgttctgtctcctctatgactttgtcaactgttgtcttaatcttcaagacagtattccctgtgcctgcaggagatcaaattcttttaaccattgctctatttcaccgtgggcttgagttgatagttgtctaacatgaccctgtcattttcttattttgagactttcaaagcagttaacaaaagccagtgaattccccattcctttacaattataattgcctccatattgtccaaggaccatagttaccacttgacccagagcctctcccttccacctgtacctcatcccaatccaccacaggtgagaaccttaattgtgttgctgctggatctgcacttaccactcaagctgtgatgggaatgatgagaaaaacgttcttctcttacagtgaccgtcctggctacctgcaaagtatgcttagaattctagattcctttgaagtctgggtaaagatctcccaagggctggctgatggggacatggggattcttaatcctgttcacctacaacgtgccatccaaagggaacctcagaagtagtaattgcccacctttatgggttgtgcatgcatgactgccaagcagctttccacaggcatcacagactctggtgtcagacaagccttggagcaaaagctacagatccagtgtctgggctgaggcaaggtcaggttatgcctgtgtggaactgcttgccttcaccagtgactggggtaagtggccaggccaaaaggatgtgaaatggtgctcaagagttctggtcccctggaggccctgactggagccaagtgtcagcacacgaaacatcatcagctcattctggagcatttactttaactcaagtattaataaataaattggaagtcaattcacagatgcatcggaccagaactaggtcaaagtctatttgcctaatcaatgccctggctacccttttgtctgtgtggttgtacggggtttggtttgagtctgaggaccatgatcacaagtccatttctcagtggactaaacaagaaacctggctaaagattcccagacttattaacgtccttccctttacccagatattagcttgatgacaatttcattcatcaacctaggtttgaacatagttttcagtgtccaaattctttctggatagtttatttctctgttcagttattaggtctgtaatcttttgtatgatctgtgtccacataaaaaattaccaacgttttcccaactagtttagtagtgaaagtaccatctaatttaaaaaaaaatcttcagtgtgggggaaaaggaggacagatgtgattattagactgtcatcatgggtctctagttgttttaaaaagttatagctacctgaggattttttcaaaagattttattatgaaaaattttaaacatccacaaagtataaataataaaataataaatccccgtgtccccatcagccagcccttgggagatctttaccgagactccaaagggatctagaattctaagcatactttgcaggtagccaggatggtcactgtaagagaatggtttttctcgtcattcctgtcacatattgaatgagtgatcacatttctaccttagaaatggattacttcccctctggtgggtttgtttgctcaggttccctttaaccagagggtatcagggccggggccaggcatgaggcaagatctagctgtgcccaccggagggagcagtgtcctcctgtttcacagtaatttgctgtggattggccctgatacttgtcaagagttttatttagctctgttcttctctttctgttggaatatcattcatttttcttggactgtgggatgcggtccatgaccttcacactagctctggcattactgtctgtagtgtttcgcagtaaaagaattggcataacgtcacccaccctacctctacactgtttgacgtgcacatttccatcagtctaggctgctcactgttttccatctcggttctgggaagccagaaaaaaattggtttgaaattgaatttttaaagtatgtttttctaatgaaactcctagatggccttgattgtgtttccagatctcctctcatctcgattctgttttcacacagagatgcagttgtttttcacagtctggagcatagagaaaatgtggactgcactctatgctgatcagaacctatatagacctctggattttattttgggcactgcatttgaaaggatataatggcaaactggagtggggcgggggtgagggaggggaactaacagataggtctgagcaatatctgatgaacaattaaccatgtagaaaagaagacccaggggaggcagagtagctatctgcaaaagttgtgttgaaatatagctgtgattggtgtggggaagttagagaaagcaaatttcagcttattataaggttagattagaaacatccaatagttaaactagactgactcataaagacgttagttctccttcctgggagtcagataaatgccaggtaacatctctcaggaatatacttcggggcggggaggggagttcctcataatagaaaacccatctagaacacttattttcttccaagtactcttctaagcacctttcccttattatttatttaaccctcatgacaaccttatgaaataggcacttcagatccacagcttttatctgaaaaccttaggaccaaaattcttaattttttggattttagaaaggtatatgacacatacaccttatggtagaaaacacccccatggggctgttctccataatcaaatacattgatatttatacagtgaggcatgtgaatttttgcattaaatggaatacttttacatgagttgggttacgttttgttgccaaatgagttcagatcatctcttcccaccaaaaaattttgaaataattttaggtttttgcattctgaattgtagaaaagagattatggacacatattgctattcccagtttactcatgaagaaactgaggcagagagattaagtagcttgctcaaagtcatatgacttccacccaggcagaaatcaggtttgagccctgctcttaagcactgtgtggactgcctctccctgtgctcttctgcctcctctctttgaggggttgggcttagttacctgcaatgtctctaaccttgtgccttcgattccctgacctctgacttcagccagcctcactggttccagagcgatactcagagctgttctcagataccagactggaataaacgagagacatctggagaaaggagacctcttcctatcccaacaggactgtgtttcacaggaggcattttagtgttgttgttccccaatggctaggcagaggcagacaaagagaacattgtgtatcatcataatttgtcttcaatgacctttctttttgtgtcattcaccaccacctgttcctcaaaacaccaccatgtgaaccccaagcccaatggctcaggcttgccctctttccacccacgttccaggatggatttttccaggaacaggactaatgactcttaacttttcttctaccatctagagatggattataaggtagcaacccaagaaagtgggtttggacattcaaatacttgagtttaagtccagatgtgcaaacttgggcaaagccatttaacctcattcatcaacttgtcaaataggaaagataatacttacccgggatgaattccagttttggtgagcttgacattttcactatttgctggagccttctttaagcaaaagaataaaaatttatgatatgaattgggtacaaaattgtgcgtttatttagaaacaattctcttgttcacataaggggaaatatgatgcattaggagttgaagtgatcttaacaaaaggctttttttgggtataatttacaaaattatacaaccatgtaaacttattgatagggcccctttccagagttagaaaggggtccattcaacaaacagtcctgcaacttagaattcattaacagcaaggtaaatttgcttctgtatcaaactcacagagttgtaagaattgaatcacaagattaaatatatgcaaatgtgttttgtaatcatcaaacacggtgcataattattttgatgcctacaactaagcaaaaatatttgtacctagaacaaagcaaaaatatttattcaataaatgataaaatagatgaaatttgctctcaccaaagtagtatacaagctaattgtattacatttccctaggcctgaaaaaatttatcagagtaatatatgtacatatttttacacaacagtccaatattgataaaagatttgcaaccaaatagaacaagcccatgtcccacccctcatattttctaattccactttccagactcaatacatttcctccatattgctaactaatatgtgctatattgtttttcctgatttatcaaccttgaatattgtctggtgactctctattatggcattattcactttcttcttcccattctctcaatatagttataggacagttcttcttataatatgaaatattgtttatggctgaacaaaatagtgggctatgattttacgtccttctacatacctctaaataattgtgttatttttcatttgcttagttttccattttacctatacttgggttttcccactgtctacaatagcattttatgtatctttccactcagtcaaattccccacgctgcagagagccatggagccctccatccctctgctccagactagtcttgctgtcttctgtgcaacaatatggaacttcatgtgctatcatgctggaaatttccatcatctctctcctaaactggatttcctatgttttctatcttcctctgttttggttgcgtctttttggtggttcttattctctagtagcttctaaggaaaggtctatgggaggtacattaactgagactctacatgtgcatatctcaaaatatctttattctagccttataattaactgatagtttagacggatatggaattctaggtttaaaacaatttcactcagaatttggaaggcatttcattgtcttctagcttctgatattgctctagagaagttctgccattctcattcacaatcctttgtatctgatgacttttcctctttggagatgacctatgattccacaataacatgtggtaggttagattattattcaaaatattcacttttctccctcaccctgacttactttggctagtgggatattagcaagtatgttgcaagtaggggcttgaaaaacacttgtgtggttgggcttgttttcttaggcttatgccatcagaagcacagaacaaacaggctgatgactagcccactggttctagaaggaggatgagtaacacatggagcaaagccaaaccctcctggccaagctcagcctgaatcagcagagctgcacagtggagcccagcttggatctgccaacactcagctgattcatagatcaatgacaataaacgactgttattttaagccactgaatttttggatgtttgtcatataacattttgtggcaatagcttttggtatcagaaattagtatctaattggtattagaaattgatatttgtagtgaggtataggcacaagaaaacaaaaaaataagtggcattggtttggaggctggatgatgggcacaagaaaactgttataggaggctggaaagaaaatggtaatctgtgttttgcagggatgagacattttctaaaactgtcacctttggtaacttggaagttagcatatgtacctaaaaatatttggatttgtgctgagaagtcttcatgcacaatgataaaagtgtgagctagttgtatttagctgcatataataggtactagagatgagttcagaaaagaaccagccaggtttcaaggaacatgtaggtggaatgcagggagcccaagaattctgggacttgctgagttggaaaataaacttttgcatctccaatatagttggcaagtcagctatattgggccttctgtcctggaaggttccacagttcatcctcacagggttagatacctctcctggctttagatttgcctttccttgccacagagcttcagcaagccccactacctggggccgatctgtagtcatggaagcacacacagcataatattgaccagaggatcacttcatcgcaaaggaggcttgggaataggacaatgaccatgggatccactggtcatatcagatactgtatcacctagatggagccagcctcataaagcattggaatggttactaaaggcacagctggagctccagctggaggcaatgctctgaaagaacagggtaccatcctgcaggatgcactgtatacattaaactggggttctccatgtggtgctatgtcctcaacaggaagaatacatgggtctgagaaccaagaagtggaagcaggagtggacccacttatcatttccaatgacctcctggggaactttgtgcttcttgtctctacaactctgggctctatgagattagaggttttggtcctcaaatgaggtgcagcttggcaggagacacagcaagtgtcccattgaactatatactatggctgccaccagggcattttggactctttctatgaagagaccagcaggtgaaaagaagaaatcattgacttccatcagcagaaagaggtgaggctgcctgtacacaatgggacagggaggaaggaatgtgtatggatcccaggtgatccctgtggtcaagtttttctgtagtcttgcccaatctgtgatgtgactgccaacagctaagaccttctggaataaagataatgaagataataaagagggggaggggaatttagattggatagtgcaggtaggagaagatgactatgggttgcgatctcaagacaactggcggcactaggggctatagttcctcccattaacttctctcttctaagtatttcctcaagaagagggcccacaggagccatggggaactggatctatggaggaaaagaaatggactgtggcagtcctggaggtacactgcttagatgtccctttaagatagtcggccatggaaagcatagctgagtgacagctacgtagaggccatacttcccttcgactgctcccagctgatcactgaataagatgaggacagtagagccacttgtgcctacctgatgtgaggctactctaatgaacagcctttgcctcagacactaacactcctttgttctggctggacacagtgtcacagtttctcagaactgtgctgcagcctgaagcttttcctaggcaggactttctttcctctcttctttcccaggtagcagacctgcattatattcttctgctctgcattcctttatccttcacaggcatttctcccaataaatctcttgactacctaatctcatcttgacatctaagaggatccaaaatgacataaatgccacagcatttctaattgaaataataatatgacttagtatggtttgaattcattgtgctggacacttgggagaccctttcagttgagggactcaagactttcagccagaggaatttttttttttttttttttttttgagacggagtctcgctgtggcccaggctggagtgcagtggcacgatctcggctcattgcagcctccgcctccagagttcaagcagttctcctgcctcagtctcctgagtagctgggattacaggcacgcgccaccatgcccagctaatttttgtatttttagtagagatgggatttcaccatgttggttgggctggtctcgagctcctgacctcgtgatccacccgcctcggcctcccaaagtgttgggattacaggcatgagccaccgtgcctggctggaatttttttttttttaatagagacaggatcttgctatattgaaaaggctggtcttgaacttctggcctgcaacggtccctcacccacacctcagctgctcaaagtgctgggataacaggcatgagcattggcaaatttgaggtgcctggcctcaaaattctctttctggaactcctattagttggatgttgacccccaggatcaagcttctaattttcctatcttttttcctctattgcccacatctttgtctttcagttctgttttctaaaagacttcctcaactttatcattcaacttttctagcaacttttaaaacttcagctttcttactcttaatttccaagagctctttcttattttccagttacttgttttctatattattctgttttcctttcatgaatgcactttctcttcttatctaaggatgttatttctagttttgtctttgaagtgtttatttattccctaccttgtctctacttcctctaagtagccttttctgttttgtttttgttttgttttgtttggtttgacttttgtgtctgtctttcatgtaaggaaactttttcaaatgtctactgatttttgactatctgttcttatttgagagtgaagcactagccagctaaatgacaagtctgtgggcttgggagggttttaaaagcacttatctaaacatctagtaatacaggtccaaggacatttatgaagaaaaggagactgaatatttaaaataggtaccatccttggaaattttgagtctgggggtgacctctcctcagcctcctcttgtcctgaaaactgtcaccctccttggttccactgcagtgtgtatggcagtaaggtggctttgtcaatgggagaaactcagatgtcaatatctgttagaattctctctggagaattgatgtctggagagaagaatcttccggtctccctcttgaagggtataagcctagctgctggcatttttgcagctgagatgaggagaacatttgcatcattcaatatttttactctggattctaacccccatcatatactagaaacttctggttcagtttttcctccaaaaatatttgtaaggaagggttttcatcactttttttgggctatgggtgaggactatatgtttattaaatagattttgaacaaatctctctatttttatcagttgcctcaccccaactagtgctcaaagcctgggcactagtttgagagttcgtacaggacaaaatcagtttgcttcttggtgatttcattctctgcaggttcttacatttcacctttctctattccgctaaggccagagtcctctagttgctttttgtcatcatgtattgtgatgtgcgcttctgtttctcatctttttgctgacaggggaaaggagagataaggtcttttctccatcatcttaagctgaaagtcttccaggttattttcatgttaaaagagagcatgcctaattcatagctagcttgtgcagaacaccccaggagagactggcctagcagggctgggaggacccacaggggtgaacaaatgcagctggattgaaagacaagagcagaaagcatgattgagctgggaaagagctcttttccaaatggcctattcaaaaatgggatgggaactgcaagtgggttgaggtgcactcagtcaactagagaagaagaaacagatatgagatgctctggccaaggcagagtcaaggtggacgcagtttatttgaactcctgtccaagctattctagtggccatgtcagatccgccttgatgccatctgttctcagtgtcttcacgcaaagtaagaagcacaagcagtggaattccagtgtcagcaagtggccctctgtgtaccctgcagaaaaaggctccctacggaaacataaagtcacacctttgctccagctaagagctccactttgccctcatattttgtggatcttgtccaacttgagcatttttcacctgaaggattaaaatagggtgtggtttatgtgggggtaaaatggctacagattgatcatcattaaagccaaggagagactttttttcattaaagcaaaggggagacttcaaagtctgagaaaggcaaggaggacaccaaatctacagactaaccatagcaaaagcacagacatgctgcccacccagaagcactggaaataagcatggttgccaaggtagctggaaagaccctttctattaggttggtacaaaagtaattgcggtttttgctattaaaagtaatacttaaaaaaagtaataacttccctactccccttggacttcccatgataatagtgacacaatttttaaaactatttatctgaacatctagtaatacaagtccaagggcatttatgaggagaaggagacaagtgaatatttgaaatagatattgtccttggaaatttggagtccggggggtggcttctcttcagccccctcccatcctgaagccacatggatggtttcttgtccccacccttccctacaccttccctctggccctgcttttaggtcttaaatggattaaatttttgggacaggtgacacttttccctcttgtccctcagggtggtttttctgttgtttttgtttttgctttctcccatagcttgtatatttcaagtataaaaattatgtgaggatgatccgcctggaagccctttccagagctgagtatttccagaacagaagtaagcaggcttctttcattctaaagtctactgtgatttttaacagggtttccttatttcctatcagtttgtttatcaaagactccagcatggagtttatttaggaaaaacaaatgactttttaggttccactacttggctgagaggaattcatgttttaggaagccccagatgggaaagccttgttgttttcttctttgaaatgatctgcattttcaatttttttctacttgcttttatttcccacaatccagactcgccttttctactttgcctatccaacgatctaaaacactatgtaaagatacagataagtcttgttgattcttttaaacattagccataatccaaaaaagaaaaaagtcttaggactatagtcctaacagcacaaattttaaccctgaccaaagcaatttctattttaatttaggttatttgagctgaatttgcagggcgaagtggtcatgggtaaaactaaccattagttacctcaagcttgcaacaatggcaaagaaatgtcaagccattaattaaaatgactcccacggcccctcctggaatcaagtcgttcccagttagtcaacatctgtcacaatctgtgtaaaagggcagaacacgctataccccagcacattaagttagaacacagaggtcttgggtcactgccagagtaacttgtctgtggcatgatggttgctaagcgaaacagagcattctctgcagggagcccccctggactgaggctccttctcttcccctttatttcttgctaggccagcaggagccaggccgtggcctgctgactgcatctgccagatgactaccaatgtgtgagtaaacccattctcaagcccaagagaacctctcagctgaaccaggcccaagttgctcacccactgaactgccagttaaataaatggtggttgttttaatccactaaatgctgggatggtttgttatacagcagtaggtatcaatacagtgtacttgtcaatctaggaattcctgtcttgtcaaatctgagaaaattctcggtcactgtcacttcaaatattacttctttcccattttctattcactcattccaaaactcctagtggatgtcttttctgtcatttctggttctgtcttttgtgatcttaaactttcattcattgtttttccatttttacttccgtgttacattttgagtcatttccttagttccagtttgcttattttctattcaaccattaaatatttctatttagttttaagtttcagtggctataagtttcatttataaaagaactatttggttattttctaaatctgcattttgttttcacatgtttttctgttttttaatttgtattttcctttgcccttgtaaatcatttaaaatgtacttattttataatcatctgtggcttgatctgtttctttacttcttgggcattactttttctgttaatttcatgatctgaccctcaaggtggtttcctcctatggtttgtaatttttattatgagcttattttcagcagggatttctcccctctggtgaagatctgtatgccttgggtaatgtgattgtcacttcactatgcctgcaagtttgcttctgatggcatcctaccgatatcaccaactctcaaccagctctaatgtttcttggtatttctgcccacagtgaaaattcagagctcacttcaatgcatggcatgggcttggcttcaagtttttctgtatgacctttttttaaatttatttttatttttttaaacctatagcccaaggacacgggagctttttttcctgatttgtttttgccaacactgtagccctcaggaactcagattttgcaaagtgctcaattccagttgccttccttactcacaccagagacaatattttattggcctgcaagggtgttaaaatcccaagggtgttaaaatccccagatctccagggcctatcattggtccaaaccctgcagaggctacagtgacattagcccctacttactgcccagcctctgagctccctctttgtttctagaatctggggatttccctttctctctgtctagagattgttgtgctggacccctattgactccaataggaatggcaccaggttcaagaggccaaagaagagacctggagccagcaaatgagacataagatttgatttgggggaacttatgtacagggatggactagtggcagtgggctggataagagaaccacaactgctttccaaaagcctgcagtttatacagcaccttcactcagcaccctctctccagcaacatccacatggcaacccccatttcctaggctaagttattgctgtcagatgtgtttgccatacaggctgctgtacagagtatgcttaagttattgctgtcaggtacatccaccgtatatatacatacacatgtacgtatatatacacatacatgtatgtgtgtgtgtacatatttgtactcatatacatgtgtatatatagatatataaaaaaattttctctgtgtttccctgtaacagtaactgaagagggaattcttctatataatctcagtccactatattgctagaagttctcttctctatacttttgagatatgaattttacctttcaatattctaaaattataacaaagctataaattttgggaattggtatatgtttgtttttagaaaaattgttagaaacataatagcaatgggatgctttaacatgctaccttgaacctttaccaaatcaagagagtaaaaattaagcacaaaagagggatctaatactataaacaaggtagatttaatacatatgtatcaaacatagtaacctagaagcaatgaatatacattttctggtgctcatttaacattaacgaccttcaagaaggctttaaacagcaacagatagagttgagttgctttggcctattgctaaaggcatctaacccacctgctttgtgggaggtcatctgctttgaatctcaactgtatccaagtcagatttaaactctatggggcattggaattgtcctctgaatcatctccaactctgcaggatacataatagcaccactttgttgttctggaatttaaagacagggtcttattcaactttggctatttttgtgcagtccatggatccttgaaacaggacattctactttaccaatatctgactcatagaagacctatctatatacctaccaggtggctactacccagtaactcctaccgccaataccatgacatttgttttgaaaaccttagcttattgcaatattgcttataattatgaaaccttagaaacaactgaaatgcctatcaaagagagaatttataaataaaatgtaacatattcacgttctattttgatatgaattaccataatattctattaggatatgaattgttataatggccattagaaggaatggattgttcccatatataacataatatatccatgtataaagtatctatataataccaacacgtaacataatgtaaagaaaagagattcatggaataaaatgtgcatgtcattgatataaattttaaaaacacagaaataatacattatattaagactatatatgtatgtaaaattattaccagtggactgatttggatatacactaaattcatgctacttgcttctggaggttgcagtaaagaactggaactgtgtctggggatgtcacttttatctgttttatttagttcattttttataaacaatccttgaggcaaatatgagctgttaataaatgccaattagtctttttgcatattggttgcatttctcttttttacaactttattgagtataattgatgtacactaaactgcacttatttaaagtacacaatgtgataagttttgacaagtgtacgtacccatggaatctttaccacaatcaacatttgtttcctcccacagttttctcaggcccttttgtaatccattttttgcttaaacaatttgttttctatcactatagattagttttatataaatggcatcctacagtatgtactcttctggtggcagggggttgtctatctgccttaattcagtaatttctcaagataaaaacaattttaaaaatcttggaactgctgaaaacaatctggggcatataatctgtgattcagaaagggggaaaggagggaatctgtggaaagcaggtaccatttgggatagattcccaagcaggaagaataagcacacttattataatggcttccacattccccaaattattcccttcatgtaatctttttttttttttaattttgtggcagtgcctgaaactgcacagatgagagtcttttggataagtaagctactcatttaaaaacagacgctttgctcagaatttactcaatggcagctggttcaaggaaagcttgtcatcctaaccctctcccaaacttagcttcattaaggaaatgtgtgtttggatcataagagagaggagctaagatgtattgaggcatggagagttggggactgtgggaagatctgagtgaggcagcaccctaggagacttcggggaaccctaggatatcgggaaccagaacccaaggaggtggggagggccagaaaagaatgtgagaagacacccaaagttaatagccatccctttcctaatgttccctatgtgcggctccctgatgagaaactggaggaagagattcccatcatcttgcgtcttctattctcaacatcggagaactcctgttcttgaaattcaacctgatatcattattgctctgtggattaaactggctcttgtttgctaggctcagagtccaaatacaagatataacattgtttttatggaaaaatgtgcccaaataccaaataattgatctacaaagaaagttttgaaatgtaacctgttatacgccagggatttcttacatgtgtagatctttgtaacaatgagctatgttataatggaaatattttcacagatataattcttaatctatagccaatatcagtcattaaaacatactgttcagtcttggggcccataagtggaagatgttatggagaaattggaaaggagccaggggagacaaagtaactgatgaaaggttttgaaaaatagccctttagggaaatgtctacattcattcagaggagagaggtgtatcagtcttcaaactataaaacgatgttacattattgacatcaagtcttttttcttcttgtccacagagggcaatattagaggaaatgagtttaaacagcagcagaggggatttaggctagtcagatgtccccagcttgaagatgagaggtgcattctcaagctcccaagcctcaatctcataagggagtggtccttcttgagggattttttttttttttttttttttttagcgctctgatcagtggcagtccaagttcacacagccctggtctgcttgaagttgtttgcatacatcagtatttgggaaactaagttcggtccaagaacagaaaatgtttcctggctacatggagggtaaagcaaacgtgaagttgcctcatacgagaagaatccagacatgagaaatctcagcctttggtccattattttgtaaatctgctcaaaagagcatggattcacaagagaagtgtccaggaggagggtagtgtcagccccactgctctgtggggcagtaggaccacatctcaggcactgggtccaggtcttggcagtcaggatgtctccaggggctgttgagaaattggagtgcctccagaggggagcaatggggacagaagaatctggaaactgggtcaaagaaggagcagttgaatgaacaacgtgtgttggcctgaagaagataagttgcagcggggacaagaagctgttttcaaagttttcaaagatttgaagtgctgtcaggtggaagagcagtgaaaattgcgtggctccaaacggtaaatacaggaccaatgagtacgagtcatagggacggtgtccgctgaaaagaaggaagcattttataatcattaaagatgttcaaagtaggtggtgatacttggttatataggaaatgtttgtatgaagactagatatatataaaaatgttggaggaagaatttttgagctttttttttttgtctcaccaagcaaatgaaactttttggagagagatgacctagcaaaagattttttctcttggtgatcaggaaaggcagtctttgcagaccgaaccactagagggagtcagggcagcagcgttgcaaggccgccgtccattctcttcaccgaagcagcaactgatagccaggcctggctctcaggttctaagttcccctgatttcaatatcacccccatgaatctttctggaatgtttacatctgattaaattcttcaatgtctgagaggcctctgtgtgtagagaggcacaatcactgctatttgtagtctgcttacatctttattaattatttaataaacagtattctcctaaaaattcaaatactccctaaacgactaaaaatgaaaacttatgcatttaacaaatgtgacattttccaaatatctaaatattagtttataaactaattgattatcctaaatatatgtaatatatagtgtataatatatatatacttctaaaatcacaaatatcctatatctaagtcttttaaatgctacaaatgccttaaaagcagaaacacacaaatgaatcatcacaatgatacatatacaaagtgatgaaatatagctaaaaagatttccaagcaaagtgttgaaggtaccacctggtttcttcttggtgcttatagtaaaatgcaagaggagagtgataaatcgagggaagaactgttaaacaaaaaggaatcaaagatgattctgaaaattctcagtctctccagatggcaaaagatgttaaaattaagaaatcacttttgagcttgtggcatagagataagtcctggcctagagaaaaagctaagtagtgattgtacaagcttttgttaaaatctcaggaagattaagggatcagagtagtattcagtcatacaaagggccctctccagagattaatggtgtatctcacagaacctctcaaataataggaccttttggaagcttaattgagttatctttcaaccatctcagcaggaactcaaggtagaagggggcctagctcaaaaagaaccttggatgtggcctttatgtaaagggaaatttactggagacccacaaagtatttaagaaaagtatttcagcaaaaacactgccaacttaaactgaaagggacggaaagagtacaaaatgaaaggaggctgttagatctccaaaattctactggcaggaagcagaatgataaaactactcagctgcaaacatgtgctacttttcatgaaaaaaggaaagatgactcagagggtggaaccaagagctatggtgaattattcccagcccttgaaatctaatcaaagaattctgactgaagtttgctaggctgggttttaaaactgctttggactgtaactcctttttatcttccattgcccacctctccttctctttttaactagaaatgtctataactattttactatattcattccttcattgtgcattaggagcaagacgatttgtctttagttttatagattgagaggaactacgctcaaggagcctcatgcatacctggacctgatttaaatgatgagatgctggacttcaagcagatgctgtaatgatatgaggttctcagggaccttgggaaatagtaaatgtattttgtgtgtgagagggacacaaatcattggaggccaaaagggtgaactgaggacagatgctagggtagctcccacaatccccacctcctggtttcacccttgtgggatctcgccatgagtgtggatggaacctgtgatttgcttctaactagtagaatttggcaaaaaatgatgagatatatgtgattatgtttacatgattatattatataagattctgagtacattgagctgcatagagagagcacgggggcaagtgagagccaggtgggtactggaaagctctgtgcctcactgaggaaaaataactaaacatgggcaaaagagatccatggaacctgagaggcaaggtgttattatatgcattctttggcaaacttgtcaggaggcgcataagaagaagcacccagatggttcagtcaacttctcagttttctaggaagtgctcagagaggtgcaagaccatgtctgctaaagagaaagggaaatttgaagacatggcaaaggcgaacaaggctcgttatgaaagacagatgaaaacctatatccctcctaaagatcccctttaggacgaaaaagtagttcaaggatcccaatgcacccaagaggcattctttggctgttttcttgttctgttctgagtattgcccgaaaatcaaaggagaacatcctggcctatccattggtgagttgtaaagaaattggaagagatgtggaagggcactgcctcagatgataagcagccttatgaaaagaaggctgtgaagctgaaggaaaaatatgaaaaggatattgcctcatactgagctaaaggaaagcctgatgcagcaaaaaagggagttgtcacggctaaaaaaagcaaaaaaaggaagaagaggaagatgaagatgatgatgatgatgataatgagtaagttggttctagcacagttttttttcttgtctagaaagcatttaaaccccctgtttacaactccttttaaagaaagacattgagatgtaaggctgtgtaacatttgtttttaaactgcacagtgtcttttttgtatagttaacacactactgaatgtggctttagatagccctgtcctggtgtattttcaatgggcactaaccttgcctgatacagtatgggggttgtaaactggcaaggaaatttaaagcaggttcttcttagtgcacagcacaaattagttatacatggggatggtagattttttattttcacttgtctctgatgcagcttatatgaaataattgttgttttgttaactgaataccactctgtaattgcaaaaaaaaaagtggcagctgttttgttgacattctgaattctgaatgcttctaagtaaatacaatttttttattagtaaaaaaatgttctaatccatctttccaggagattctctctcccttgctgtctttgaaaaagcaagttgccatgtgaagagggccatatagcataggagctgaaggcagcctccaactgacggcaagaaaatgaggtcctcagtctgacaacctgcaagaaactgaatgttctaaaagccacatgagcttgggagcagatctgaccccagccaaatctctgaagtccgcaggcaggaaatgaagatcagaaaaaggctattgtctcatgaatatgagccagactccacagaagctggagtccttcattatggagctaaacacatacacctggcttaggagtcagaaaaactgaaagagaattcagggaagtagagaaattgcaagcccagatgctgcttcataccaaagaagcaagtcagcaggtcagcaacaatgtgtatcagttccaaaatgacttacacaggtaccaagacaagacattatatacacttatatagtcaaatactttaaaactgttaacaaacttgctacaattgtctcatttgtcttttaaccttaatatcacagatcaagtttgtaatctcaaaagttcaccctggctgctgtgtggagtattctcttatctgctcatattacactgtgcttattcattcatcagttaatggaaatttgggttgtttcctgattttgactgtaatgaataatgttgctgtaaacattcatgtacagttttgtgtggacatgcttttctttctcttgggtaggttcctatgagtggaatcactagattgtatggtaaatgtatgtttaacttttaaagaaactgtcaaactgttttctaacatgaacgggccattttacgttcttatcaacaatatatgatggtttcaattttcccacatcctcaccaacatttggtattgtctctcttttacatcataactattttagtggggatgtagtgatatcttatcgtggttttaatttgtgtctccctaatgactaatgatattgtgcatctttgcatatgcttgttagccatttatgtacattctttagtgaaatggctattcaaatcttctgcccatttaaaaatcgagttgtttttcttattattcagttgtaagagttttttctttattctgtgcaaaagtcctttatcaagtctaggatttttgaatattttctcaacctagagcttgtttttcaacatttttttcttaatgatcttttgaagtgcaaaagtttgattttgatgaagtctaatgtatcacttcttcctttaactgtcatgatttttgtgtcgtatctaagaactctttacccaactcaaagttaccaaggtattttcttccagaagttttgcagttttaactcttctatataggcctgtgatccatttttaattcattttttgcatatgatgtgagagaagggcctaagttcatattcgtacatgtggatgtacaatggttccaggatcacttgctgagaaaagactatcctttccccattgatttttttggcacctgtgtcaaaaatcaattgaccataaatgcaagcgtttatatctgaactctcagttcttctccattcatctctaaggatatgtctatgcttacatcaatatcacagtgtattcatgtggctttgtagtaaattttgaaattgggtgatagaagtctttcaattttgttcttagttttcagaatagttttggctgtactttgcattttgatacaaattttaggatgtatgtgtgaagttttacaaaaatgcttgctggagttttgataggaattgtgttgaacctatagatctatttgaggggggaattgccatcttgacaagcttgagtcttccaatccatggacagggaatgtctccatttatttaaatcttcattaatttttcttagtaacgtttcacaatttttagcgtacaagtcttaaacttttattacatttatttctgtttattctttttgaggctttgtgaatagaatttttttaattttattttttgggcttgacattgctgatatatacaaatacaatagatttttaaaatactgatcttagatcctgcagctttgctaaattcttcgattagttctagatattttgtgtatagattccttggtgttttctatacgcaagattatgccatctgcaaatagaagcagttttaattcttcctttactctcagtctgcttttaatgagctattatgtcttctgttctgtattggtcaaaccctcacctggatcacagtatttattactgaccatcacagtttccttgaggaaatgaaaaaaattaaaaagataaagtaactattaccataatccctacattcggacacaatatttatgagcatgtggggtaaattcttccagacactcttgctagaggacgtgtagcagagcttatgatgcactgagccacatcctccagccaccagattccagtgtagctgtggtgaactttgccttgcactttaccagtgtccatataagctcatatcacagtgtctttctgttttgctttctggaggtcagggaagcctgctgagctatatgtagacccaacccatattttcaaggtaatactccttagttgatagaagccctcagtcgatgggaacaggatttcatggattaatgccccagctcccccatcctgcaggacatagaatgtgtgactatccaagatgcttgcaacatggtttctcagagttcccaatggaattgaatcccagctgcatacaactgtaacccactcatttattaacttttctcccttcctctttcccttcacttctgtttcctaagactacttccctctaaatgatctgcacccaagtccttgtctcaaggtcttctagagaaacccaaactaaggcagtttgtcaagggacaaactagggtacatctttgaaacagtcattaggagagtgagaggtcctgcaacgatgtaatataaaagcagtgaaaatagctgagaaaattagaaaaagagaaaacttacaggaataatcatagtcatctttaaatacctgcaaagtaatcagatataagaggaccaaaggagacactggttttaactgagcaccttccaggttatatactagctactatgaagtgtatttattccatccttacagcaacccagaggcaatgagaactacccttatttttcaaataagaaaactgagacacagatgattaaggaatttgccaaggtccaaagctaacaggtattggaactaggattcaaatccaagcctgtctgccccctaacctgtgtcttgctgctgtgtgttttgctttgaagggcaaaacagagaccagcaggtagacattctaaatccatagaattgtgtttatatgaatgcagtgtgtggcagagattgtctagatgttcatcaatgctgttttctctgttctgtttctggacatacaggaacacttcatgtcctagcctcctttataagtagattggggccatgtaacagggttctggcaaatgggaatgtgcagatgtgatatgtgatgctcctgattcattcattctgtctctttctctctctccctctcagctagctgaaagcagagaacccagcagaggattctgggaaggtcctgggggatggcagagccagcagagagagggtatggatccaccaggcataggatggaacagagcactattgaccacagtgaactggggcatgggcaatcaataaacacatattagattaagctattgagactcagggatttttatacaactgacattccctaagaagccatgatcttcctgtctcaggaggtgcataagcagtggttgaatgttcaacagtcaagaatgttataaaaagaggttcttgggagagtggacctgatggccagcaaaaatcatagctcacatttattgagttattatggctcaggcatgtgcacatattcttttatttaaatctacaatatgctttatcatgctcattttatacatgaggaacacaaggcatggagaggttagataacatgcctaagatcatgaagcaagcaagggggagaaaagatacccttctcactccttccagacagctcacttcaccaccactccccactgtctctaaagcaaaagttatttgaaggcttagggactggtttggtattatccatgcagggcggtttgttttgtttttcttttaaaatttcagcctatgcttaaaagatttcatgtaaaaattctgttttctagtttctcttgaaaattaagaagatctggtaaaactgggcttgaagaccattatggtaacaggctgctgaagctgaggagagggccccttcagatgggcataagcactgctccccctccccaaccccccttttaggttactatcagactctggaagcttctgaatgtgtgaaccctgaaagagtccatctaaagctaagttctccccaggggtagagcccaatgctgggcatacagtagggactcaatggatatttatcaaatgaatgaatacaggtggaattcagatccgtttggcctctcttttctgtgactggggaccactgaacctgagtcactaagtgataactcacaacacaaattttcttcttgttccaagcagccaggacccaggttctaggtatctaaaaatgctgtgcctgacttgagttcgcaatgacattttttatcaactgaaaatgtttacttctgtgcaaccagccaaagctgggggtaagcagcccagtggggtgcgctgattctatcttagattacgctgtgcacaatggactctttgtaaagtccttatggcggggagtggccaggcaggcatctcctgcacccagctctggagactcacttgccacaaagctgaagaaggacggggcagttttaatatacctggcttagaaaagccacagactgttggacttacatgtgggtgtgtaagccccacacagaagcagctttttctccagcattgttaacaaagctcatttagaggaatgcaagtctggggcacggcctggatgggcagcatgacgcacacaccacataagctccagacgctcactgatccccttcacagaggctgagcctgcccacccaaccctgccctcgccctcaccctcacctccgcagccggacctgggatagcactgcttttcttgagaggactgagtcttagcattgaggatgggaaggggagtgtaagggctcttccaggagagaatctcctgcttatttgcatggaggaagaagggagcctttcccagtgcctacacgtctgagtcccaattgtgagagaaaatgaattgcttaaagttgcagttctcaaccagaggtgattcccctcccaggggatatttgcaacacttggagggatttttcatggtaatgacttgggaggggaataagggaggtggtgctatgggcatctggtgagtggaggccagggatgctgctgagcatcctacaaagcataggacagcccctcatggcaaagcattactcaccccaaatgtcagtgtgccaaggtggagaaaccctgacttaaaggagggcttttattaccttttaagcttaagaattataaaaggcaatttattgttttataatttaaaaaaagggttattttaaatatggacaaatatgctgaacttcccaagtatcaccttctttcattatttgtgataacagtcttggcatatagcaagtgctcaatacctatttgtgcaatgaatgaatgtcatactgtaatagtgtcttttacttaatttgttataacatggtcacttccttcattgaagcagtacacaggttctagggggagggctggggatagatattggacagtttatttacttacttatttacttttctgcttctggctttagcacgtgggcccctgactccagctttactcttttttttttttttttttttgagacggagtctcactctgtcacccaggctggagtgcagtggtatgatctcagctcactgcaacctccgcctcccagattcaagtgattctcctgcctcagcctccggagtagctgggattacaggtgcctgccaccatgcctggctaatttttatatttttagtagagacggggtttcaccatgttggccaggctggtcttgaactcctgacctcaagtgatccacctgcctcagcctcccaaagtgttgggattacaggcatgagccaccatgcccggcccagctgtacttttaaaaaaatgttgtccgatttgctaataagcttggcctctctcttttctcaatccttttgctattgtttgggtggatttgacttgataaatttccaacccatctgtataagaaccacatttgatattgatatggattgtagccataaagctttttttgctaaggaagaaacatttcataattgaaaaactgaattgttacatatatcccttgagttacaaaaccctaaagaatttcatattgttcaaaatgggaggccaagtgaaattctgactcatttctggtacttcttgcctctcacccaaattgctgatggtcctgtagccacattgactgcttttctcatatggctgatggtttctttatgggattatcactatctgaaatgctatcagatattattagctcattttcctgtctttccttttctagatgtgagttctctaagggcaaataccttgttcttgctcattcactgctttatcctcattgcctagcatggcgcttggcacagggaagacatttaataaatatttgttgcatgaatgaatggcagggcagagaggccagagactgagtgacctacctaagatcatgcagaggcccgtcaggagaatcggtcatgaaactgggaaccaggttaaggtcctctgcatttggcctgcccacatcccctgcatatatactgtggggtggggatactaggcatgccatccttgtaccacaggagttgcccagtgagactcaggactactaggatgcagtatagcatcatcatctcccagatgggagggcccaccttagaggtgaccttgtgacgtgacacataggtcaactaacccggttttcctgggactgaggaatttcctggggtgcagtactttccatctgaaaaggggaaagtcccagttaaactgggatgaactggtcaccctatgcgacagaaacattcagtaaaaatctatggtgccctgcagtggattcttcctttgggaaactctgttaagttgtcaaagaatcatggactctcagcggtggcagggagagaccttagtgatcattgagtctggatgttgcagacttaagtgtctgcgcaagtgtgagaaatggggactatggcaaattggggcatatttgcctcttgtaaaaggaggtggccttggctcaatgttgcccgtgggaataacagcccatgtggccagatgggcctgttttcaagaaaagcttgaaatctccctccctctctctccctcctctctctctctctttttctctcttctctctatgtctgtgcccacacatgttcacccatgagtatgtgtggagagagagaaaaatgagaagggagaaatagagggaaatctgatttttaacactgcaactactttttaaaatgtaaacactatgcaatgcaacacaatgtagccgcaggcaggtccgccccataggccaccaactgacagctgctgtcgtctgacatttcatataggcagatactaaaacagagagcagtaaatgctgagctaggagtgtaggatccaggcctcttgaccagagagctttgttaaaagactcatttctataaagatcagttactacacccaattttcacaatatccctttgagcaaattacttaatctctctgtgtctgtttccttatgtgcaaagaataatagtgtgtatttcctgagcttgtggtaaagatgaaaggtatgaattcgtgtgaagcggttagaaccatggagtaagcgtgtgttggctgtcatcatcactgaggtaggtgctgtcatcaccctcattttacatgtagagaaactgatttctcagaggttgcctaacttgccgatgatggtatagcaataaatcagaacgaagagttgaaccctggctgtttgactctggtatcaggggtatttttctctgtaccttcttgctataccactaggctggtgttataaattcaagataagaaaaacaaaagccaggtatttttcccctggtaattattgtatagatatattatcaaggccagaagttaagtcctgtgttatttctctctgctgtcagctaagtatcatctgtaatgacggaagggaaaatgttacatagataataaaaaatggtggataataaaaataattgctgcttgggcattcattatgcaatttggggggcagctaatttatcttcctaattatattttgcttaagctgattttaaaattagtttgtttaccctgagcacgcactgattaacagcagagagaggtggcccagaaacatcttgggtggtagagggaagatattttgagattcaggggaatttctgtggataatgttcatgtagctatgggaaggtagaaggctgataggttgttggtgctctgagtgtaattaactattgtgatttgttgttgggagaatttaaatataaggccctagattgcagactcagagaggggaatgaaccccaagctccttcttgtttattcttcagtgctgaggagagttcagactgtcaatgtaggtagattgaaaaaggagatggagaaggagagctagctggaggtgaccccaggaatttcctttcaatcgatacccaaggacgattaagtgcctattacgtactgctgtctattacatactgtgaattatgcccagagctgaggatgccaagatgaataaggccattgtcttaccctgtggaactccacaatctagtaaggaacaggcttataaacagagagatcacagcccagtagaatcagtgttatcaagaaaacaggatcacagtgagagcagagaagagagaagagagggtggctatcaccataggggaggcaggaaaggaaggagctccacccctcactcttcctctgttcacccactttctgggtagttgggggaggcaggaatggggtggggaggtaagggatggggtgtagaaaccccttcaggttcagtgtcagctggctgctggctgtttcagccagtgggaggtgctgggacaggctggaggatgggagaagaggaaagtcagggtagctctcccctttctctgcctggagtggcatcttcaaaatcttaaaagcatatggtctctcccatgagtccatttcccactagacaggtccactggggtccagcttcagcagggtgatcatggcttctgagctctggtgactttctttaatcgcccctccagcctctgggtggtaacagttttttactggtgctaaaaaactgtctcactgtctcctggttggtgactccatgttttcatcctctggaaaatcaatcccatgcattaaattcactctatttaaatatagtgggtggctctgatgggtatgaaaggcttcccagggtaactcatacttgaactgttttttaaagaataaaaagatatttgctaggttgagacacaggaagactgtgtctgaaacatacttggaggtgtgaaacaccggagtgtggggacccagaagggacagacatcccagcaggtgagagccactaaaacattagaaaggaaatacattgttcaggtattttagaaaactcatttggccagctctgctctgtatagattagcaaagaaaacatgagggtggctgtgaagactagttaagagacaatcacaacgattcaggctataagtcatgaggcgaactatatatgcacatagaggcgtgatggataaatgtggatagaggacacactctagctattattctcttaactatatccaaggagaaaatatcttattttcctggcatacaataggtgcttaataaatgcttgctgaatgaattagtaatattctactagcttaatttgtgttatgaaacctcagttccccacatgtctttcccttaaccaaaactctgacctgtcccatggagtctgttgcctaaggtcaccaggtttctgcctccctgtttaggacagcatggggtcctcccacgggtgctctggcttcccagccctgctctagagcatccctctctctagttactgactgcccctcctccatcagagccattcaatcagacggtatttacagacacttacatactaatagctggcactgtgtgggacacttgccactcatttatctcgatccttgcaaccacccagtgaaggggctacctttatcctcattttagagacaaagaagacagatagaggcagataacttgtcctgggtcatgcagctagtaagtggcagagctggaactcatacccaggtgtatgactctcaagcccaggttctgagccactaggctagattgcctggtactgggtgctgtatgtagctggagatataaagaaatggaagacaacgtgtggggagagaaagtgtgaatgcacaaagaattaactctgatgctaaaaatatgtagtgattcaagtcaacaaatgaaaagctgccacaaagcagaatgtcgactgccagtataaatagggataaggggaaagagagatcatcctaggctggggtaatcaagggaggcttaaggaagtaggtagtatttaacctgtggctttcctgctagttaaggagacatgctgaattcttctaaaacaatgcaagagcaactgggaggtcactagcaggccagtgcaaattgcagcaggaaattaaagaagggagagatttgtataaactggagaaggacatctggttgattctggagctctgagtgcctgtggatggagcctgggtgggtggcctgtgggtggaataccttctaccaactttgcacaaccacctgtagccgactcttttcacacatgcacgttcctaggttgaaataggctccttccaggactccaggttttcctctgggtgtggcctgtcctcagtctttcttctcacacatcacctgtgatcccgcggcagggaagacagatcccactacacctgagaaagagggaccatctcttccagttcttggggataatagaatgacaagcaacacatgagactcaacatcaagtgtacttacttgatggtatactccttaggtaacacagggaaatggcccggtgactccaggagggagtcagggagcctgagcatgcaggtgagagaatgcctccttgccctctgtggtaacatctctatcttttaagcatatccatcattccttcccttgtggggactcctgccctactctatgtggtctcaatgggacttgattgactatgtcgccctctaccataggggcaaggatatataacccagctggccaatcagactactccatcctcctggccatagcgattgagccaagcctggtgaataggtagtgtgatggttaatactgagtgtcaacttaattggattgaaggatacaagtattgattctgggtgtgtctgtgagggtgttgccaaaagagattataatttgagtcggtgggctgcgggaggcagatccacccttaatctggtgggcacaatctaatcagctgccagcagatataaagcaggcagaaaaaacgtgaaaaggagagacaggcctagttttccagcctacatctttctcctgtgctggatgcttcctgcctttgaaccttagactccaagttcttcagttttgggactcggactggctctccctactcattagcttacagacaacctactgtgggaccttgtgatcatgtaagttaatatgtaatcaactcccgttcatatatgtatttgggttggggattggtgcgtttgcatatatcatattagttctgtccctctaggagaaccttgattactacaggtagcccctgctctccagcagtgctagtcttgagctgcaggagagcaccacttaacaatggcagggccccatgtgagcccacactggctaatgtgctgcagttgttcaggatttagcctggagcctgcctaggatatgaagggttggtctcctctggtcttttgaagggtgcatatccagagactctcagttgattcttggttgctttggagatttggggtctttcagtgctagactggtttaccctgattaagattaaattttacttcccaggacagaagcacataatggttacatttaaagttaaggttatattttgctttctggaacacagacacataacagaggcataaacctatggatctttgcaccagaggtgatttgaagagggaatgcaggcatgcccacccctagccccttcatctaggcatcctgttaaagcaaaaggagtttgcatatatactgacaagttttcttccaagaatattgtaccaatttacattcctactaaagagctgaaagtgcctttttctctctgccttcccaaagcaccaagcccaggtgtttaagtttaaaaaaataatcaattttataaataataaattatagtaatctctcagcatgcattggggattggttccaggatgcccgctataccaaaatctgcacgtactcgagtcccacagtcgaccctgcagaatccacagacaggaaaatttggctgttaggtttcgcatcccatgaatactgtattttcaatctatggttggaaaaaatccacgtgtaagtggaactgcacagtccaaacccatgctgttcaagggttaactgtagattgtcgtatactaatttgtatttccttgatttctaaagagttggagtctttttcatatttattgtctgtttatatgtcttcttttatgaattactcctttgggtgttttacaattatttaacggtatgtatatctttttctttttgatttagtttagtttagttttgagacagtgtcttgctctgttgcccaggctgtgtgcagtggtgtgattatggctcactgcagcctcaacctcctaggctcaagtgatcctcccacctcagcctcccaagtagctggaactacagaagtgggccaccatgcctggatatttttcttattttttaatagagactggggtctccctatgttgcccaggctggtctcaaacttctagtctcaagtgatcctatcacctcagcctcccaaagtgctaggattacaggcatgagccaccatgcctggccttttattcttttttaagagttctttgcatattacaaacttatctgccttctgtgttgcaaatcttctcagtttgtcattttctttggatgtttattatgaattttttcaatgtaattgcagtgtaatttatataatttacatacaataaaatgcatccatttaaagtatataattcagtgagttttgataaatgtgtaacaacataaccatgaccataaggaagatatagaatatttctgtcacctccaaaagttctcttgtgccattttatatggatctaatttccataattttaggttacttttttcctattcttggatttcatataaatgaaataatataatacatacttttccacaaagcatgattttgaggctcacccatgctgtcgtattagtagtttgttcctttttatcgttgtatagttttccattgtatgattatcattttgattatacatttgattatccatttgatttgattaatttgattatccattcacctattgatgaacaggaggtttgatttgatttgattatccattcacctattgatgaacaggaggtttttcagttttggtctcatgagtaaggctgatatggacttctgagtacaaatccttttgtggacatacattttcatttctcttgggtgaatatctagaagcagaattgttaggtcatacataaatatgtatgtatacatatacacataagcatatacataattttataagacactggcaaactcttaaaagaaatagtatcattttgtgctcccaccaacattgatgagcatttcagttgctccaaaggtctatcaacatttagtactatagtatgtttaatattcgccattctagcagacttttttttggtattttcttgtcagtttaattagccttccctgatgactaatgttgttaaacatctttttatgtgcttattgggtatttatagatcttcttttgttaggtatcctttcaaatgttttgatcttgtttaattttttttcttttttttttagtttcaagatatttttatgtgaggaaaatataatcatgtatgtagtacatttcctaaaaataaataaataaactctcctggaactaataagtaaatttagcaaggttggaggatacaaggccaatgtatgagaatcaattgtttttctatgtatcgccacaaaaaattggaaaataaaaatttttaaatgattatttatatctttaaaaatctaaactacttagggataaattaaaataaaatatatctaaggcttatacactgaaaatttataaaatactactgagagaaattaaaatatatacatcaatggaggaataaatcatgtccgtgtattgaatttaatattgatgagatatcagtttcccctaagttcatctgtagatttgaccaatcccaatcgaaacctctacaggctgttttgtagaaattgacaagctgactttaaaatttatgttgaagtaaaaagcacctagaattgctagaaaaaataaattgaaagggaagaacagagttggaacactcatactgatttcaagacttagaataaagctacagtaattaaataaatgtggtactagggaaaaaatagacatatagataaatggaacaaaatagacctgcacatatacaaccagttgatttttgaccaaataatcttgatgttatgtttgggttaatgagagtattcttcattttaatattgaaatcatgttaacttagtgagagaatgcagaaatagtggtattaaagctaatggcaagctagcccattacaatctaataatccgtggccctgatttaccaatgggcagagagaaaatgaaccacttttgcaaatcacagagatctaatttgtaaattgcctttctcagggtacaagtctgtaggtggcccccaaataattattaactattcacaatagttcttagtagtaattgacttatttgaacaaacaattggttcccatatttgctttaaccagacttaaggactaaacatacttgacttcaaatatagaagacaggttaaaagggagcacttatcttactcttgggaaagcgacattaaaatgatttatgtcttatttctcaaagtagccatttgccattgattttacccatgaggcgggcatataaacaccaaaagaaagaacaaacagtaccttctgaattcagtttcgtgatagaaatgagggtcagaaataaaattatgaaaacctttggggaacacagcaatacaagatgagagggagttggagaaatggcttgcatggtaatccctgccctctccgagtaatgtctccctccacatttcttttgtctttcagaagattttgctttcatttatttaagggtagggttcttacatgtggtgttcacatatatcagttgaagtaatagacaagaacactttgcaaaggttgacatgctttataaatttaaggtgttattattgcacttctgaaagtataatgaagactaaaaaaaggtggttatctactgaaaatcctttggtgatagtaggactttaaaaaaatcttcatttcccgtcaaataaccactatgaacagtttggtacaaatttttcccatcacagcttataaaacaaaaaccctcattacagggatataataaggagtttcttttccccagttctttgggtctggcccaaggactgggtcggcagctgttttgcaaaagctggccactctccttcccccttttcatagtctctgcccaattggccagcaaattaataaggcttcatgtcatccagtgttttagttagaaattaacaaagtaaagtctcataaaaaatgtttaggagttgatggtatgtagagtcacagtttaagaactccatattctttacaagcagagtttcttcactatttctagctttccccactgatcagttaaacgtggccttgtgaccccatggccttgttgtcttcttctttgtactctgctgtccctgttaaggacactgaaggccaacctctaatcttacttcctggtaaataaatggtgcacatgaccaggatgaaattctaaatagctcaatgctatggaatcaagtgccaagctaacgtgagagtccttggaagaagaagagggagtgaagagcacaggggttgacttggttgacttgaggttaaaataattggcatcacatgcttcctgcccttgtaaggcatggcgtatttaaaaaccaattggcattgtggaacctatcctagctcttttacaaactagccaagtgggcaatggtagattaggtagcttctgaattgggggctcctttcattcatcatggggatagtaatgtgtgtgttgtacctatctcttggtgttattctaaaaattgtatgcgataataaatgtgatggggttttataaaatataaaacactaagaattcttttaaggatgataccttttgacccagtcactctgcagaagaaagaaaagccaagtgttttcaaaagcagaggtcaaagctataggtttacttctacttgctcagtcctttactcaactcattcagcatatgtctgtcaagatctacagaaccactcttctctcaccttatgggaccaaatggtgaaaagagaaggtaggcacactagcttcatatccaaaacaacccatatgccctgcttcagaacccacccccaactctggaagactctcagatttcccagacttgcattggagttaacaggattcacctggaacagaaggtgttgtctatggaagcatttgtatatatgtgtgttggggggaacatgtatctttgtggtggggaagggacacagcaggagtgacttgtgggggtcagaaattacccaggcaaagcagctctgggaaggcacaggcagagctttggggaagttctgcatttctgtctccacattcatgaagttcaatattggcactcataactgactacaagccaggctcctgggcccacaacaggtcaaaatagtggtatactgatacatgcttaactggcttggtaggagaaagggtagtaaataaagccctgatttacagtgttagccaaattctctggtgtaaatgctcccaccatgtctgagttcaagctaccagcgtgatgtcactgaacatggagctggaaagagatgtgcagtcacacatcatacacaacagtctcaccatacaaatctcagagacaaatctcttcaagtgcactgataagagaaagcgtaataaaataattaggaagtgatggggtttaagtattgattactcttgttttcaatataatttatttaattacttgcctgtataatttaatttttaaaaatgacagtgtctaacaaccatcttgaaaaattcctgaaattttcacactcagctctcatgaaccagtacaggcctgcttcagcatagcactgggtccaaaggaaaagaagaaaatgctgagtgtgtgggtggaacatctaacctcttcggacgtacaaggctcctgcctatgtcatcctttcccctggcatggtaagtgccctaaaataggtctaagacagacaatagggcttctctaaccaacaactgcaacaacaacaaaaacaaaaacaaaaacaaaaaacagaaaaaccttctccctactggcataaaaattccattgtacctcatgggctaaaccatatccatgtagcagatagatatgggaaggattataggaagggagagttttgaggtctaagaaagataagaacttagctaggcatggtggatcatgcctgtaatcccagcactttgggaggccaagctgggcggatcacttgaggccaggagttcaagaccagcctggccaacatggcaaaatcccatctctactaaaaatacaaaacttagccaggtgtggtggtgcatgcctgtaatcccagctacctgggaggctgaggcagaagaatcacgaacccaggaagcagaggttgcagtgagctgagatcgtgagtgagactgcctcaaaaaaaaaaaaaaaagaaaaagaaaaaaaaaaggaaagataagagcttggattatatcagaacagacaaaacattatcatagaaggttctggaagccagctgtggcatttggatgctcagtgcttaggttgaggagaagcagaagaaatgatggaaggaaactctctgcacttcacaattctgccctgggcctgtcctggcatagttcttgaagaacaacatttcttcatgagattctttcggtaaagataaaaaaaaaaaaaaaaaaaaccaacaaaaaaaaccccacaaccttctgtggtcaaagaaacacatcttctaaaataggtctcccagaattcaggccaccggcttgtcttcggtaccataatgggatacaaaatgagaagggcctgaggtctaggcattactaaatcctgccccagtgagtacacacagagaggaaaatgaccaaatgccatttcaatccattatcaacccaatatacttctccttgagtggaagcagagttagaaatctcattctaaaaataacattgtgatctgtggcctggaataatgacgcctatctaaggccaggttaaagcatgtgcacgtgtgcaagtgtgtgtagggtagggtgagagaatgaacactcccttgtgtgtatatgcaacagtcattttcttttctatttttatatatttttctaggcagcagatgcaactctggagtgggggaagagggcgggaagagagcctgtgctgctgagcacctaccaggacttgtcagggcccaggcaccctatgaaacaccttatgttggttatcccacaccaagctcgcaaacctctgaggtaggcaactttgtcacagagagaggctgagtaacaagcccaaagtcaaacagccaagaagagacagaactgtattaaacttatctactggaccccaaagaccactcttttccctacggtacagtacatccttccctatccggaccggagttggccacagaagttggatcatctccattcctgtatacccggcaccacattggtccctagcacaaagtagggttgacaaatatttgttgaatgtagtgatttcaaaacaaagatttaacatctgaaagtttgcctggcagcatgtgaattgggaagagactccacaactctcctagatcctgtgacatggctctaagtgccaagacattaaaccaggtcatagcaggcactaattcctgtattgcattaacagttattggtgtattcataagtgtggccctgcttgtcaacactcctcaccattctttgaagtcagatgccccttaatgataaggatgtgttgggttgtacaccagaccatgtctgtttttggctttgggccacaggggtgcttaacactttgagaaaaacccaatagaggaatagctagatttacaaagaaagaacctgttggggagtgtttgcattacaaaattatttaccacagggtttgtttaaatagttccaaatttagattgtgtatagaatatgaatcaagacaccctggccgatgtgcacagcactttccagggcacgtcgatgcggagggtgcagtggagtccttccacacctgccccttcctgtgcaagggggcacgcggctgctccctcctgcatccacctttctcctatccaggaagagagatgtcccctcaatgtatgctcaggaagtctggtgaaaagacaagctggctgctcctgagcaggaaaatttgagtggaaaaatagacttggagaaattgaagggatgagtagaacggattgtgacatctgctaggaatgtcacctcaaacccagaaaacacccagcccagggagtgaggcccaccctgcgggaccgtgtgcccaggactcctggggagtcttgagggagaaacacagcccccacagcacagagcccccacccatttacactagctggctttcaccacacaagggggtaacatgagccaaatgtttgatgatgaggaagtgaagtggaatgtgagaatcctcactgctgacgtcaagctagcctttcattttatttatacccatgacactgtgacacaggatctaattttccattgtattttttcctctgttgggaaccaagtgatgacaagtaaatttgtgcctgagcctggaaaatattttaaatttgaagacagggacgatacgagagtctaagtctatctccatcctgcccctctccccttgaattactaaattaactatggaacagggcaaaggagtaacactctgacagggcatggcagcctgagaagtcagagctggaagcatccagttgcctgctcttcacttgtgtcaggctgttccttcctggcacgggggctggagggaggccagggagcagcgaggctgcacggcagccctggcacagagcctcggctgccgtctggggatgaaactgggctctggcaccaggagcgtggttccagctccctgacccagaactgcctgtgcaggggctgctctgccacttgtgccctggtgggaccccactcctcctgcccctctgaggcagggcagattcaggagcagagctggatctggatggaatggcaagtcagggatgctggggcgaaggcaagtcatatcccttctgcagaagcagcctttagggatgtgcctgtgatggggaagagaatggcatgtgtgttcagcaagtgacagagtgggctttaccgcagctccttcctctgctgccagaccagtggcctcagctccatcaacagcctccctccattactccccatggcttcaggtccagacacagcatttctaacatgggtccctcctcccactctgaaatggaagctccacctcgtccctgcagacctgccatgttttcagtagggcctcttttcaccagctttgcaatcatgtttttcagcctctaactccagagaaatcttgacttccttgtactcagttcagaagacgtttgttattcaggattctgatgcagaggtctgataagagaggcctcaggccttctgagttagtaaaaccaacagagtctggggattcaaaaaatccaagaagcacaaggacagccacaccctgagagttggcgcagtgccagctcctgtcacttgaactcttccaggatatttagacatgggtgtcagtgagttttcactacatttaccttggtggttgtgtttgattttgtttgcttgcttttggaaacaaagtgtttcccgtagcaccaacacagtcagacctgtgttttattgataagatgagagagcataatagcaggggcgcagttcagctttgggaggtgggggctgggaaacccctctgtagagctacagttcacataaagcctagaacggtgcttctcacgttttaacgtacatcacaatcacctggagggattgttaaaacacaggtttcaagggctgacccccaacgtctgaggtggaccccaagaatttgtgtctccaagttccaagtgacactgaggctgctatttggagaccacactttgagaactactggcctaaatggcaagtaggaagtagccagggaaagagagtaggagaggaggtcagagcaggcagcagcagcatgtgcaaatacccgagttgaaaaggagtttggtggctgcagggaatggaaagatcagcatgtctggaaggcagtggattggcagctgtgtggcttgaggtaatctaagagatacacctgaccctcatccccatcctgaaactcactccaacgaagctacctccagtttgtcttagacacacctccagtgtgtctaagaagaatggttccactgagccctggaggtgtgctactgcagcttgggataatcaaactgtgccgaccctgtggatagtgtgagtgctgaaagtgattaggtatgcaaagggctgagtgcagagtaaatgctcagtgcactgtagttttctctcctccctgacttgaaacacggctctatctcaagttccctattttagctatacgaagacatgttcctgaattggtgctgaggtgctatcctgcacctgcaagcaaaaaggattaatgtggaggttacccctgagacctgaactagggtcctgttgagtagatggctatagctaagaaatctggatgccgcttcctaagagcagttttgggcatgtatgtgttttcctccatcatacccaactgataaatgtctcaggtttttaaaccaaaggaagcataggttaggtttttggagccagagtgcacaattggccttagatcaattcctttcagactgcatttattgagcgcttactctgtgccaggtacaatattaagtctgggaagacaaaagtgaacaagactgggtcccttctcttaaggagctcatggtctcactgggagctggacacgtaattaaccacagagcagtgggataaaagccacaacaaaagtctacacagagggcaaggaaaactcgggagagggagcagttctgcctggggatgtcagagaaggtcacagatagaaagtgacatctgagccaagcctggaaaggaaacttctagagaataagcaggactgaggataaaggaacacatctcctttaagaactttcttgttattgttttaagctctgaactaaatcatcgttatgagtttctaggagatacatggccacatggtgttaaatttgatttaaaatattgcataagccgatatatatagaaacacatatggaaacaatctgaaaatatttctcctcaaatatagtgccatttgcttttacgaatttgctatttctagataaatatgtgaaatatggtttggtcttctgagactcagaagaaattatatcactgtcccaagaaaaaaataactttggttgctaattcattcattcatttagtcagtcaacaaacatttagttaggaatttcaatttttgaagcactacaatagtccatcagggtaaacaaaaagatgtaagacattgtcttgagctcaggactcttcaaaacttgggagtgagaaaaatacctgaacacaaataattctaacacgaatcaggagtatatgatatggatgagtacaaagaaaatgctccaagtatctagaggaaaacaagctattttctgatggaaataattggagaaagcttgatcatttacgaaggcgaattcatttgcataggccttgtagtgtggaaagggattggacttaacagaaacaagcattggggaggtattccaggcagatggaagtttgtgaacaaaacaggtgggaaacctgaggtcacttggaaatggcactttgtcctatttaggggtatgacttggggaaagaactgaaatagatggatgtcagtctcacagcatagtttgaacttcattccactggctgtggcttctcggaatttgaaatgccaagcatttgtcacttggttccttgtacatttgtttcagttggcacctcaggcttgaccttaatcctggcataattctgtccggcccatagaaaaatttttaaaatatcaatctgtgtatgctgggagtagtaaaatcacaatgcagctctaaagccacagattgaaagttgacccttttcttcgggaatttatgattccacatctggaggttgcaagagatgggttttgtgtccaagtcccttcaggaaacaggtgagggcttatttacacaggtgtgggcagggttaaaaaatggtgcagtgtctgtgggctggtgagagccaggaagctgtttccactccctaggcaggtggtaatggggcaggggatgaagccaacaatggaacttggaaagacttctgggttgccgcggagggatggaggtccagccctgtgctcgtgcctttcattggctgaacctgactgactggaagccagagggccagggacccattgatgaattccccacaggtcagactcctagggcacaggatgaggggaggaaggatggagatgatctggaggggcagacagagcctatccagcacaatcctttctagctttaatatttctgtgatgccaaaacaacccaaactacagtcagccttcatttgacaagtatattctaaacacccaactttttctcagcaatttatttattaaaaaaagaaagggagtcgattggatggatagatgaatgcgtggatggggaagaagcctctgactgggaaaattcataaaataataactcaactagattgcaagcttggcaaactcagggactgggctgggtttgttcattgttgactcctcagtggccagcactgtgcctgaactttagtaggcccacaataaacatttgtctgaataacctgactgatgaaacatcaagagcaccaaacaacataaaatatgcaattgggagtcttgggacaggataagtcaaagttggggtaaggagctaacatgcttgcacctaggagaagcagacaatgacggtgtttgttaattctgcttctagtaacttttatgccaaagcttctaagcacttctcagggaacaaagaacatctgatggtgatggagagataaaggacagtctgtccctcaatcataactagtcacttaaaagagcaacattagaacacttatatcccaacctcaattaattcatccatttatttatccagtgaaaatttattgagtgctgattttgtatttggaaattcagaaataagacagaaacagcctcagccttcaaggagcttagtctggttggaactaaagataagacattaggaaataccagtaccagtgctgactagggggagcacaggctgctgagggagcaacaggaaacctgggacaggcagtgggtgtcggagtaggtaagttgagcatggaaggacttttccacttgtttacttgtttctggcttccatccctccaccagccattcacccctccaccatcatcacccaaacagtatgtaagcaaatggtttgtaatgcatatttctttgatttggatgcatgttacaccagagtgccataacccagccaataaacacatatatagggtagagtctcatcagctaatcagtgaatgcatgtagaggtggtaccatcagccaatcagtgaacacacttggagggtatgctccttcctccagagtttttggcagagaaagagaacaagaggtcagaagagcacaaagtgggtgtctgggttggaaggaggagatgacaggtacaggaatagaggctggagatcttgtagacaaatctgactgctgaatattttggaggattagtactatttatcttcaactctttgcaaacaaatggaaagtatgtgaggaggtttatgtgtgcttgtttggcttttttggcctctagcaactgttgggtacaagatctcagaaagttactgatctgcatggtctatattaacactgattcatctgacttaagaaggtggttgttggctgatttttaaatattggcaattttgttacaaaattgcttcattctcagaggttttgttaatcaggatattcatgtatttaacttgaggattatgactggtaatgggaggaaaaagcaatttggggagaagaaacagaagggaagataaagaatagcaagtgagtcaaaatggaagggcgaatatttcctaatttatctatattgccctctttttttaatgtgaagcctactagagttgtgagaatttgctgaaaatacattttaattgttagttacatttgggaaattgaagtgctttttaatttactccctttctccccccatctcatttttcaaaggaaagaaaaatgcttctagctctagaaagtgtagcggagttaagtgtatgtgtgtctggggcgggggtggtggtgcgtggcatgcgttttattttctatgagaacattacttctgttagggaataactctccatttgcagtctttaaggcattttgacttttgatgaatttctttactattagcacactctgtccttggcctggaagaagttatgctgggaccaaccactggcctgagagctgattctcttaccttctggccatctgcttaagtctcctttgtcctactctctgttcagcccttgaaggtcagtagtctgttttgaagcttggtctgcaggtctccttctcagagcttcctctcttacctatatattgatgctgcatgaatttttagctgtcacccaaatacttcccttcacatgtagacctgtgtttcttcttacctattaggtatccttcctgggtgtcaacacactcaaaacttctccctctcagtgtttgttcttgcccaccctgtctctgtttttatgggaggtaccagcatccccactcacagccactgagtcagtcacccactcacatccatgtatatgatcccttaccaagtcctagtgtattcctgaatgcctttcctattctttccttttttttccatccccaaagccactgctctcatcagctctttctgggttattattgttattaattatctctctctcctccactggtcttcactatatgcttccctcaaccaccagctttttatttatactgtacacatctccatgactattccttgtgtcaaatctttcaggagctctccgttttctagctcttcgtgtcagtgaacaagtcgttgaaacagcttcattctctctgagcaggttttcctcctatcgcatgggcctcagctccctgggctctgctggtatctcctccgctgcgtgaccttgaagagttggcagacccagagtatggttctccaccctcttctcctttctgatggcaccctcctccccaccaccttaggtgacctcatccaaccccacagctcacagtagcatctatacactaatgactctcaaatttatggctctagccctgacctgtctactgagctcacacatagatccagctgcctctttgacatcttcactctaatagagattcttatttcacaaggcccaagcagaactcttgatttcccacccattctcttcctgatcctgtcccatgtctcagagaatggtactactgcccacccattagctcaggtcaaaaacctaagggttatcttgtttttttccttctccttactccgctccccacatccaacccatcacaggtcctgtcaaccttgcattcaaaattcatgcatcctgaacctgaccctctctatccatctcccctgccttctgcctagtaacccccatctcttatgtggatggctctgacatcctcctgccctagcagtttccacccttcatccctagaattgattctccacacagggaccagagggattttcagaaagcaaattatattgtgtttcttctctgcttaaaattctcccaaggcctcctccctggcctggactgttgtcacttccttgaactcaccaagctttttcctgccttaaggattttgcatttgcaattcccttccctggaatcctattctccccagatctttgcattcccagctcccttgggatgattcatgtgccagtttaaacatcccctcccagggaagccttctcagacttcccaaactaaagtggactctgcctcagcttctctctattacagtaagttgttttattatcttcagatcatgatacaatgatcattttcttttcttgttaattgtctctcttcctccactagaatgtaagcatcatgacaagtatggattcatcttacaaatttatcttacagatctatcctcagcacctaaaataattcttggcatatagtagttgctcaaaaatatttgttgagtgaatgaatgaatatataattgcataaatttgcctctgtgataaaatacctcaccaccgatttatatatatgcatgtatataaatgtgtgtatatctatatatatagatacgcacatacatatatatgttagcttgttagcatcatcaacatcttcaatctttgaagaagaaagactggaaacctgttcaagggaacctaaatggtgcatcccatttgttttaacctcatcagtgaaaccagaatggggttatcagtagataactgctgctcttccagccctgagtggtcgggcttctatttgtgtcctcttagaaaactattttcttcttttcccatatctttgcttgttgagttatacatcggaagcaggtagattccactgcacgtccagggtgaccagaaaccgactagccaccagccacgcgaaagccacctcactcccactcgtattccaaacaactagacacgcagcaccgtaggcaaagctgtgaatggggtgaagttggttttgttgcccttttccatcaccctagcgctgtctacccttcccagggaagcagtgtaggaagaagagagtgatcaacagagtcttatgaaggttttagaggcacaaagagttactgcaaaatagaaacatttacagtttttaaacttaaggatagagcaatgccgaagcaatttaaaaaaacattttaaggacatttcaagccctgtcaaatgtgggtggaggagatattcatgggcatgagcaggaggagggtggattctttggcacatctcagttggatgatgtcatattgactactacctactcgcccaggttagtccagagggagaggacacgggcccacactgagcctgtttccctactggcggtaaggatgcaaagggacagacagagagcagtgatgcaataatggaagtggtggctggttgatatggagagcaagggagaagaaggaaagccagatggccatggtttgaatttggagagttgttagtagcatgaaccactaggaatcagatttggaagggagatgatgctttatggttcagaagctttcgttgcgtgatattgatggaactcatgcttggagttgtccaggaggccatggggagcatgagagcagagcttcactatgcgattttagataccccagccccacctccagctagacttggaattctgtgcctttggtttcttttctcttttccttctttccttccttccctttgcttcagttccctttccttctctttcttcctcctgtcccttctctttctttcttcttcctttttctctctcccttcttcttttttcctcttttaaaatcttctaccactccacagtctcttcaaggtgcatggtaggtgataaatatccagtgggttgagtgttgggctctgtttcgctgtatgatggcagaagtggaggaaaaaaaaccatgtttaaacatgaggcatccaaagacacttaaaacctaacaaatacagtatcccccccttatccgcaagggatatgttccaggattcccagtggctgcctggaaccacagatagtaatgaaccctgtgtacactatgttttttcctatacatacgtacctatgataaagtttaatttgtaaattaggcacagtaagagactgatgataataagtaataacaaaataaaacaatcataacaatagactgtaataaaagttatgtgaatgtggtctctagctctcaaaatatcttagcgtactgtaggtcttagcgacctcaacatacaattatttttctttccttattaagtcaagaacttttatcttttcacttaaaggaagcgcattacagcttctctttggtatatagaatggccagcatcactgctcttgcactttggggccattattaaataaaataagggtgccttgaacaccagcactggaataccacaacagtaaaactgacagccaaggtgtctactcagtgactcacgggggatgtggtggaggtagtggatatagcatggagacactagacaaagggacgattcacgttctgggcaggacggaagcaggacacctctagatgttatcagaatggcatgcaatttacaacttatcaatggtttgttctggaatttttcaatttaatatttttggaccactgttgactgtgggtcactgaattgcagaaacttaaactgtggataagtggggactactgtatgtgcaaaccatcagaactcaggctagtggttttaagatactgtcaatttttatgcaatatctcaggaaaaaatagacaacctcccagttgccacagacatgtactgtaagcagacgtcctcctagtacttcttaactggctcttctggaaaattctcactctctcagaagtgaatagtatggcttttctttttcttttatagatagaagaggaattcagaggatttggtgcctttatccttcctcatcatctctttgttgtttttttctttttgttttccatttaacttatttatttttctttcagaaaacatttatttttaacctgggtcaatgtaccctgagtttttcaaactgtcctttaatctgttgggttgtttttgcatcagactttattaaagttattcttttgccttgctttaccttccacaaatctcagcctgcacttaatgctttactttctgatttcgttgctgttctgcttttccttgtctacccaggcctaaaaagactatgagtgtgaaataatgatagatcatgctgttaatttaaatcaccttggcccttctacctaaccccctttgcctcacttttccttctgtggaaggacaaagtatattcgtttgctattgctacataacaaagtacaaattcagtggtttacaataacacatatttattatttcacagtttctgtgggtcagagcctgggcatggctttactagatcctctgttttaagattactctgaaagcggcaatcaatatctcagctggggctgcagttgcatctcaaggctcagttagggaagggttcactttcaggctctcctgatttttggcagaatttacctcctttcagtttgttggaccgagggcccttgaacaaaggcaccctcagttccctgccgggtgggcctccccagtatggctgcatgttttatcaaagccagcaagagaaagcctctactagcaaaactgtataacttaatctatgaagtgtcatttggtcacctttgccatgttccataggtgggcagcaagtcaagtcacaagttccatccacactcaaggggaggggacaacacaagggcatggacaccaggcaatggggatcattgggagtcatcttgaagtttgtccacacatggaggaatgcttttgtgaaaaaatgcttgggctcctagaaaaacgtggcgaaggccatattcatactgcattcatgcctttttgtaggcctttatgactaatgtcaaaaataataatttttcctcgttttatttctaaaaatgacttatttttcttttctgccattagaaatctcatcagcctttctggatgagaaagtcagcaggaacagattgttgttggtcttggttttggctggactgactcagcactgtgggcagctgagaaggaaaaggccttgcaaatgctctctagaccttagttcaaaatccctccaccccagaggagccaggtatgggccaggcatggtaatagctgcaagcaagatgccaggaccatttaaggctgaggcatttaattaggtacaatgtattacttcctgaaagtgtatgaaagcttcatagtgtctgcttagacatttagtgatagcagctacctacccagattggaggggatttgggtggggggcggctctagaagcttagctgcacctttggtttgatccgtgtttgactcatgtttgtaaattgtccctacaattaaggctgagggataacttcagcccctaatagatttttctcaaggttttttctccttatgttgctgaggctggtctcgaattcctggcctcgagagatcctcccgccttggcctctcaaagtgtcaggattacaggcctgagccaccgcgcccaggagatgttattttcacattcattcttctacttggaggaaaacctgtctttattacatatgatgtgttatatatgtatagggaccaatatctctaacttgaaaatctctttaaaattatagtgtatatgattgtgagttgagggctgcaggcaaatctgatctttcagcgttttcctgggggcaaaggcccaacgagaggaaagtggagacctgtaaagggggtgttgggaatccgaatcctgagtcccaagaaaggctccaggtttggcagctccagcgaggctggacttccctcgaggggccaggaaggtgttgcccagagcggagcagctcagcgggctcaaagtcttggctccacaccccgggaggggcgctaggacccaggcacccgccggcccggggacgcgtctggaaagtgaaggcgcggaggctcaggctcgctgccagagtcccacggagcaaccagagccttcacgtgggcacgaggcccggggagtggggtgcagggtgcgccaggccggtgccctctgtgcggggctaaggcgccaggcacgggcaccaccagggcgcccaggagccgcccgccgccggcatggaccagctgtactgcccaccgagcgcgtgccaggtgagcccccagcgcgggggaccgcgcagccctcggccgccccctcacacctgggtacccggccgctggcacaagcccagagccggcttcagggccccctttcagacacccaggtgctagggtggctttttttcttttcttttcgcccttagtccctgcgtgtcctagtgccaactacctccttcctttccaggcgggaagcacctcgagcgtctagtgtaaccgtcaggtttattattcccaataataattgaccacagacagccgccgttcgcgtccacctggcgcttctcagcaggagctggacctgtttctccgtcgggccggctcctcgggctgctgttgcgcctggtgttttccacgcttccccggcgcgggacggtggggcccctgcattcctcctcgtgcttccagtggctgcaaagctgcctccccttctgagtagtgagtcgccggcagccccagcgtggggtgtgtacacgtgtgtgtgtgtgtgtgtgtgtgtgtgtgtgtgtttgcgcgcgcacctcagtgcctagctccagcgctcgggactctgcaatggggcacccacccctacccctacccctaccccaacccccacccccaccaccatccccaccctcacccttgcactaagttctagggacaacgctagctgggtgaatagacggagcgtggactaaaccacccgcctcatcccctgtgggaagggatgtttggaggtggagcaaagcaaaggaagagctggaacgtgtgtacaaagaagggtcccacgctgcggggtcgcaggaaagtgcccgggagaacagtctgtggtagggagggacgcttagtgcaagggggaagctgcgcaggcggcgctgccactctgaacttgggggcgttccgctaggcgttcagagtgtcctctgaaacgcacctagttaccaggatcaaagtagctgtgctcctaaggactgttgggagaggtgaggcttgcagcagcctttacaaaagcttggctagaagccttgaaccgtccacaggctcctctataccctcaagactagctgtgcccatccattctgcttctggctcaatctgacaccagtttacccgtccccaggttgccagctccagaaaaacactgctggcggcgaggtgtgagttactaggactgtaagacctccgcagttgagtggtggttatttgcccaggctgccttccatggacggtcggtcgggaggtcagggtggctgggggcatgctggctctgatagttacaagtgcttctgtctgaacctgaagttggacgtgcagtgctaacctagaagagagagttcctctaaactgtgtgttgggagacaatcaacgaaaacatttacacaaggtccccaggggaggcgagggccagaggacccgccctctcggattttataacccagcagttcgcattgccagttctacttgactgccctcttgaccttgaataagttattttaactttgtagaggttcggttttccaagaagcaaaaacagaagaatgacaattcatcagcagtggcaagagcatggattggaggccagggagttggattccaagctcagtggtaccactgaccagttgtgaaactcagggcaagaggtacaacctgtcctggcctcagctgccaggaaggctcagagcctttaattctggattccactctggcagtaatctgccagacttagcctgtgaatgctcactagttctttgcagtcttgctacagattgtacttggttccaaagagcgtttatggacggaagagatactagatcagtgggtgaattgaattttaattccaatctgttcatagggctacacaaatcattcaggcttaaagataggtggaagtaagcctgactggtttagttaatgcttagaatgcactgggaaggatctcacatagaaagtcctggtaaagtttgagcttggttatataatcctggaagacatcctttctgtgcatttgaaagattccagccacaacctccctgttacaggcatgagtagaggggaagccccacactaacccctcagtggaagacagcccagtcttgcagagctcatggaggccgcttacatcatatctgataaacaattgacttacctgggaatgactcagttaatgtcaacttctcagaaaagcagcttatcagtttggtaatgaaatagttaaattgtctttaaaagctgtattaaatattggatgcctaattgccagagcttattgagataagcactgcttttttttttttttactttatatacacatcttatttttatttatggagaatcagttaataaacacattttaaattcaatatattatgtatttgcttttttgataacactgctctttagctttttaatttagctttaggaagggaaataagcaggatgacaattttttttactagataattattataagagattaaaaagccacaaagaaccttgtttcttcaggttttcagagatgaatatcaacataatggtgaaaattttttaagtacttaggcgctaggcattggactaagctctttatgtaaacactatcatgtaatcctatcaacaccttctgaagatgtgctattattattattattattattattaattattttgagacagagtcttgctctgttgtccaggctgtagtacagtggtttgatctcggctcactgcaacctctgcctcccaagttcaagtggttctcctgccttagcctcccgagtagttggggctacaggtgcgcaccaccaggcttggctaatttttgtattttcagtagagacagggtttcaccatgttggtcaggctggtctcgaactcctgacctcatgatccacccgcctcggcctcccaaagtgctgggattacaggcatgagccactgtgcctgggcgctactatttctttaaattttacaaatgggagagctgagacttctcatcttagatgacacagctagtaggtggtggagctgaaccagccagctgggtgtatttacaatgatccaagcgacatgcaagaaggaagaaaaggggagggcaaaaagtgcctactacgtgtcagatgctttatacacctcagtgcatagagatttaaaaatcttttatgagtgataattttcttttctttttctacttggactttcttgctttcatcaacatgatctgggtgtcttttcatgtcagcaaagagattgactcctttatttttaactctgtaagcttgagagcagatgggtaaaccgtaatttatttaaccaatccctgtgaatgggcatttggattatttctcagttttcacagtcacatacagtacttgtgaaagatcacacagtggatccatttatttatatatttctgcatacctgtttagatatttctggtgaatctgttcctaggggtggaattattatgtgaaagatcatggttactatttaaatacatactttttttttttaaaaaaaaacagaatctccctctgttgtccaggctggaggggagtagtgcattattggctcactgcaggcttgacctccccatccaagcagtcctcctgccttagcatccggattagctgggactataggcgtgcgccaccatgcccagctaattttttaattattgtagagacagagtctcactgtgttgccccagctggtctcaaactcctaagttcaagtgatcctcccacttcagcctcccaaagtactgggattacaggtgtgagccaccgtgctggccagatatatacttttaaatacatactgctaacttgccttccctaaatgaaatgtaatttctgatttggggtccaattcttccactaacatgtttttggagttttgataaatcatttaatctgagagggtctcagaagtattgtctataaactatggatggtaggacttgttggttgccaaggtcttttccaaccgtaagggtctgcaaatatgtgcagttagaggtcacacaaatgaaactgtccatatttgaccattttttgcctacaaaaacaacaacttagtatgattttatctaatatcacatgaattcctaaaatatctgtttttggtaccctggcttttctgaggtagctttatgtgtgagaagtggctaggctatgctgcagccacaaatcaaccctgaaacctcagtagcttaaaaaatagaaagaggctgggcatgatggctcacacctataatcccagcactttagggggctgaggcaggaggattgcttgaggccagaagtttaagaccagcttaggcaacatagtgagacccttctttaaatttttcaaaataaaaataaaaataaaataataaaataaaaatgaaaaataaaatataaagatttatttgtcactcacattttatgtccaaagcaggttagcagagtgccctgctccacagaggcactcagggcaccaggctatcagagctctgccatcttgtaactgcactatctagaacatgcagtcttgatggtcctatggcaggggaggaaacagagacagtggagaatcaacacctgcttgtaaatgccttggctcagaaatgaagcatatttcttgtatttacagtcttttggtaagaactagtcacacagacctcaacctgatgcgtggagacaaggaaatgcttttcagtgtgtccagaaagagaaaatggtaaatacatagcactctgtattagtttgctagagctgccataataaagtactaaagactgatagctcacacaaccgagattgacttctttatagttctggaggctaaaagcctcagaactataaggtatcagcagcattggttaattctgaggacctctcttcttggcttgtagacggtcatcttttccctctgtcttcatatggtcttccctctgtgtgtctatgccctaatctcttcttacaaagacaccagtcatattggattaggagccatgttaatgacctcatttaaaattaattcctctttaaagactctatctccaaatacagttacattctgaggtactgggagttaggacttcaacctaagaattgtgttgaacacaattcagcccataacacattgtctctgtcagacagcacatcctgagatgtagtcatgctgttttcattggagggggcctgtaggttactgagccatgttatggagtcatcttcctcttcacctcacatccatctcctcctgtccccccaccccctgccatttcctaacccaaaactgttatttttctgaattccctgggtaatatttaaagcggcccaatgttactacttacatcaagcaaattttattgatggcattgactgtaatgtgaagccgagtggctgtgggttagagatgggaaacctaggggttaggagcaccaactctgaagcagactgcctgggtgctaatcccagctccattgcttgccagtagtattcctcatctgtcaaatgggaatagtaatacttcccttgcagggttattgtcctgattaaatgagataatctatgtaaagtggttggtacagactaggtgtcaaaaatggtggctattattatttgcagcttcagaagctcatggagcccttcacacccagtgtcctgcattccagcctgtgtcccagcatcacagacaacccagaggctctgccacacaagctcccagggcttccctggtgtgcccaggaagcatgtatttgttagtatggcagtaattgcattaccactttaaagctccaacagcctacgcatattaaagtcataggttcctaattagatcgtacagccaaaaggaacagaagagactatccccttaaatagccccttaaaattattatccttgttacagttaagacaatgagaattggcagttaaattgatttggaaaagcagcatttcagtttttctaagaggcaccctcttcctctcccattttaatgaccctggaatcaggatgtgttaatacctgagagttaggcctgcaaccttttcccgttgacctgcctgggaagatgactgcagacttaccttctcatgccatctttttcttggaaacacagcagttggattgctgtgtacctgaggtgaattatctgtcttgattattgcaaaactattgattcctgagactgcattaggattggaagagctatgagttgcccagtggccttgggcctccatgattggagcaagaaagaatccagaaggaaaccaaagcagtggtttctcctgggtagggtgaaccacacccttcatctttggcaactatgtgcaccatagtgcgcagaggggaggccaagagtctgcaactgtgggtagttgctgggccttcctacgagatagcagatactatgcaagctgtgtttcccattctgtttcctactagaaagctaaataaaggcagtgatagattaaaacctattgtgtcttgtgaattgattacaagtctgaatctgtgatcactgctgctggtgggacagcttcttataaattgctgtcagccaggcagtggttgtaatggatttgtctatgaatatgtacacagtgtacacagtttcagctttttatgttttcaacatttgttgaagtaggtgcatggttgataatacatgtgtttagtttacttgctggctaagatgacttcacaaaggttacactatgatttggccttgacacaaaagttattgtttacacagggagtcaaggaaatagagcatggggataaatttgatattgatgaggcaaatatttggcattggagggatgatgcaatttcagttttctttgcttgtttgttttgcaaagtagcagccaagtgcttttaaggaagaaaagatacccacaagtacctacagctagatttatgtttcaatattgagagatgtgcaaaggggttacctcttacatgtcaagtaactaaactgaagccaggagatatagcctaatctatagatgaaaaaaaaaatcaaagcagtgagcggccagtgggagcaattttcatatcttgtaggactgtcattgtttgatgggcagcattcttttcttagtgatacataaagtgatggcattccctacaattagtggtattttagatttgatgaaatatggcaaaaatggcaaagaggggactagaatccagagcttctatctctcaagcagtctactttctcctacccataccaaggtgtgcattccctgaccctggtgttgtctgactccagccttggttttcatcttcgaaagaatttttaaacttttccctagaagattaagacaattacactgaggcataaacaaatgaaaaagcaaccatctagcatacgtggccagccaatattctccattgtaaatattactccttttgagtgaaacttatgaagggtgttactaaggtcaggacattactaagaaagtaagtggcttaataaatgtatttatcaccagctctttatcattgtatacatgtttaagaggccatggctgattaaagagtaggagaacatgacttctctagggttttagcatctattttctagttccagttagtattaaaaaataaattcaagaccatctttgttggaatagcatgcaattgaaataggaaaattaacttgctcagagagcttttaattaaatctttgtttgaaaacttcacaaaagaccctcttagtaacctaagagtactttagaaagttgaggagttctagatcctgtcctggctttcgatggaatgatattaggaaggttgagatgaataatattgataaagggcttactatgaacatctttgtcaaacagccattgaacagcattcctgtttaaagtgcatcgttttgcagtactcattttcacatcttgaagaggaaacacccagttttattccagagtagcattttcagggggacaatggctactgaagtattttcacaatctgtcttttcttgggtaagtttttctgtttaaggaagggcattttggatctttaaatacggcatgcactgggggttctcaatgtgctgtcactcatatcatgagaataacttctgtcggaaagaccacagctcacccactgatctctgcaactgcagaaaagatctcacggctgcaaggattgcacaagaggaaaataagtaggaaggaaggagtgggaggaaatagtgaagggagtagaaggaaggataaagcagtgtatttcaaccctgtgcatcacaacacacagaggacaatgtaatattgtctaggacatttgagtcagtggacaaggctctgtgtctgctccaaatgctgaatgggtgacctgaaggcttagagaatcaatatcttgcttccgtaccagttcagctggtaccctgatgagtaagtctgagggtaaagcatagccctcagtgggggaagggagaagaggctggggaccaccacattatctgctcctgcctgtctcaaacacctagatggcctcttgctttggcccaggtgtagttggtcttctctttctcccctaagcccttccctctgcctttctagggatttgcccagtctgcagggtttttctctgcactacagcaagcactgctgtcattcacaccccctcttccccaggcttgaaatctggaaggcaatgagagctgtgagcagcaggggaggacacaggcggcctaggacacttgcttccccactctgacttgtcatccttaaaggacatatttctattattcatgcaacacataattagtgagcatctaatatatgccagacaaagatcttctcttgaggcttaccttcaagtgttgggataaagtcaagaaggaaaggagaggaggagaaggagaggaaagggaagaagagggagaggagaaaggatgcaagtgtcagatgtggtgagcaccagaaagaaagataaagcaggaaagagcaataataactgtccaggatggggtggggaacattgccatagtaaatagcatggtcagagaatgcctccctgataatgtaatatctgagctgaagcctgaaggaagtggggagtgatatttgtgaaattttttggatatttgtgaaagaatatttcaagtgggagggatagtgggtgcaaaggccctgaaggagcatgtcggcatgcccatggtgcagcaaggaggctgctggagcaggaggaagtgagcaggaggggcagcaggagctgagggcagagaggttgtggagagccaggctgctcagggactgtggtcggctataaagaccaggtcagatgggaagtggggggtctgacagtttgtaggaggctcaccctggctgcttatggagaatagcctgagggaagccaggtgaagctaggagaccatcagtcatccaggcaagaggttttggcagcttagaccagaatggtagcagtgaagatggcaaaaaatggtcagattctgaatcagttttgtaagtggacctaacaggatttgcaggcagatggaatatggagggagaaaagatctagggtgacattagaatatctctaaggccccttctagcactaacacggtgtgagttgttaccatcagcccattggtcgggcttgccacctggtgcctgtcctttgcccatgttcttattaattcttctccatgagttgagtcagctgacctggttgttatcaagggtgattgtggtctggctttgttcttgagtgccaaaatgccctttggtttccctggaggggcaaaccttccagggagttctaaggccagtccttgactgcaacagtttaacatgccatggtcaaaataaaggctgctttccctctggaagcctttcttcataaccaaacttggagtgccactaagatagctctaaaggagaggggtagatctagtttgttagctgaaaaatgttactcttaataaatgaatcataattagtggaaagatgagaaccaatgcagtcatctgttgcagaatttatttgataaatgggataatagaagagaaaaggacgtctacagtctatagtttagcggccagtactaagtgaggctcaatgagaagccaagagaaagcaattgcttcactgaaatctgatctgacacacagatgagtgtgatggaggtgctcctgtctcttcctttcacttggccctggtaaggtctgactggtgtcaatcatggcttttttagacctaaaagttgtgttctcctcatcactttggctctagcatatgaactggttgtgtgaactgttggccgaggccttcccttgcagaattaaaacaacctctgtctctcagtatatgctctaggaaagttttaattggctgaagacaaagtaggcccaagaataatatgattcgtaagggatggtgaatttattatcttatgcttggtggtccagtatatcagtcggcttcagctaccataacaaaataccacacactgggtggcttaaacaacagatactcatttcctcacagttcagaaggttagaagtccaagatcaaggtgctgtcagggttggtttctggtgatgcccttcttcccagctggcacacagccattttcttgctgtgtcctcacatggctttttctctgtgcatgtatggagagagctctatggtgtctcttcctcttcccacaaggatactgtcctattggattagggtcccacctttatcctcatttaaccttaattacctccctcaaggccctatcttcaaatatagtcatattgacagttaggacttcaacttaggaattttgggggacagacttcagtccataacatgaggtaaatgtaagtttttttaaaaatgaattttattgacgtataatatttatgtacaataaaacatatctttttttttttttgagacggagtctcactctgttgcccaggctggagtgcagtggcgcgatcttggctcactgcaagctccgcctcccgggttcatgccattctcctgcctcagcctcccgagtagctgggactacaggtgcccgccaccacacctggctaatttttttgtatttttagtagagacggggtttcaccgtgttagccaggatggtctcaatctcctgacctcgtgatccacccgtctcggcctcccaaagtgttgggattacaggcgtgagccactgtgcccggccaaaacatataccttttaaagcagcggtccccaacctttttggcaccagggaccaattttgtggaagacaatatttccacagatcgaaggtggggattgtttcgggttgattcaagcacattacatttattgtgcactttatttctattataattacattgtaatatataatgaaataattatacaactcaccataatgtagaatcagtgggagccctgagcttgttttcctgcaattagatggtcctgtctgggggtgatgggagacagtgacagatcatcaggcattagattctcataaggagtgtgcaacctagatccgttgcatacgcagttcacagtagggttcgcacttctatgagaacctaatgctgccactgatctgacaggagacggagttcaagtggtaatgtgagtgaggggcagtggctataaatagagatgaagctttgcttgcttggcctaccgctcacctcctgctatgtggcccagttcccaacaggccacggactggtatgggtccatggcccaggggttggggactcctattttaaagtgtacagtttgatgagttttgacaaagtaagtcatcttgtaatgtgtccacataatcaccaccacagtctagatatagaccagttctatcagcctgagtcacgtgttccttcccagccaattcccaacccccaccagagaccccaagtaaccagtgtcttccttccattccactagactagagttgtctgttttagagtttcatgtcaataagatcatacacataactttttgtgtctgtcttgtttcacccagtataaggattttgattcatacatgctgttgtgtatatcagtagtttgtcacttttcatctttgagtagaagtctattttatgggtgtaccacaatttgtgtatttactcacctactaatgaacatttgggttgtttccagtttggggctattattttaaaagctactatgaacgtccatagataagcctttggccattttccattatgttcttatttctcttgggtaagtgcctagaaatgaaattccacctttccatggtaagtgtatgtttttaataagaaaatattagagactgctgtccttaaaagagattgtagtaatttacattcccatcagtaatgtacgagaattccagttgttctatatcttgctaacacttggtattgtcagtctttttcattttagccattttagtggctgtatgctggtatctcattgtggttttatttgcacttcactgatgactaattgatgctgagtcttttttatatgattactgaccatttttatttcttgtattatgaagtatctgctctaaatattttgcccaatttttaaaattgggttgtttgacttctgattattgacttgtaagacttttaaaaatatattccagatacaagtcattggatgtatatttctcccagtctgtggcttgcctttttattttcttgaagatatctttaaaagagcagacttttacattttcaatgaattgcaatttatcatgtttttcttttctagttcatgccttttacattcttttaaagaaatctttgcctacctcaatttcacaaagattttttcctatgtttacttctagaagcttccttcttaaattctacgatccatttcaagttaatattcatgtatggtgtaaagtaagggtggaaggattttgtttttttgcttgttttgtttatgcatttggatactcagtcattccaccaccatttgttgaaaagactatactttccaaattaagttactttggtagttttactgaaaattaattgaccctatatgcgtgggtctgtatctggacactattttattccattgatctatttgtttgtccttatgccaataccgctctgtattgtttactgtggctttgtactaaattttaaaatcaggcactgtttgtcttctttgttctttttcaaaattcatttgattattctaggtcaattgcatttctacataatttttctaatcattttgtcaatttttacagatataaacctgttgggttttgattgagattgtattgaatctatagatcaatttagggggaactgacatctcagcaataaggagctttctgatacaagaacattgtatatctctatttaattagacttttaaatttctctatcagtgttttatagctttcagtgtgaaggtctacagaaaaattttatgctttttaatattattgtaagtagtattttgtatttcaatttccaatggttcattgctggtatatagaatacaattgacttttgtttattgaccttgtatcctgtgattttattatactcacttattagttctagcagctgttttcatagcctttagcattttctatgtgtacaattatgttgtctgtgaataaacagaattctacttcctctttcccagattgtatcttttacttctttttcttgctttattttattggctagagcccccagtgtagctttggtgatagtgcacacctgtgtcttgttcctgatcttagggaaaaggcattcaatcttttaagtatgaggcttactgtagggtttttgcataggctttttatcaggttaaaaaaagtttcctttcttgacttacttattgagaattcttattgtaaataagaagtgaattgtcaaaagattttattacacctatcgaaatgatgtttgttttttcctttgttcttttacaatggtgaatcacattgacttttttattgtggtaaaatacccataacatgaaattcagatttgtaacaattttaaagtgtacaattaagtagtattaagtatgtgcacaatgttgtgcaaccatcacccctatcaagttccggaatttttttaatcactccaaaaagaaaccccatgaccattcggcagtcactttacattccccagcccctttacattccccagcccctggcaagcacctgctctctgtctctggatttgcctattctagatatttcatataaatggaatcataatagtggcctttgtgtctggcttcgttcacttagcattttttaaaggttcattcatgtgatagtgtgtattggtgcttcatttttttaaatggctgaataatattccattgtatggatataccacattttgtgtattcagtcatctgttgatgaacatttgaactacttctaccttttgactattgtaaatagtgctgctattaaacatttaagtacaagttattgtttgaatacctgttgtcagttctttggggtataagcctgggagtggaattgctgagtcatatggtaactctctttaccttttaggaactgccaaactgttctccacactggcattatgttttagtttgtgctgctataacagaatacctgaggctgggtaatttaagagaatagaaatttattttctctcagttcaggaggctgggaactccaagatcaaggtgcctgcatccattgagggccttcttactatatactccagagaagaggaaacacatgccctcacatggcagaaggcagaagggcaagagtacaagagagatcgaacttagcctcaagtcgtttatataatggcatgaatccattcatgagggcaaatacctgccattaggccccccgccaatacagttgcattaagcatcaattttccaacacatgaattttggggggatgcgttcaagccatagcattctaccattttactttcccaacagcaatgtttaagggttgcagtttccccatatcattgccaacacttttttttttcaattatagccatcctagcagatttgaagggacatttcactgtagttttgactttatttacattcattttacagttgacccttgaacactgtgggggtaagggatgctgaccccctgcacagtaaaaaaagaaatcaatatataactttgaacttcctaaaaacttgagaccaatagcctattgttgaccagaagccttcccaataacaaaaagtcaattaacacatattttgcatgttatatatattatatactatagtcttatgataaagtatagagaaaagaagatgttattaagaaaatcataagggagggaaaatatatttactattcattatgtgaaagtggatcatcataaaggtcttcattcctgtcgtcttcatgttgagtaaacagaggacaaggaagaggagaggtgatcttgttatcttaggggtggcagaggcagaagaaaatctgcgtgtaagtggacccacaaagttgaaacccgttgttcaaaggtcaactgtagttttcaattcattggagttttgaattgtatttctctagtgacaaatgatgttgagcgtcttttcatgtgctctttggccacttgtatatcttctttgtacaaatgtctattcaagttctttgtctctttttgaattggattgttcagttttttgtagttgagttataagagttttctttttagtatacactagatacttgacccataccgaatatatgatttgcaaatattttctcccattctttgcattgtgttgttactctcttgatagtgtcatttgatgtacaaaaactttttaattttgatgaagtccagtttagtttttcttttgtggcttgtgcttttggtatcatatttaagaaactattgtcaaatccaaggtcatgaaaatttgttcctgtgttttcttctgagagttttatagttttagcttttaagtttagttttaacatgttttatggttagtttgtacatgggatgaggtaaaaataaaatttcattcttttgcacattgattgatttttgaatgtgaaactaactttgtgtttttgggataaaaaccgcttggtcatggtgtactacctttttattctatttctggaggtttggtttgctcaattgtgttaaagatttttgtgtctatgtttaggggtatttttatctgcacttttccttttttgcaaaatctttttttccttgtctttggtatttggataatgatggccttataacatgagctgtgaagggcttcctacgctcaattttatggaaatgtttgtgtagggttagtattatttcttctttatatattttgtagacttcacctgagaatgtttctaggattggagttttctttgtgagcaggctgttaaacacaaattcaacttctttagtagagggaaatctagattttaaaatatttcttcttgagtatttctttggatatttttggatatttctagggaaatgtctatctaaactgtgaatctgttgacataaatttgtttctaatattcccttattattcctattaatagtttagggtcttgataacactaattgatgtatttttatctttgtttattgagcagtcttgctagaggtttatctattgtactgacctttaaaaaaaactttttttttttttttttttttgagattgagtctcactctgttgcccaggctggagggcagtggcatgatctcggctcacttcaactttcatctcctggttcaagttattctcctgcctcaccctcccaagtagctgggattacaggcatccaccaccatgcctggctaatttaaattttttttttttagtagagtcggggtttcaccatgttggacaggctggtcttgaactcctgacctcaagtgatccacccaccttggcctcctaaagtgctgggagtacaggtgtgagccaccacatcttgcccagcttttttgtttattgcatttgtctattgtttacctatttactatgtattaatttctgtttctatacttaccatatccttctttctttttagtttagatttaatttgttttttttttcccctagtttcttaaggtagaatcttagattattggatttggacccattttctgttctaacataagcttttatcccctttatcatttttatcgtgtctctttgattcttctctcttttcttctttattagtctggctagcggtctatcaatttagttaatcttttcaaaatccagctcctggttaattaattagcatgtctttgagttcactgatcttttcttctgttgtgtctaatctgcttttagttccatccagtgaccatttcatttcagaacttgtatttttcatttctagaagttctatttgattcttttttaatattttccatttctcttctcacaatgcttgttttttttcaatacttggacaataattataacagttgttttgatgttcttgtctgcgaatttctgtcatttctgtttctattgattttccttttgattattagtcacattttcctgcttcttgggatatctagtgattttgattatatgctagacattgtgaatgtctaagttttgttgtctttctttaatgagtgttggattttgttttggtacacaagttaattttggttccatttaatcctttcaaggtttgtttttgagcttttaaaggtaggtctgcagtattttctctagggattctttaatatttttattaaggtatgacccaactggattctctactgaatgccctgagtgaccaagaaagacaatcctttttggctggtagaacttggatagctcctagttctgtgtgagctctgtaaactgtttgcttacagcttttcagtcactctgtttctggtctaaggaatttcaccctactcatacatattttagtacctactaaactctcaagtgcccctctatgtttctttcataagtatttccttctttctgaaatactgccccataaatcccagctacaaaagcctgtctgagccatgattttggtcttctcacatcggtgaaaccactgtgctctgccttgaactcctttccttctatgagacattgaatttgcctccacggtgaaagctggggtagtcatattgtatattccatctgtttcccttctcttatgaattatagtcctgagccacctatttttcaatgtctgataatagttatttcacacattttatctgattttctagttgttaatggaaggagggtaaatttggtccctgattattcatcagaagtccatgttgcaaatttttattcatgatcctatccaaaaggttgccatttctgaaaatgctgttctatttgaagatgtcttctgggacatttttttttctccattcttcttctacaacttaaaactatggatattccaaataaatttgtgagaactatactgcattgtttctggtttttgttgcagaattgtctgttttcccatagtgatccctatgtcttattcgtcttttcccacacacccacttcaaatagggctaatgtgactttttgatacaggatttaggctacgaaatggctctcagacctttccaggggagtttctaagtcccttatagctggagttctaagaacagccactcaaggcttgcttccaccatttcttaaaagtgagaattacttgcagatgtggcatctctaacatcattgctttatactcactcgaacatacagtgggaaacagaggctattaaaaatgtaatcagtgtgaaaattcatgccatctgaatcgtacgagtatgtaagggatttgagttccttacagaattttctgtaatttagtacttcaagtgacttataaatgtatatacttctctctcacaaaagtgttaggagaaggaaaatcttaaatactagcttgatttcttaatttaataacaaaaaacaattctcataacatgtatcacctaacatgtcactttcactttaaaagtctaaagagttgaggtttatttcttttcttttaaagttgatgtttatgttggtgatttcgaaaagatcagatcccccgttatgaaggatcttaaccttgtcttttagatctccatgagaaatgcagtacatgtagcattagccatatttcttttttagaggcctatgtaggatatttataacctgtaaaagtttgatgacttcatgctcaggagaaagcaagtaattacctagccaagccaggtgggtgttcaggttagtggtaaacagaaaggagatgttgaaagatttcatatctaaagggtaaaaacacaagagaagtatatagagataaacatgtaaagtataagactgttacatagtaagctacctccgaagtggcagccattgttattatttttctgccagtattttgaaaataattgtatctgttttgtgtacttaaactggattgaatttacactatctccccctgccctgtcctccagacctctgcttcctagaactttatttattgttcttaaaacataatgggacttttgtcttctcaggtttaaactctatatagtaaaaaaaaaaaagaaaaagaaaagcaagtactgtactggaaatttatatcattaaagtcacattagccctatttgaagtgggtgtgtgggaaaagacgaataagacatagggatcactatgggaaaacagacaattctgcaacaaaaaccagaaacaatgcagtatagttctcacaaatttatttggaatatccatagttttaagttgtagaagaagaatggagaaaaaaaaatgtcccagaagacatcttcaaatagaacagcattttcagaaatggcaaccttttggataggatcacgaataaaaatttgcaaataaaaatttgctggtgtgtatttaaacattaagtttacttctacaaataagcctctccttcccctagccccactcccacatctcagaaaaggtaaaggggactattgaaaacctgtccttagaagtccttggttttgtgaggcttgcagacatcctaaaattcacaaccttatattttgtttcagaaaatgaaacatcacaggtgaagggcttttttttaaaaaattttgttttgttttgttctgttctttgtcattgtttttgttttgcaatatcttactacgtgtacagaagtagttttcaaagtgtgatccctgagtaagtagcattaacatcacctgggaattatgtagaagtgcaaattctcaggcctcgcagtctgtgtttaggcagttttggtatatgctaaagtttgatagccactagtgtcaagtaccctggaaagctctctcacatcttactgaatctatttctgtctatgatattataagcctcaaatatgaggtatgaagaagtaatcagtcatgcccccagtgactgttgccttggagatgtttaatggtgtgacatgggaagtgccatgctgcagagcaaatgtcaaaccccaagaagggagagactttctgccacaagcttccagagcacctcctttcacagccctagcagccacagtgtaagaagattaagaaaccagaactgcagaaggtactaaagaagcagggccttcaggcagagctgcagcctcgaggcaccttaagctagttaagaaataagatcccagggctcaaaagcagttcttgaagcaagagtatcaaaaggctgactttagcaatccagacatggagcaaaaaactagcatcactgcgtaggcctgactgtggggaagcccaaggaagtcttggcagaaactgtttacttagccaccctggaaaagggcgatggtgcgtttgtcagtaaagaggacctgaaggctgacatatctatctgtcctcctcataaaggctcattattggttcagcaaatattgaacatgtaccatttctcgttccaagtactagagatccagcagcaaacacaaaagaggttgctggcctcatgtctctcacattctaatcatgttctggggagagttcagtgtcagcactggctttgggtggacactttctggtttctagactcaagattctgggtcccagaaagtgcaaatccagatgaagaattcccttgatagacaaagcttatttctcctggaagtgctccccaatctcatttgcattttgtcctagacatctaacctggaaattttgccatcagttttgatatcactggctccctggctccttatctaatcaggcaccagatcctaaggattcgttttcagtaaggtccatggaattcccctccccaccctttttttctgtttttacaaattccatctactcaatgtctctgtatttgctagggccgccataataaaatagcacagactaggtgacttaaacaacagaaacttattttctcacaattctggagcctagaagtctcaggtaaaggtgccagcagggtaggtgtctggtgaggcctccctcctcaacttgcaggtggtgcattctctctgtgtggtcttttctctgtgtgcatgcaggagagagtgggcaatctctgctgtctcttcttcttatagggacaccagtcttattggattagggccccacccttatgacctcgtaaccttagtgacctcctaaaaggccctgtctccaaatatagccacactgggggttaggcttcaaaatacaaattttgggaggccacaattcagtacagaacaatccctattatcccattcctgggttattatagatccttactgatcttcattcctgacttgcttcaccagtccttcttgaatatgcaactggattcatttcagtaaaatagtacagttgactcttgaacaccatgagtttgaactgtgtgggttcactttcatgtggattttcttctgcctctgcaatccctgaaacagcaagatcaacccctcctcctcttcctcctcagcttacttaacatgaagatgaaaagaatgaagaccttaatgatgatccattttcacttaatgaatagtaaatatattttctttttctcatgtttttcttaataacattttcttttctctagcttactttattgtaagactatagtatatactacatataacatgtaaaatatgtgttaattgactgtttatgttatctgtaaggcttctggtcaatagtaggttattagtaattttttttttttttgagacagagtctcgctctcttgcccaggctggagtgcagtggtgtgatctaggctcactgtaacctctgcctcccaggttcaagcgattctcctgtgtagctgggactacaggggtgtgccaccatgcctggctaatttttatttttagtagagatggggtttcaccatgtgaaagtggcctcaagtgatccgcccaccttgggcttccaaagtgctgggattacaggttagagccaatgtgcctggcctgtagttaaagtttttgaggagtcaaaagtaacatgtggattttcgactgtgtagcagttggtgcccctaacactgtgttgttcaagggtcagctgtattttaaagttacagtcttattgaaaacatcagtgatttctaatgactagaatttagccaaactgcttagtctggcatttggctccctggtcatagtctcccttgtcagccaaaatcatgttattctcttcttccataccacaaacctttttgagtcatctgcctctttgttcttcaagcatttagcaagtgttcccacctctaggccttaagcacattattctctctggaatgtcctctttcccacttattcaaatactgccctttcttccaagagctatactctgtctcctcagtggcatctcccggataatttccacccacagtgatctttctctctgggcttggattaatttttcaaagcaaatgttaacgcaattctcttgtgtgtatgtctgtgttcctaactgaattgtctgagggcaaagactaagtcttttacttcttcgtatccctcacagcacctggcacagtggtggtgctcaaaccatgttctcatggcatcatggctggctggctgggtggatggatggatggaaaaagaatgatattccctttgataaagttttctgggaatcttagcttaaattcacgtcctctgagaaaactttcattgtcctaccccagtctcactctatcacatcaacatattttaaatccctatataaccttcatcactaccagagactttgtttgtccttccaactccccctaatatcccaaactccatagaaatagggactgtttctgtcttgtttctcagtgcttagttagcatgtgatacacggtagccactcagtaagcatttactgaatgaatggatgaatttagcatcatattagtgtaatgacatcttctggaatggatgatatgcctagcaaggtgtgcatgcaggcaggagagggcctgcttagaaacctgaactttaaaaaattgcccatgagacatttaggaaagctcacactcatttagaaacagatgtgccttgtgccttgctttatagattgtaaatgttaaaaaaaaattggtatgaattaataatttgtacccttagttttttttttttttttttttgtaccttgactaagaatacctaaaaacctcaaagtgctatgtgagagtattcatggaggctgggcgcagtggctcatgcctgtaatcccagcactttaggaggctgaggcaggcagagcacctgaggtcaggagttcaagaacagcctggtcaacatggttaaacccatctctactaaaaatataaaaaaattagccaggtgtggtggcatgcacctgtattcccagctatttgggaggctgaggcgggagaatcacttgaacctgggaggcggaggttgcagtgagccgagatcgcaccactgtactcaagcctgggtgacagaatgagactctgtctcaaaaaaaaaaaaaaaagtattcatgttaatcatttggcaaacaacaatattttttgcaagacaatggatttgttttctaaatctagattttcacacagaatgtttccttaagggcggtagaacctacagtgacttccattaaatagagaagttgtttcagagtcttccaccttcatttcttttttcttcttccagtgttatcatccctgcctaaggagacactgtctagttaccctgtctgctcactgccttctggtgccaccaagtttagttctgcctctgtgcctttgttcatgctgttcctgtgattgaaaagttcttgttgaggcccaactgagatgccgccttcttcccttcccaatgaccataactactataaaagaattgacaataccactcatctttgttctggccccttgacactcatggattgtactatattttcatgtgtaagtcctgtctgcctgattgctctgtaagttcctttggagtaggactgcaccttgtgtttcatttctatatccttttatgtctgatgcttttgtgaaatatatttgtaagactttaggaaatgaatgttccatctctcctagcctgattattggggtccaaagttctggaggtgagtagcattctggagtctctctgcagggctaatccagcccctccctgtggggtgcttgttaacaggaaggacagatcacttttgtactatgcagactcaggacccagcactcggtggcctccaagtttcatgatgttgacctaaggaagtcagatgttggctgactctcctcctacacattctctgtttgcattttctacaactggcaagagaaaaccgttctatgggccaaatcctctccttagtttcacttggcctatggcaaaaggtccaagaagtgatgcacctatagtttaaaatacaacttatttttactgtcttgaaagagctgtctccgtaaactcacttggtaggactatttcaccatgaaagtggcttcccatggctttctttgtctctctttcttttttcctctctgggtgtctggttctgtgaggtttcctttacaaatgtgtaggcattcgtttctctgtctccacctatctctgattctctcccttttaaatttattttccatcttttaccttctgtccaaaggaaaaaaaaatcaatggaaatccataaaaggaaatagagttacctaaatactttttgtggagagaattaggaaatattacacttactcatttacatggtttttatgcactgaaactgtttttcagaaaaataaatttgtcgtttcttgtctacaccactttatactcacttatgaacctcaagatatgttcatacattgtctatatttgtaatcaatctatgtacgtatctatttttaacctaacattgttttgttaggttttatattactataaatagtaatatttatatgtgatttgttgagccattccctaagtgtttgatggttgaattatctctagtttcattattgtagacaacattgctaccaacaactttgtacaaattattatattttattattctggctttttctgatgtacattaccaaaagactaccatgatgtaatcaaaggcattcactgactttaaaaactaaaaacacagagcataaaactctattaaaaacaaacaaataaaataaccccttccattttgggtaataacagttaagagaaaggcaaaagacaaagaaatgggagaaaattattcattcataaattcaacaaatatttgagcacctaccatgtcctaggcactgttccaaaagtatgggatccatcagtgaataagaagcccccaaacccctgcctttgtagagccaatattctagtgggagaaggcagacaataaacataatagtaagtgagttaattatataataagttgaaaggtgatatgtgctatgaaataagaaaaatagcaggctaaggggaatcaggagtggtagaggaacaatagagctatgtgggttgcaatttcaaacacgggttgggaataggcatcactgagtaggaaacgtttgagcagagacttgaaggaggtgaggaagttagccttgcaagtactgatgaagctgcacaacaggcagagggaacagctactggctaacaatgttggatatcctggagagacaatgaggaggctggtgcggctggagcagtgagggtgggctcagcaaggtcgccaggatccacgtcgggtagggtcttcgaggcacttataaggacttaaacttcaaggaggctgtggaaaggttatactagattcactttctttgaaaggacagatgctggacctgtccttaacccctgaagaaagtctctgggatggaaccagggaactgttgtatttcagggtggttctgttgtgcacgtggattcaggactactctttctgttcaaaagtcccacaattctaaatataaaataatttaataaaatgaagcaaaaatttcacagcattctcgaatgttggtgatttagagactctggagatcatctaggaaattgaagcccaaaggttaagtgacttgctcaaggttacacagccacaagaggcagaactcggtttcagattcactcgtctaaccctgaattcaatgtaccttccactgtactggactgcctaataaacggtatcatttcacttatcagttggttagatttccaatagctccaccattaggaacacagtttgaatccagaagctctgtaaggttgattggttgattaaatatttggttatctaaaaatcaatcagatagctgctattgttttaacctttacagctaagaatcattcaaaatgtattaatcacattttctgcttctctagaggaattctgaagagtcatgccatcttagaattggaagggaccttatttgttcaggatcttgcagtgcctgtgggccataattttacagttagctcttatttaatactattataaaacacacaagccattcaggtgaccctggacatattggaggttttgttttacaatatgtttctgatttagtttactttcttttgatttgcttcttggatattttctgttgctaaatttttctccacttaattatttttttaataatgttggtctttctggccttattctgtaacttaggcctaatttttatcaacagtgtctgagcttgtagtctttgctgtcacctgggatgcattgaagtggtcagtggcaattggttcagaaatctcttctgtgggtcagaactcaggcttcagaactaagctgtggaaatgatttcagttaaaccatttcccctccacttgcacacttctgcaagtttcagcagccagatctgttccagcaatgggggcaggttgcacattcccactgagaacacttggtggagattataaggacacattatttttttctttcactaagccagaattggcagttgaagatgtgtttgagctactgtctgctctgggaatgggaagaaaactgtatacctagtgcatttccccttctatcttctattccaacaaagaagttgcagtcaatgaaagtcactggtcctaatatgaactgttcagttaacccactaaagcagcctagtcctattcactagctaccttgaggtcacctactctttcaaggcttaattattcttattttttaatgtagaaagttcaacctaaatttgtttctgggtgacttctagcttcatgattcagctcctaatgttctccaccagaagattggttgtaatttctgtttcatcacagtcttcttgcctttcaaagcctcagtgagtgactggtgcttttttctgggtggtttcattgcattcctagagaaaactctgaaaaagtagacatgtgtcatgagaatatgcatggctgtaaatttcagtatgtgaaggctgtcattgatagctccatgaaaggtaatgactgaaatgctatatgcattatcacaggtaagctttaggaatcattaaaccctgacttgaacgttacatcagggactagtatagagactagtgtttttgcaatttaactctgatgttgttttcccaggtcctaaattgtcctttggaagtagagcagatggttgctatgaggcttagttttaaatgaatgactgtccccatatctcagtctcagccatttaatgtggtgttcttacaggcatggatgggacaaggaaacatggatctcagcagcctggaagggaactgtgggtggaggctatgatgccaggaaaggacttactcctccagctactgggagtgctgccagcagaaagcccttggctcagctgacatctcctaggggcagtgcctcagctgaagagagccaccttgcccaaggtcgctgaggtggcctgcatgtaaagactggtccatgctggggtataaaggcccaccagaacaactcagaacccagccccaactcagaacaactctgaagcatcatcccaccttcagaatcctccctgcagggatgcctgaggcttggtcaatttctccctctgctcaagcttgcctccctccattccctccctttatttcctcccacaaatgttgactacaagagcacttcctaaaaagcctccctctgcctgctaaacaccatctcagaatctgcttctaggaggacccaacctgtgcagaaattttatgagcaatttgcctgtccattaaaaaatacagcatagactttttccaggttagctggagatggagtttttttgtatcaaaaaaagagagctaaactgagaagagaagcaaaggtagaagaataaggttagactctccctgtataactgaatttgggattgggaatgatatcttgcttctctatgaaatttagaaactgtcttttgaagtcttcatccagtcacatccaagagtggtccaggaagaaaaaggaaaataagaatgaaaaaaaaacaaaaaacaaaccttaaaattggatacttctttgtgccttgcattaagcctctatgttactgcccttgtccgtataagcaactctagataaaatcctttcttagaccatctaatttatctccccgtgccattgtgaaaatcgggcaggaattactgcgggaaccagtgactgaatgggcagtggtgtctcgcagctgtaactcagagtttacaagggaaggatgaacagcagccatccttctaaaggcattcttcctctcctccagcacagctcagtctgtgcatgcctcaccaaggagaatgagggaaggccttgttgactgcccagcccagagtgtgaggaacagcagttgacatgggcggctggacgggatagaaaccagcatgaacatttagtgacacctaaggaagaggtgaaaatgggggagaaagccaagaaccatcagacagcttctttctgttcttgccttggatcttaggggaacgtatgtgttcaagggtgccttcctccgcagggcctcccatcccttggcacaaacttccaaacgatgagtagacatggaatgggcttcttctgaagactgggtcaccatccaactcagccttcggagtaggcggtggggctgggggaagaggacggaaccatgaggtctctccatcacttcccgggtgtgttgagaggcaagcaaatgcggtgggtgggcctgggctgtagggcccctgccatttcgggaggggcctcctggtgtttagctctgggatgtgtgaaaatgtgttggtgaaaagcgagaggcttacacagcccttcaggggaagaggggctggggcgctgggggcggcgtcgggatgagtgcagaagagacgaggcctctggacagcggaggaggaggggagggcgccgaggcgcggtgccagctgccgcgcacaggggccccgcggcggagccgagccgcgggcacgctctgccctgtcgggagagctccgggagcggcgggaggggcggaggggcgcagtggggcccgggcggctgcggccgcggagccggggcacctgaggaggaaggagggtgggagcgagggagggaggggacgggcgcagaccgaaagtggggaaagaaggtgcaggcaggcgggcaggcgggcgggcgccctggcccagggccgcgggtgcgggagcccggcgaggtcgagctgggcggcggcgggggccgcgccgagggaggaggggaaggcggaggcgcggggagcgtgtttggggcgccgcggcggggagggtggcggccgctggtgcgcgcggggcgctgtgtatgcgcgctcccccgctcggggaggaagatggcccaaaagggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggtaaatgccccgcgctggcacacgccgtgggggccgtccgccccgtcggcggggctcgcacgggtagggggctccggcggagttgggtgaccgtgaggcggttggtttggagaggttgtcactaaggaggagtttacttttcatttgtggagatgatgggagcccaggaaatgtggtcagaaaaaggcccctggaggggtcctggaagcgtccttagctggtcctgggggactgggcggggaagggagcgcagaaggaagcaggtgggctggcctgttcctccttgagggcaggaaggctgtggcttggtttatgcaggaagaggggtggggaccattgagagcattcggtggccagtcctgttgaatgaaatctgagcactgagctggatttgcgtgccttgtaggtgactggtgcagttgcagcaccaggatagatagtgccccatattccgatttttacctgggattaccagccaggctggagtctcagcacaggaaccgagcgtagggatttgtgaatgaatgagtgttcgtgttttaagagatgtgggaacggagcagagtggaacctgttgtttgtcactgtaacgtttctctgggttggctgcatcctagacagaattgagagaaccgggccatgagttcggagtgtcagcagagccaccgtgaggggacgtggtttccagtgcagtacagctgtctgaggatgattctgcacatacaactgatcttcccagagagtgggattttgaggaagtggaaaaaattgtttagatggttaaagcagtcgctaaatatttatttcttaaagacagaagaaaaataattatttaaatagtgtcctcccgtatgttctcaaagtaccgttaaatccaagaggcttttcattgtgtaaatctgggcactgggtcttttttcctttcagcaaacaagataacaatggcatatcctattgtacagagagaaaaaaatactcctaatgtcagatagaatcacagcctttacctggtcaataggttaccaagaaccattccatggattatttgtcaaagacacatttgtatttttaatagttaaaaacttggtcttcattggatgaaggcagcccacagtggaggagtgaggagaaggataacatgttttggcttcaatctggaagtccaaaagttttttaatgaacctattttttttttaacagcatctgattgtttaacatgaagcttgactgatgtttgcttgtggttgcagtgtttctctggcagtaatcataatcaccattatagtaaaaacatcgtttattgagcacctactatgtgccaggagtaagctttctctcctaactattgaatgttaacagtgtgatcttagcatagcatgtctgaagactagagtctaggatttatgacagtacaaacctaccagttgcccattcgttacagaggcatgtgctgaacgctatactttgcttttgtcaagctctctctctctccccctccctgttcacacaaagttagctttaggagcaattttcagggatgaaaatgttaaatttggtgaaaatattaagttgggatattatcagtaaagaccatccttttgcctgacggttgaagacctgaagcagtagttcaaaattgtgacagctcatgaactttgtgatactttttttggttgctccagagaaattgtgaatttttgttttctagaatatctataatctcagtttagtacttggcaactctagctactccatgtttgttcagtagaagaaagaatactgaatgaacccattctgtacatttttaatacttccctcaagaggctgcttagagaccaaatgaagtaaaaactgaagggacaatgagccccaattattagcagcttgtataaacttgtattaatctcattgctacttggcttaagtattaaaaggcttgacctgggtaggagtttaactcattttgctttatcaagaagattcccaaataagagcttaattcactctaacccattactgggaatgttggaaatgaaacccctggttcattgacttaacactactttgcattgtgtggatctcagaaagtatatatttgaagtgaaatttgagaccagagttatttatgcaaatcttacagaattattatcacagaactgccctaatatatttaatagtatccttttaggcctgtgactcggtgttgtattgtcttttctcaatcgtaaagttcacatgttctgtgcccttttgttgctgagataattttataaaaactttacattcatttttttgtagactaagcattctttttttgccgtaagagtttgagatagttgctaggcacgtggtggtgccccacccctttccaaagcacacaggtggaaaaataaaatctttaccatttggtcctgtttacagtggtggaaggttgtaatagtttccaccccctccccctggccattttacatcaattatgaagtgtatcctcattatctacttggcctctggtattccccagagtgcaaaaatgtgtgcttgatctctctctctctcttttctagcaataattcatctcattaagcttttagaatgatgaggcattatgatgtcaaacatgatgtcaacaggaaccttcctgaatacctaatttgcaaaaaaaaaagggttataagcattaataattcatatgcagtacaatgatatcacatgggtttccatttctggtaagaagttagatttgtctcccaattgctgtgaaaatgcaacttcctagcaatttctttcctttttgcttgccttttcaaaaatagtactccaacaggagaatcctgcaggatgttcactcttgatattgtgccagttttgtaattcttgttcagaaatcctcagaggagatggttgaacctctctctgggaagaaccagggattcttacaagttttctcataccagctgttcctacttgggagcatctgggactagacagccagttgtagagaagaatcgttattgacaatatcgtcaacttgctatgacctctgtgtaggttcactcttttgtggatcagacacaggatgttgttagtttccagatggcagcatcaccagctccccgttttccctccattcatacagaatgtgctcatttgttcattcagtatttgtggccagactgtgttgtaggtgctagcgattcaggaaatatccatgaaatttggtaagcaaagcctaatgaggaggataaatctcctgtaaaatggtgtgcctaagccagttattagtgactgctatgttttctgttccatagcactccagaatttgtgaggataatcctgagttgactatatataaaaggaaaataaatagatattccactgaccttatggtaaataataatgagattttatttgggggaggagtagagctattttggaaaaaagtcatttttgttttctaagtcagtgttttggagtcaaactttacgcaagaatcacctagagagcttgttaaaatatagattgctggactccactcccagagattctgatttagtaggtcttgggtggggcctgagaatttgaatttctaacaagcttccaggagatgctagtgttgctgatctggggaccccattttgagaaccactgctttttacagtggtgaattaaattatctgtctgttgaccaggcgaatgaggtggggccacctctagcagagtgcatagtaccacactgtctttatctggggtactggtcatagcactgctttcatcttagttcacttctgtatgggaaacctgctatccctgtacaggaagtcaaaacgctgagcctccgagattggctaaaaagtctgtaagtgaggagtgttggatcatgtaaccaactctggtttcttgaggttaagttttccccaggatccttttgggtttgtacaggtcctaatgtcttgctttgccaccacaacagaagtctaaagcaaggctggatgttacatgatacaggcacatattctcttctcagctcttggaattcttgctaggcctttcaccatcatttttcattttaaaatgaagtataaagtttaataagctcaaatgagtcctgcaagctgatttcataaaatccaagtttgccttctgccattgtatatatgattacaatttagtcccttcttttcccagcacattaattagaatgaatgagcacattttccttattttcatgactttcttcagtagttccatgaatttttaaggactatcaggtaattcttccttttgaaggaaagtaagtcctcaagccaggatgtaacatagtataagctgccagctgttcagagatgatatagtttctactgaaatcctgttttggtgaccaccaggtatggcctgggcgccagcaggacagaatatgctggtgagggcagggcagattctgtggcactaaactggtcatgggtaaaggccagtaatcaaaataataatcaaaataggaaggagggagtgagccccgtggaaccaggtgggaagacagagtccagagtttgttcaaccagcaaagttggagggggccagggagcaggtgggaatgttggggccaggcaggcaagggaaatctagaaattagtggttcagcaaaggtgacagctgttgaaccaggttgagacttctgattggggaataaaagctgcttactttctattctattcaggaggctgtggtgaccaatcggagggctgtaggtaactttgtgaacccagcaccaaatgacacaagaccaaccaaccagttcttccttgcaccctgatcagacagagtctgggcaggaaacagactgcacatccaaaagggttaactcagaataatcaaatgaagggactactgcaaatgttttggcaggatgaaggaaagacaacaaatgatgctgaagcaccctaggctagaaaaagagggagctgttactaccccagaagagtcaaggggaggggatgtgtattagtctgtttcacgctgctgataaagacataccagagactggttaatttagaaagaaaaagagatttaatggactcacatttccatgtggctggggaggcctcacaatcatggccaaaggcgaaaggcatgtcttacatggtggcagacgagagaatgagaaccaagcaaaagaggttacccttataaaaccatcagatctcgtgagacttattcactatcatgagaacagtaaggggggaactgccccatgattcaattacctctcaccaggtccctcccacaacacatgggaattatggaagctacaattcaagatgagatttgggtagggacacagccaaaccatatcagggtggttatgggaagctgagaaaccagggtagttatgggaatctgagaaaccaaacctgtaagtcagggaaaccctcagaagctgtagccttcaggagtggacagggagggagccaaagcagtaagtcccttcatgacattgtcctccctttcatcaagctcctgctggtttccacatctggaaaccagagggaaaaggaatctgttgattggggttttccagggtgctgagcagggtggagagtgggtctggaggggcaaatgaaaaatatcctgagcatatcccaaaggctcttcgtaacaggcaataagagatgttcagtgtcactggagctacctcggtatagataaactaaaattgtgatgggcagtttgatgattgtctaaaataatggcattttaaaatggccacttaattcactgtttacagttcctgtttgatgactaatgatattaaaatatgtccagttatcttggttggagacctcgaacttattgctgtaaacatatccttctcttcagttcattctgtcccctgactgctgatacactttttttatcacttcctctgtcccctgcctgctgtccttctccctatcctgaactcaaagcccaagggtggaatgggggagaaagacctgagcctcataagagactcaggaccctgtcttatcagtttattccattttttttctcagtttttactttcccactttctataaccttctctccacagactcaaaaagtgaaaaaaaaaaggattttgctatgtgcttgtaaggttatattttcaataaagaatgtgtacatttagaacatatttaaaaatattaaaatgtgtccaggaatttatttttaaagataggtgttacctttaccctacagtggaagtcttggtagttatgttttagtagaaaacaccaattttttttttttttgagatgaggtctcactctgtcaccaggctggagtgcaatggtgtgatctcagctaactgcaacctccgcctcccaggctgaagctatcctcctgcctcagcctcccgagtagctgggactgcaggtggtgccaccaccctcggctaattttttggtattttctgtagagatggggtctcgccacgttacccaggctggtctcaaactcctgagctcaagttatccacctgccttggcccccaaagtgctgggattacaggcgtgaaccaccatgcttggcccaaaacactacttttcaacaagttgtagtatatattagtttaaaattagttgttcatggctccttccctagtctctttttttcttccatcagcagataatagtcaactcttatttaggatttttctgttttactctttaccattgatttctttcatcccctcctttccccctccttagggagaatgcacagaaaagtagttcctgaagtaggattagcctaccctgctgcaaatttgctttaagaagcttgtgattgctgtaataaaaatcaaggaactattttgcttttggataatccatcaatgaaaataagaatatttcatggttgtctcttgtttccaaggcgatttaagttttagtgcatggtttgtacactttgcaacaaggtaaacaggatagctataataatattagttgttatttaagttcttgctatttgctgagcactttatttacattgtttcaccaaatctgcatgattttccctgttctgctatgagctacacgttattattttcactttagaaaagaggaaaatggggctgcaagaggtgggataaatttcccaaggcgaggactgaagtttgaaggcaagagggtccgaatggtctctcaccccatgagcccatcccttaagtgtgttgcacactcaggcctgtggccacacagcctgaagccctaagtgtggctggtcctggaactgcagttatttagagcagaaggatgataaacaggcagagggaaggggagcagggagcctcgtgagtgagatttttcctttcacatatccactgtcaccccttctattaacttgaactagagtgttttgaagttggagaagaattaaaaaatgcacacaaaatgtgacaagctctggtacaacatgttgtcattattttcactgaacacagtgcctgacactttgtaagtgctgtacaaatagtagctgctcttatttttatggttgctattattactctttgggtaatcaaaatgagattttggttatttagatttagatatttttgaaacatgtaatttttttaatggaaaatatatccgacactttcaagtacattgatttggccaatagatgactaactggatttatagacagataggttatcccaaagccttgcaaactgctgccacagacatgggttttgtctgcttcacttggatttccagagatgacatagtagaatcttgccagtccaaggcccaagctggggtttgggttccatgactgttgagcctgcactcagcagaatttacaggtcaaggccttggtgttatcctgaggtggttccctgtggaattctttggtataaacttgtagcctgaagcctcagtctctaattgctcttagaagcattttgcatgagctcggttggttttcatattgctgcgttttgggtgctgtcagacacagtatattgttgggaaaatgatacactgtacatctaaaacctgttttctctcaaataggaagatgtaatgattagctccagggacccagttgcctgtgtgagtcataaaactgagataagaccctaaattttggaaatttttataggaagatgcatgagagattttaaagcaacctatcacccagggtaccatatgaagaaaaagatgccgttctgacgtcagaaccacaaatagcattaaagctccggaactggaaggtgatgacaagggttcaggatagccagagcttttgtccactccagggttcctgctgagggagcttcaaacgagagcaatgaccaaatggagagacaaatacatttatgaaggccagtgatgacccaacaatccacacctcagccactagtggtcctggggccttgtgggacatactcattttcagcttaaaaaatggattgacagtcttggccgagaaatggggtctctgcaaggaaacaaaagccaccaatagtgtttggagctgagccttagttggaactagaagtctctttcccccacagtcgagagtgtgatgctcaaaagaaggatggccaaataaagactgaagggagcaaggatcagcttagtctgtgcctgtgcaagcattgggtggatacaacctttcatcccagatccatctgtcatgtgcagcctcagacacacacatgcatgcacgtgcacacacctgctctaggaagtgttgctgggacagaacacctaggcgggtaagttttcaggagacttcctgctctccccctcccacatctataatgctgggtctgtgaagccagtttcaggacccctcctcacccagtagactcttgcaggtcctcctgtccttgtggttgctgccctgcccttcttctcagtcacatgtggagcccagggtgaggtctctgacacccaggctgttctctgcagtgatctggcccattaggactgtcaaaccctgggactggctgactgactgtggagccttcatcccttgggaggaacaggtgagggcaagggagtgtgatccacttagcctgatctccctacgggcagtggtagaggggagttttgcagactttgttgagattttcaagaagggacaaggaggtggggcaaaaggttggaatctcttattatatcaaaggtgagaactttgaatcctaaaacacaaccaggaaatgctttggatgaacgtgaaaggcagtgttcacttttatatgcagactatatgacaaacattagtttgtaaggcacctagttgttattggggaaagactttcatatagaaacatgttatatgtggcatttaggtttctaggttagcacaaaaaagttttagcccattatgtagctggaatatatttacactgttgaaacaatattgctgtgaaagaaacataaaattgaattagaactcccatttcttttgtatgggtgtcctttgggagaagcgggtttaattagaggctgatgaagcagatgagggagaattcgtgaagttcctttagggagtagttatctttagtgatccattgtgtgctggggagctgaggggctcaggtggtgttattaacctcacattgctagggaggaagtggaggcacaggcggctcaagtagcttgaccaaggtcacacagctagggactcagagctacatctgctcaaccgtcctgttttcactgtcctattttatctccaggtaaaaaggggtgtgtcgagcttctttgtggcacttattttctgtttcatctacagatagctcagttggtatcttttaactagaactgtttttaaaaataaatcataaaaccattatataccaaaaatatgacaacttaatatcaatcacacttttctaattgtcttactacttattcttttactgtttgttggtatccaaacagtaactccactcattgcagtaggttgctatgcctcttaagtctcttttaatctgtagcttccccttccagtctctcttttctatatacttgcagtttgtttgttgaggaacctgggttgtttgtcctgtagattttcccccaatctaaagtttacttattgcattcccatgatgcatctaacatgtttccctgccttctgtgtttgctagaaaccgtagtttgatttagaggtttgattggattatactaagttttgtagggtggaggttgtctcttttctgtgatgctaacagaaaatcggagtatgcgaagttttgtaggatgtttggttgtctcttttctgtgatgctaactcttattaacgatcattgcttatatccattagtcattagaggttgtaaaatggtgatatgctatcattttgtcttcatgtattcattggaatgcctcaagaaacttttttcaagagttgactccctagcattctcctaaggtgacaggagttctttgcctgttaatttgcttagtatcattatgaatcgttatgggtttatgtgtatttgatgtgttgatgcattgcagttattaaacctatttgtgcttagactgcccagttttgactgaagggagcttattcaagttggtgaggcacttttcttgaagaaacagttctagctaagttgagtgtgtccttattcgaaactcattgtttgtagatggggactccactgaccaccctgggggtggaggcacatcctggtgtccacctagccctctctagtcatgccaaggccccaaacatcatggagcttttgaaaggaggcatttcacaaggcccccttgcagctcctttgctataatttttgtggctgcaaaagggtaacctggtgtgaaggaaaggtgctcactgactccagcttgaattccagctctgccctgtacaaactttgtgactttggagaagctgcatgatttctccttgcacggtagggataatgcatctctaaaaggattggtacaacctagaggtacagtccctgtaaacccgctaggttctcaagtacgtgtgtgtgtattttctgccttatactaaggcgctactctaggtttggagtgataaaaaaaatgaatatgatggccgggcatggtggctcatgcctgtaaacccagcactttgggaggctgaggcgggtggatcacgaggtcaggagttcgagactatcctgaccaacatggtgaaaccccatctctcctaaaaatacaaaaattagctgggcgtggtggcttgcacctgtaatcccagttactcaggaggctgagacaggaggattacttgaatctgggaggcagcctgggtgacagagtggagactccatctcaaaaaacagaatatgacatagttccacgtttcgggagcttccattgtttgtgccctatattgtcgtcttctgtgggaaggcaatgtgttgactgagtgccggctggctggcaggagttacggattgggaattgggttcttccaggtgagacactcctactgggagagcatgaagaactgtgagcctgaggggtaagtcagctgaagactgtaaggaaaagccaaggagcagacaactgtacggccacaggcaggggccagaggcagaattaaggtcaggctttctaagcctggagctcaaagctgccagacataaataggatccaagagaactgattaagaaggactctaaagtctggtggagttgatggctgagaatactcttgggtgttatggttcagagactgccagataaggcttgctttgggttgaagctctaaagcagcattacccaatagaaataaaatgtgacccagatgtaacctgcacatgtaattgtaaaattttttatgaatcacatttttaaaagtcaaaataagcaggtaaattaattttagtacatgttcacttaaccagtatattaaaaatattattttgacatgtactcaatataaaatttgttaatgagatagtttacattctttctttttttattttattattattatactttaagttttagggtacatgtgcacaatgtgcaggttagttacatacgtatacatgtgccatgctggtgtgctgcacccattaactcgtcatttagcattaggtatatctcctaatgctatccctcccccctccccccacccattctttctttttttttggaactaagttcttaaagtctggaatgtattttacaattacactgcatctcagtagggactacccacatctcaagtgcataatgaccacacaagtagctaccatgttggaaaaacggaggaagaaagtgaaatttacatcaaggttctaagtcaagcatttacaatttgacattgtaacttgacaagcatagcacagtagtggtgttggttttttgtctcttagtttgtagctccatttttgcttccccattttctcctttgtattatatgaggctagaagtctgcaagctgcatcttccacattacttttccagatggtttcctcttagattccacaggtaggagatactggcaggaaattggaatgtgagagaaaggaacaggcgatagcagtggcccctgctaagtggcagtggtgctgcctgagtggtgatgatgccagccccctccgctgatcagcatgagtgtgggctggcgggtgtcagcccagggtgttaacagtttattgtctctggatgttactgctttatctttttagtttctccagctctacctccatcttccctttgttcatccataccttctaacacctttgtaaacagttcactacagcggtatctcttcttaatatatataaaatggttcttgcttttctcactggacacttgggatctgatgtcagagaactatgctgtactgtggtcttgtatgtaccatctgttggttctatggcttagcttctttaattttcaacttcttctgtctaaggatagaaaaataaggatagtgaaagttctgacctcatagagttactgcaaggatgatataatcaatatatgtaccattgctagctttgaatgtaacacccagtaaatattgcttattattgataataatatacaagccgatttttgaaggctcataatttaacattttttattatggaaaagttcaaatgtatacaaatgtagtgagaataggatagtgaaacctcacgtgtacatcccccagtttcaacagtaacaaattaagactattcttttatttatacctcctactttcccccatactttgggattcttttaaagcaaatctaaaacatcctcttatttcagctgtaactatttcagtatgtaactctgaaagagaaggactgtttagaaaacacaaccacaatactattagcaaatccctaaattaaaataatttgttaatattatcaaatacaagacagtgttgaagtttccctatctcataaacattttcatttaaagatttttttaatcatctttcaaataagatctagctattgcaatcaattgatatgtttcttaaggatcttgtcatctgtgagttccctttcctctctttctttttctcttacaatttgtttgttgaagaaactgggtcatttgtccagcagagtttcccacagtctggactttgctgattacattcctgtggtatcattaaccacattcttctggccttgtattccctgtatgttggtagttagatctagaggcttgataggattcaggtttatttacttttttttttggggaagactactttataggtagtgtcatggacctccatcaggaggcacatgatgtctggttgtgtctcttggagacgttagcagccactgatgattgttgcctagatcaattaattccttaggggttgcaaaagcctaccattctttctacagtgcttctggaatgcatctataaagataaacttccctccatccaatagttggttatcctgaggtacagttcatatgagaaaggcagggcaaatgcttgattctactcttccatttgccagttttcaaaataatgagttgatttcctagcatcctccaaaggtaaccagtgatgatttttgaattcctataaaattatcagtttataaatattagatgtgtcatagtccattgcagttattgtccttactgatgctcagttgtcctgactttgtctactcagagtagccacgttggctcctgtgtccttttcatagtctgctagtaatgtttgacagatttcctgcctttttggactgactagatgttccaggtttgttgcgtccattccctgtctctgatctagaattagtcttttctcccaggaacctaattatttttattgaaaaatggtatttagaggtatgatctcgggtgttcattgctaatggactggtcattgcttctggactttttaagtggacatagccaggaaatagatacttttgaaagataaaaatgtaccgtgagtgtatacttattcatccagtttaaatttaggactacaagccttttcttcaacctcgtcagtcttacgtttctatttcctctttcccatgacataaatcctggttcttaacatcatcatgataattcctcatttgttagatcccacatgcgcgtgcacacacacacacacacacacacacacacacaccccacgcacacatctcagaataccagtgatcaacacgacttcatgatcaatatgaacactgaaaacagtttgatttttttccagtgatttttgatattagggtctgtcccactaggggtgagcaggcaaattactgtgtttataattgtttaaatcagttcttttttatgtggctattctactaacaatggaccagttagtgattagcacaatacagttaggattatttatttcattttccttttgatttggtcttctttaatgtttagtttagtgttataagaatgtaaattatttatatgcatcaacgtaaaatatggtatattcagagacatttagattttatctctgtctcttacattctatgccctctgccttattggtaattacattttaaaatgttatgcatttcataccattgtttaaaatacacattaacatatgttctgcagaactcaacttttctgcattttccttttttcacttaacagatatcctggagatcattccatcgtagttcataaagatattcctcattcctactcatagctgcatagtataccatcatgtggctgtactttgttttattcagccagtcccctattgatgttttttggggggattatttccagtaatttttgctattgtaatggtgatacagggaatggccctatgcctatatattttcatatcatacagtctaattttttagtacaatagtgacataatgttttccagaaagaatatatttatctatccagagcattaacttctgcctatcatacaaagactttccttggactctttagttgtttagtaattgtaaaatagtaatatagttttagctgaagctcaagcttaagatctctagatcttaatctcagaggattttctttgagtaaaatgtacttttttctgctttcaacccagctatagtttcattttcatggaggtgtgagatctctgagacaaattgtttagaggaggtttgtcttgcatctgttggacattgtaattctcctcccttatgatggcagcaaagtgatttgagaagaatagtggctgccttttcatcttcacttctgcctttccacttacattaaagtcctatgcgtttacactggcattaacccagtcagcacccacaaaatgccacagggggctctgtatcactgattgttgtaaagaactttcttgagccttcattagagcttagagcataattgtaccttattttggtattaatcaccaagacctaaaatcaagtttttttccaccttagaaatggaatgcatagatgtatattcttttgtatgtttcagaaattggattttatctttgtgatagaatcacatatctgatccataatgatcctgtagtgctttcttatgttcaatataatttttaaactgaccttgtttttttccttatataaatgtatcaactttatcaactagcaatgctcaaggagttttcttggctcacaagttgtacatgaatgggtgagatcatacctctaaataccatttttcaataaaaataattaggttcctgggagaaaagactaattcatgaagtttgggtggggcaggagaagaaagactggcagaagcaaaggcacccatgagagagagagagcaaagatgaattagattcatagcaaaattttggaggtacagatgggaaatgaaagatggagaaaatgatataaagagtggaggtgtgcctgtgcatgtccataagagataatcttggaggtggagtatcttaactatgctgtgagccacgcagaatggaagacagagttggttacctgcctcagtttaggaaggggaagcaaggttggggtcaaatatgcagaaactttggggcagactggttcagttcaacaaacatatactgagggcttaactgggcatcaagcacctgcattagatttaagaatacaaagttgagtaggatggttgcttccctaggtgagtttatacttagttggaggagttgaaagggataacacacaagcagatatttacttctttataacacattaccatagacttaggggcttaagacacccacatttattattagttgctctgggtcaggagtacaggcacagctcatctgggtcctgtacttcagggtgtcttacaaggctgcaatcaagatgttggctagggcagggtcttatctgaaagcttgactggagaaaatcttccaagcttatctacatggttgttagtaggattcactttttagatggctgttaggctgagagctttagctccttgttgactgttggctggacaccaccctcagttccttgccacaccgtcctgccccatatagcagcatatttcatcaaagccagcaagagagacagtctcttttatcagtaagatggtagtcatattatggatgtggaagagaggattacacaagggcatgagtacgaataggtgggaatcattgggggctgtgttggaacctgcctgtcctacaagtgtctgctacagttctgtaatgcctgagagaggaagtgttccatggaagcatgaaggaagagcatggaacctacctggcagggaagtggcttctccaataatgcagtgtctggatgtctgagtgtaaccctgaaagacaaatagggattaacttggtgtgtagctgggagaggaggaagggagagattccaagcagagagactaacatgagcaaacattgagggggtaaaatacctgaggaccaccatccaagtagttttctgtgtaaaccatgtgtggaagacatatagaaggtatcagaaatggagaaaatgaaagatgagggtcagattttggagttcctcgtttgtcaggctgaagaatgaagactttatcaaggtgatcacagggaggattttaaacaggggaatgacacagtccaagttgtggtttcattagtatggaagatcaattttagcagcatttataatgatttaggtgatagatgaagagggtctggattaaagtagtgcaataggagggcatacattttaattttacaattaggaagttatttgatatttgggcaaggcagatgtgggagatagaacggtctggaatgatgtccaggttttggcagaacattcttgttaggaagcaggggaaagagaagttgacagagggaaaggaaaggatggaagggagaggtctgtaagagtttatgtaagtttgtaaattaagtggctgatgataggagagcccaactcaaaatactctttaaagagcttatgttctcaatttaatcaatgtaactgtgtaaattttctttctagttaagccatatgttcctctggtaggagagagaatcaaatacggaattcatttttcttgcaaacagttggataaaagaaaaattagtgtcaaaattttagtaaacctagaccaaaggtgggacacgcattcactagttctatccagtgcttgcaatattgtactctggcacgcagatactgctatagaataccattcacaagctataaagtgtcatgtaactgactttttcttgaaaatggagatataattagaaaaacataaaattaaccattttgaagtgcacagttctttgctttcagtatatttactatgttgtaaaaccattactgctaattctagataatttctaacacctccaaaagaaaccctgaatttattagcagtcagttccaatccccacccctccgcactcctacccctggcaaccattaatgtgttttcaggcactatagatttgcctattgtggacatttcctatagatggactcatacaatatgtagggtttgtgtctggcttctttcagttagcatgatgtttcatggttcattctcattgaagtatatatcagtactgcgttcctcttgactgtcaaataatatttcattgtatggatatactacattttgtttatccattcatctattgacggacattgggttgttttgactttttagctcttaggaataatgctgctatgaacattcttgcacaggttttggtgtggacatgtggttttatttctattgggtatatactaggagtagaactgctgcattgtatggtaactatgtgtttaactgaggaaccactaaactgttctccgaagtggccgtaccagtttctcttcccgccagcatgtatgagggtctctatttctccatgttttcaccaacacttgttattgcctgtcttttttattataaccattcttgtggttgtgaagtggtatctcacgtggtttgatttgcatttccctgatgactcattcaaggttgtttttaagaattaaataagctcccataggtgaaatctcaacatgaacttgggtttcagttctctgctagatccaggggccttcagaaaaactatattggtattccttgtcaatttaatttacactgcacctttttagctcaggaagccaaagtacaggcaccacttctcacactggctttacagggatggatgctagaatcccctgtggggccctatcccagagctctggaagcacaatctcaaggggtctgcccagcctgtgcattttaaatttattctattttattttgagatggaatctctctctcttgcctaggctagagtatagtggtatgatcttggctctctgcaaactcagcctccgaggttcaagcgattctcctgcctcagcctcccgagtatctaggattacaggcgcccaccatcaggcctcactgatttttgtattttttgtattttggccaggctggtctcgaacttctgacctcaagtgatccacccgccatctcaaagtgctgggattacaggcatgagccaccagacccggccattctgtgcatttctaaaaggctgcacattcaatgtcaatgcaaagtcaagagttgagaatcactgcctgactccagtctgggagaagaaattggtgggacctggaggaaaagcaagagacttagtctcaagaatcttcaggcagcaccattttttgccaccacaggaggtgctggtgaacacatgttgttcagacctctcaataagaactgagagagttgcttgccatttctgtaagtgcagaaactaagatttcgatttggttcagaagtttagcattaaccccaaatcattggaagcactagaattaaatgtgggccaggtttctggtttgggtgcatggagtcatgcagtgtgtgttggtacttgatatttgttttggtagtttggaagaaatggcggttaaaataatttccaaatggtgactgaaacaaaattcacatgtagttgttttggaatgcgttttttacctgcttgtatgaagccagatacagcagacagtgtggaaattggaaagacacaaagtcaggctacaaagacccagcttaaaaggaagtaggggaaagtgtgtgggaacttcccctttctacttttcagttctttttgctttttacttggattaaacagtcttgctttttagattgacttaaagttcttaaggaaaaactgtttctctttaagctgtttttctttggttacagtggaagtcattgggtttaggtttaaagggagggaatttcaaatcaccttcgtttctgtcttttgtgtgataatcagagaaagtaggaacgatgataatggtaacaatgtcaaaaggaagctgtgtgacaagaggttttgctacgtgttaattcagaattgattgcagttgtcaaagttgcatcagtcccggtcccacgggaaacagctcacccccagatggttctgatgaagagacttcagtgtaggttctgcttacagaggtgtgagcatagataaggaaagacaagggacaatgagatgcctagactagcaactgtatttagcccttaccggccctaggactgtagactgaggggcccctggcataagcggtactcatgaaggcacatgctattgccaggacagggcactgaagcagcgaaggagtgggaaagaagtgacttgacctctctcagctctcatcctgcagtgccctgccagtgcctcccactggtcacatccaacatgaagccagccacaagggaggcttgtgcaggctgcacagatcagcctttcaagacacagagcagggcagacagtggatgtggatgggcatagtggtttttacaattggagactaacttgcacagtaatcaactgttttacagtgatcacattgtatattttgttaattttagaatgtattattttggagaactttgagaaattttgcaagcatagaaaaacatccatttttcatatttaaaaaacgttcctcagtatttcacatttacttatgcaaaagcttcttgtcttttaggttgtaaactttgttatgaagtctcttaaactttgtacattctccttattttcccaatatattagtgcatatcattgtattgcgataagcctgaaacagagagggccacactgtctttcagattggcagagggtgctttaaaaattcctcttttctagataggggcatagatatttgtgaattattcaaaggtgatcacttgcctttaaatcaagttaatcaaagtggaatttagtttaatgtctttcgtagctcatagcttagggggaagatgctgtgtgtttgagacattcacatagctgcatatatcatctccttgcagacatagctgggaattattttgctgcacacattagtgaaatataccaacttgaaatgtttgtgctaaccgagtgacctgttttctgtgtcatcatgtgtgtaattctcttatgtctgagtaaaaggctgagatgaaggtctgtgtctctggatacccgtggggttgctaggaaatgattttcgaagtgctctgtggtgatgcagcaggttgaactttttttgtgaagtgttgtcatggaaaccaagtgcatcattgccttgtctgactaatttatcttttaatgataaaaatttgtaatccagggttaacaaatataaataatacaaatgcaataaaaaaccaataactgtaaagggaatactgctgtaagtagcgaatcctttgaattggaagatgtcacaggagtattgtgtgattcatgttggtaagggcttggcagtgtggggagctaatcagtttgttttccttcttgtcattggagtagggaaaccatgatttcactctgtggcttagtgctgtgggcttttattactgacctcggctcctgagcttataagtaaagaggaaggcgctgcacaccctgtgaggctcagcaagcttgccagggttttgttttctgggtggttgcttagttgtacttctcctttatgacctctcactctgctctctccacctaagagaaggctgggtgacacaatgcaagccctaccattgatgaaggccagtcatatggaaatggtgccacaggcttgctttctgggctaagcagtcctacatcccccttccccaggagcaggtcctggagcacagaatctgccttgacttccttttcgtggttaaagggccctcaaggagagaaaacctgctcttttgtttattgaggacaaagtcttatagcattgtaagatatcaatggatgctgcttatatctggatgagtagcttactatggtaagctttccaatgaaaggataggagaactgatctgaaagaagacttgattctatatttagtagtttatctgcctccataaggatttagctactggcgtttcagtctacctgacagcccccaaccccctgaagctctgtgtgtgtgtgtgtgtgtgtgtgtgtgtgtgtgtgtgtgtgtgtgcagtagacttttgttgcattaggttaaatatgctcttcagttttagaccattccaaaatatcttttattaatatttccacctttagggtatgtttgagttttttttttttttaatttaaggggaaaaagtttgactctaggcatgagtcctaagataaataatggaagcgagtcaatttaaatcagtatttcactgactggtgtttacggcccaaatctgttttcatgctttcatttagcatatatttcctgagcacctgctttgtgctgggtacttctgatgcacctattatggataaaagaaggcgcctagaggtaactttaaggggctgagagcaaaggccagccagagcttgcaacctgtccagagcagtttcagaccaggaggattccatctggcagccatactgaaatctcactggtgatgtccctgcatttctgtgacttatttcctattcctttggtcattttcccagttccagaatcttgaccgcacctcctaatgacgatgtggtacacgtacccagcattttgcatgatttcctagtattgaccttctgtagggaatgtcacctttgttggtaaaatggcccccagaacctagacctggaaggactgggcagctcttgactccatctatggcattttatcttctgctttgatctccctactcaccctcacccaactccacatgggcttcagggtgagagaaggggccctcctcccctcgttaatatcctagccaactcatacacatgaggttgtatttagttcccagagcagaggtgagtcaagactcgcatgttcaagaggactttaccgaacctcagagatgacagaatagaacaggccgagggagcactctgaaactagaccctctggtttgcccttgggtgctgcagtacttgtctagtctaccagagactccagtctggccttccctacatagtacctttccatagaagtttgacctttatcctctctcctccagattcttccccaagattcctagacccctgacgtccagaccaggtgattctaaatccctcccagggtaaatgttatctttggaagtaagtgattgagagcttttgcttagaattccagctgccaccactctctaaatgaatattatttggcctgttttctcgttcatttaatgggataagagtaattcctattttatctgggaccagtgaggattaaatgagagcatgcacgcaaagtgctcaatgtaatgcctgacacttcgtaaatgccttgtcatcatcatattgttggaaagaccactcttccagtggtctctcacccccaacccattagggctattcttagccctcctggtctaagtacaattatcatggccgtcatctcacagagcagccccacagaggcctacaatctgttgtttgtccttgcaccacagctgccctgggcccctcttgtatcacagaataatcccatagccctaccctaccttccttctggtatttacctgttggttgtgatttgtgtgtgcgtgcacgtgcttgaggaaaccccaagttgggaaacatgaaaatgggagcatagactaactaattgaccatatttattcacctttagtatattattcaattgatgaaatactcagaatggcctttgctgtaaaacgtccagcattttgcctccatttgctgtgtatatttcagcactgggcctaccagtgtatgaacaggattctctgggacatgctcatgtttctccctgttagagtctcattcttgcagatcaaggattaggagactaaacggggcattcattcattcatttagctatacaacaagtaaatgttgagtgcctactgtgaccttgaatcagggaatacaaacaaggtccttacactcatagtgcttatgttgtaatttattcaccattttcattcattcatccattcattcattcaatgcatcttgaaattctgtgttcatctttttgtcaataaggaatattttcttcatatccttctctttttttcacttacaccttcattcgtctatttgtttggcagatattgattgaagtgggggcctaatatgtgtcagtcaatgtttgagacactgagttacagcagaaaaaaaaacaaaactaaaaattcttgttttctgagtacttacattttaactgggggagatcaccaagaaaaaaaatttaacaaccttatttggttggtactataattatccccatttaaaagatgaggaaactggagccgagatagattaggtaatttatttaaggtcacaccaccaggaagtggcaaagtcacgattgacacccaggctggctgactggactcttaactgctgtgctgtgttgccagagaggatattctggaaagataacttttgagataagacttgaaggaagcaagggagtgagccatgtggctatctggaggaggaataccccagacagtgggaggtcccgagtcaggaatatgcttggcattttgagagaagcacaagcaggccagtgtttttgggatggaataagtgagagggaagagaggtgagaggacaaggttctagctacctgtagacacaaatgtgggagtcatcagtgcatagatgacacttaaagctatgaaactggatgggatcatcaagtgagtgagtatggatagaagaagagatctaagaactagattaagacctggggcacccagaagttagaggctgggttgatgaggagaaattcagtttctaagaatgagtagccactgaataggaggaagaagtgtagtgactttcacttgaatgccaagtggaaaaagtgttttgaagaggaggaagtgattaactgtgtcacatgctgctgatagttcaaaaaagatgaggaccaatattggaccactggatttagcaacatggaggtcatcagtgaacttgaccaggacagtttcagtgtggtgatggaggcaaaatcttgcctagagtggttcaaagagagaatgggggagagtaaatttagataactattttgaggagtttttccacaaaggaagggaaaaaaatgaaatgatattggctgggaaagtgttctataatgtcaatttagttcagttggatgatggtattgtttggtttttctatattcatgcttattttctgtctaatagttctattaattactgaaagagacctccaactgtaattgtgaatttgtctatttttgcctttagttttgtcagtttttgctttatgtattttgaagctccgttgtttgctaattgtatatttagtattttcatgtatgcttggtgaattgacttttttatgattatgtaatttccctttttatccctagtaattttctttaatctaaagtttacttagacagatattccctttgtttgattagtattcacctggtttattcttttccatttgattctacctgtataattatgtttgaagtgagtttcttatagatagcatgtagttgggtcatgtgtttttaattcattctaacaatttctgtcttttaattgatttatttagaccatttacatttaatgtccatacttttattatttgctttatgtttgcttcccctgtttttcattcctctgttccatcttttctgctttttctggtttattcaaacattttttagtattcaattttaatttatctattgtgttttttactacatctctttgtgtagattttttagtggttgctctagggattatcacacacacacttaacttttcatagtgaacttagaaacgatattctatgtcttcaaattatataaagaaatcttcatgtgtgtcttttttatccaatcttcttcatagttattttatatactagttatatgtacattgaaaactccattaggccatgtcataaatttttctttcaactgtcaaacatactttaaagaattcaagagaagaataatctactatagttacccaaatatttacaatctattgcttttccttcattcgtgatgttccaagttttctcctagtatcaatttcctttaatctgaaagcttttctttagaattcttttagagcaggtctgttgacaactgatttttaagtcttttctgcatttgagaatgtctttattttaccttaattccctatgaatattttcataaaatatagaatcctgagtgaacaggttccccccaccccaggactttgaagatgatatttcactaccttctgtctcccatggtttctggtgagaaacctttagtcatttgaattatggtccccctgtaaatagtgtaccattttctttggatgctttcaagaatttttcattatctttagttttcagtagtttgattatgtttctggacatggatttcttggagtttatcgtgttttgagtttgctaagtttcttaaatatataggtttatgacttttgccacagttggaaatattccaaccattatttcttcaaatatttctttgtcttctctttctgaaattccatgacatgattttaagaccttttgttattgttcaggttcctaagactctgtttttttagttcagtcttttctcttttgttcagattggataatttgtattgaatcatgtgcaaagttcactgattcttttcttcaatcattctaacattgagcctatccagttggttttttattttggttattctatcctttagtcatcagattttcatttgattcttttttatatcttctattctttgctgagactttaaatctttccagttggttcaagtgttaactcttgcttattggaattttttataataattgcttagtctttgtcagataattccagcatctttgtcatttttgtgttgacatctatattactgagggctcttcatagaaacagaaccaataggatacacatagatatacagaaagtggtttattacaaggaattggctcatgtagttatggaggcagagaattctcatgatctgacatctgcaacctggaggcctgagaaatctggcagtgcagttctagttcaaatctgaaggtctgagaaccagcagagtcaatgtgtaaattctagtacgagtccaaaggccagagaaccaggagcactgatggccaagggcaagagaagatgaatgtgccagctcaagaagagagaatgaatttgcccttcttctgcccttttgttcttttcaggccttcaacagattgtatgatgtccacccacttggtgaaggtgaatgtctttactcagtctactaattcaaatgctaatctttcccagaaacatccttacagatacactcagatatgttttaaaagctatctaggcatcccttagcccagtcaaattgacacataaaattaatcatcacaacatctgtcaattatcttgtcccatgcaagttgtaattttcctggttcttatgtccaggaattttagattgattataagactttgtatcttgattaaatcttatggtgaatcttgatatttccgttttagcagggaatcaaccctgttgggttcagaccacaatttctagtcagccttcttttgtggttatatcaattacatttttaaagccttttcaatgctctttgaatatgtcccatgtgtatgccacccagtggccagtctgtgacctgaaaagtgatctgtctcataatttagttctctgtaatgtgctttttagtgttagatccatatatatgcagcttggaggtgatgctagcagtacataaacaacctatggcttcgattttccaagcacttccttgtttgcaatctcttggtattttcaagttccctggggctactgatatctggccacctttcttttctctaattctttgtacaataaacaacaccaatcttttctctcctttactggataattttagtgtggaaaataacatctaacctttctgaaatcgaaatccacacttttgatgaacatgatccaattccaatctcttatgcttatgtaactttaaaactttccacacatctttctaacaaacatgggctcctctagctttagctgtattgtaagatcttagatgaggttaaacaccttcctgttcagagctttcattcttgtaataacccaggcttgtctctccagaatgctcttctacttgggtggcttttaaagcatgtttgtttatagctgctcctggtccattatcccctgggaacacaatgttttatagggggtccttgagcagaaaaacacagcagcaaccctaacccttcgacgtcagtctctccaagtgcatctaagtttaagtgttttgcttccttcatcagtactttttctgtgatccttccttttcaacaagctctccagtaacagcacaagacaaaagttaaaatgaagctttttttttttgtatttcgttttagtcattcaattgagagttttttgaaagggcaatttaaatttgttttgttttgttttgttttgagatggagtctcgctctattgcccaggctggagtgcggtggcgcgatcccggctcactgcaagctccgcctcccgggttcacgccattctcctgcctcagccttccgagtagctgggactacagacgcccgccaccgcgcccggctacttttttgtatttttagtagagacggggtttcaccgtgttagccaggatggtcttgatctcctgacctcgtgatccgcccgcctcggcctcccaaagtgctgggattacaggcgtgagccaccgcgcccggccaagggcaatttaaattttaattaaaactccgaggtcacaggaggtctcgtagacaggattctactcatgtagaaagaaagtagaaaccataagataacctagtgtacatctgccttgtcaccagtcagataatcctatgccaacatcttctccatcactagggctagctattaatatcttttcagtaaaatatgctatttaaagtgttatacccacactaattattcaaacacattcaaattgaaattaactaagctgacaattattcagtacccattttatgcaataagtgttgtgaaaggaaataaagaaagaaaaatacataactcttacctccaagaagctttctgatttgcatttccataaaataaaattattttgtctttcaaatacaggtttccaaatacagagggataaaatgttgaattaaccttttgaataatacgtagttgcaactaagcagcgttttcctaaataagcatgtttacaaaacttcctaggaagtgaccagattgctattcattttagtaacacatagtgaatttttttagtgcaaaaatgagggataaaggagaaaaagtgagacagttgcaaacaggagttgcaatcaacaagggagacagcagccaaatgaaaagagttctttttctagagcactcactagtatagcatttttggaagagtggcttttgaataaaacatccggaaaactggttgatacacttactgtcagttcagcacgcacacctcattgcttttcttcggcaagtattgggagtaactcatcattatagtcaaatatgtattcaaatgctttgactactggagatatcatagttcaaagtgtattgctcttgaatctgaagaaagaaccttaattgatgtttaatgtgaactcagatattgagagaagaatgataagacgtcacatatttcaacagatttaaagtaatttgaggaggtaaacaggcataatcattttacttatggcacaaaaacaatcatagtaagaatagttactaatatttattgagcaccacatgaagagcatgatgtgcattacctcactgaatcatgcagcaatcctgtcctataagcactatgatccttatctccattttaccaacatgaaggattagaggttagagaggttcagtagcttgaccaaggtcacactgttactaagtgatgaggccaagtctgggtgccaaggccagttcccagccaccattcctccctctctcatgagatcatgtgttcttcaagcaaagttcacgttggccatcagattatttctctgggaaaatattaaagctgcattgatttgctaaagaaaccacaagtgtctggctaacttgcatttcaaattttgctttaaagttttaaagttatcattttaagaacagctgctgtagctgctataatgcctctggaaaagatagcagaaaaaatccactgccttgcccaccactactacaaacaacagcaaaactttctcatggttcaaatccttccttaacttgtcccaacaccaaattcacgcaaggtgtatgccgatgagcctcctgtaaaatatccagagcttctaatttggggtaagatgaattaagcactccattctctctctccaacttaatgcaattataaaacctggcgagaatgcatggagcaattatttaagaaccttgaaaagtaaatagtaacaggtagattgggagggcagccagaaatggaagaactaccaaactggtggtgtgtttacaattttcccctcactggtatccctcagcctgtatccagtgctctccaagagacctccctgagtccttagttctggcagaaggcacaggaaaagaaaggtggccaaatatcagtagcaaacgtgcttaaagagaagttaacagttattagctcaacatatttcatctacatcagcatgttttaaagtatgtttcaaaggacaatagttgtgcagaatgttaggctcaaatgaacaaaaaagcaaaatagtggagatccagtgctgtttgggattaggctctttgtaaaccactaaaagaagctagatatatttctaatttggtaaaataataggtatgatttggagatccagtttattatggctaaaatttattagtgagactttaagacatcagctccttctgttagaagttttatatcaaaatgtcagtcaaatttctttttctttttttaatttatttatgtatttattttttgaggcggagtctccctctgtcgcccaggctggagtgcagtggcacagtcttggctcactgaaagctccatctcccgggttcacgccattctcctgcctcagcctgtagctgcgactacaggcacccacgacctcgcctggctaattttttgtatttttagtagagacagggtttcaccatattagccaggatggtcttgatctcctgaccttgtgatccgcctgtctcggcctccctaagagctgggattacaggtgtgagccactgcgcccggccaaatttctttttcttattagatttaacattctaagaaataccaaagataaaaagtataataccaatcaattatactttttaatatcaactataccatgtttattctattttttaaaagtggtctcttttaatcaaggctttgcaatgatgttgatgggaaaagtttatggtgaattttataaatataattcagtagcttgagcctaacttttttggagtgcaagaggagtgtctaagaagatatcttctatggtatgtccatagataaaaatgtaatacctttagacagagccaactatactaccagaaaatataatctgtatgttaagtaagccatttaggagttagcattgcatttttttgttttgaaaaaacaccccagctttattggagtatgctttatataccataaactttatcaaattaaagtgtatagtttcatgaattttaataaatctatatagttatggcaacatcactacaatctagttttagaacatttcattacccctaaaagatccctagcacctgtttacagttgagcctgctcccactcccagacccagacaaccacagatcctctttctgttggttttaacttttctggaaattttatataaatggaatcatacaatatgtagtcttttttgcctgagttctttcagttaacatgctttcaaggctcattcatgttgtagcatgtgtgagtagttggttccattttattgctaagtggtgttctactatatggataggacacattttgtttgttcattcatcagttggtggacattttggtgatttttaaatttttgctattataagtaatgctgctgtggacatttgcatacaagtttttgtgtggatgtgtgtttttgttatttctcatgaggagatacatcagagtgaagtcagggttgtatagtgactccttaagtcattgccaaaatgttttccaaagtacttgtaacatgctgcatttccaccgccaccgctgcatccttttctgcttgattaaatggttaatgtttggtctgaacttaagagcaggaagcagggtatgtgggagagttgaagaagacactccaccaccaccaccaccactgcaacaagaagggcactggggagtcagattggatgacacaagccaagccatgataggactgcaggaaacccaggcttgaagatcgtagcagacatacaaactaatcagatgggttttagaaagacttagcttgggggtggggtaaaccggtggcagcagacctctgaaatggcacagtaggactccagctgtaggctcagctctagagaggaagactgaaaacagaaagagcaacagggccctcagccacttgccttgggttcatggcagggctgcagccttggggtactcccaatgtggccaaagtcacagggtcacgtatagagatgggaccaggtcaggaaggaaagagaaatgatctgggtctaggaaaccatacaggctccaggggcagccttagggcaacttgcagtgaagatgccatagaggcaagcttcttaacagaaatacatctgttgggagtggcccagcaggcctcagtatattgtatagaaagcagagactttgaaataataataataataaccaacctgtatatagttctcactttatactaagtacttttttaagtgctctctctctctctatatataaattttttaaattctcactgcaaccccacaggatagatactgttatctcatttgattaagcaagacactaagcatcaagagatggagtgacctgcccaaggtcacgcagctattaagtaggtaaactaggattccaaccaagactggctggctccaggggccatcctcttgaccactaagctagtcacccctcaatgtaatgcttatcacctctgcctgaatggactcaaaaacttgtcatccagggcagggggtgctgagaatctcagcataggagaggcaagaccctagctgaaagtttaatacaaaaatatcacgcagacataggccacagattccagtgaatgtgtaatcataggcaaggggaaaatactgtatcttaagggaaaccttaagtgaaatattccttacattgtttttttaaaaacagccaaaaatctccctctagctctgcagttaatatttgagctatgtctaagataggtccaaaagtaatgaactagaacattgtcatacaggctttgcatgattttagctactctccattggtttgaataaaatactctcctactctccaaattagcgaaatgttatacaagctaacaatggtttaaaaaatgaagagtgtcttgagtaaaataaaataactttgttttttagggggagcattaaaataaaaagaagagtacattgaaaccaaattatcaatgctttgtaacttttctgtgactttatatgcaagataattagattttttaaaagagacatatgggtagtatcattatcattaacaatgactattttctgagaattgacagtctctctgatcgtacagaagacaaggcccagaccttcaggaacttagagttcagagaatgaagtgagatgattattattgggcctcctctgcctgcctcatttcctctttctctttggtctttatttcatggagcagcttgtgtgtgtgtgcacatgtgtgcatgttcactaagggctatgcacttatttgaccctcacagcagccccgtgagatagatatattattatcctcattttaaagaaaaggaaactgaggtttagtatttacatatgataacttatctgagatcattctgatcagaatctgtgttcttactactatgtattttgtacccctcctctctcctataacctcctcccccccccgccccccccccccaactttttgagatagggtcttgttctgttgcccaggctggagtgcagtagcacagtcacagctcactgtagccttacctcctgagctcaagcaatcctcttgcctcagccttccaagcagctgggaccacaggtacgcactaccacgcccagctaactttttacattttttgtagagatgggttcttattatgttgcccaggctggtcttgaattcctgagctcaagcagtcctcctgcctcagcctccagaagtgctgggactacaggcatgagccatcatgccctgccctattgtcttttatttttcctcctcaattggtcataatattaaaaaaaaatgcattttaggtcatttgatggatttattgcattcatgctattatttgacttcattgatctacaaatgattgtgccattctggcttgtgggcgtggggggttccctcagagggcaggtcccaggacagttaggttgttcgtggggactcctccgccatctgaggtcaggaagagaaaacaagggcagagcctgacttatgtacaatttattgcagggttctgaaactcccgcctgaggtaccggtctggctcactacctatttttgtatggctcatgacttaagaaagggatttacatttttaaatgcctgaaagaaagttagaagaaaaaaacattttatgacaggtgaaaattatctgaaattccaatttcggtgaacttaaataatgttttattgaagcatagctgtgttcatttatttacttattgtctatgatagcagtcacacttgcagagtcgaatagttgtgacagagaccaaatggcctgcaaacccaaaaatatttactgtctggggccctttacagaaaaagtttgccaatccctggtctactggagcaggttggagaagctgtgagctcgttgaggaaagtgactaagctttacaaaggaaaagagccagcaggcaacatggtgttcttgttgggtaagagttcttcagactctggctttgatcttgactccacctgtgtgaccttaactccacctgtgtgaccttgagcaagttactttgcctgtctatgctcatatttcatatttataaagtagtgataatcgtagttcctacctcataggttgttataaggattatatttatatgctaatcttgtcaacagtgctttaatataaatgtagcacacaaataagttaattaaggttcattgttgtgctatgggcgtttcctctaggcttcatacaacagggccctactggcccctaaacctcagccactctggatggcaccccacccttagaaatatgagaccttctggttggctcctgagatccttctgtctccagcacaggctctggtggctcacaggtgtacttttctccttattgttctgggccagtagctcccaatgccagccctttcagaggctcctgccctctgttccgcagcaggaggtgtgatgcggtcctggcactgcagtcacgcagggtgcctcggggtcccaaatgagggccatgtcattctcacacgagcctccctctgtgtcatatcacaatgagtgcatccctgatggccctgtggggccacaaccatgaacattagtccagagcaggggtcgagccatgccctgcggtgaccctgtgtgacctgctgagggcctggctgctctgcatgttcatcaatatcacttttatgcagcaggtaccacatgccaggcctcgggctggggctctgcacacatcacccttcatcctcatgagatccctgcagagcagcacaatacccatcttacagtggggaggtcaccacagcagtcagcaaagtctccctcctgtatctagggctaaatgtgttccttccccctccctgagggccagtgttctgtagagatttggtttccctcaagagaggtggaaatcatgtcctagtatgataactatgaatcctttctgcctcttacccttggctgcctcatcccctcacccttaggccacattggtttctcctaagcaccatgtgtagtaggtattcagtaaatgtttgctgtccaggggatccatgcaggaaggtctgaggttacaagcaggtaaacagaaaagcccacagcacttcacccgcatggtggtgtttggatctattataacagcacgtctaagccaggcctgttcatcccccatgggacagctgagaaaacaaaggtaggtgcagagaagtgaagtgattattccaaagttacagtcacaaacccagctctgactctgaaacagaaaagtgttctaggcagaaatgacaactgagggctaatgagcattaactggactgcaagctcgatgagggcaggggctattgcatgtttattcactgttggaacccaagggccaagaatgctggctggctcatgggaagtacccaactaatatgggtggaagtcatagcaaatattgttgccaaggtgcggatgaatcaggagcttcctatttggatgggaagcaaaggagagagtataactgcactgagagggataccttctatcctcaagaattaagaaacccccaattaaattagtttttgttgttgttgttgttgtctaatgagcttcagtttcttctgtatccacaacacggatcattggccttggtgacaaaaacttccttgccccagtataccttatcactacagggaaaaagtccgtgtgtacctaccgtgaagaaacaaggttgttacctgacacactaacaacacatcagatgcacttgcagaatccggcttgtctctggggaaagaaacaatctacttatgccagaaaacctctggaaatttacacatcgtatgtggtgctatggactgaattgtgtccctccaaattcatgtgttgaagccctaactctccatgtgactgtattttggagattgggtctttaaggtggtgattaaggctagatgaggtcacaaggctggggacctgatccaacaggattagtatccctataagaagagacaccagaaagctactccccactccctgccatgtgaggacacagcaagaagacagccatctgtaagccagcaagagagccctcaccaggaaccaaccctgccagaccttgaccttggacttgctagcctttggaactttgagaagataaatttctgttgtttaaggcacccagtctatggtattttgttatggccactcaagtgtactaatacatgtagtttcccaggattaatccatttatataaccaatatctggctggagagacctttaaatcttcaacaacagaagcagaattcttcaaatgatgccactagtagttaatgaattctatccaaataagtagcaggtataatgatccatatttttacaatacgaaaagcagcatttaactattttctgtttacaaaagtcacaccacaaacactgtccactttaattctcagagtagtgctatgatattgtgagaggcaagaaaattcaagctcaagagaggttgaatgagttatctaaagccacatagcttctaagtggcaaagctgaattctagcctcagtgtttgacttttggacaagactgtgtagactcagggaaatagtttagattctctgacctttcatggctgtatctaccaagtggcaaaaaagagctcaaaataaggcactgtaacccaaggagaaatcaggaaaatttagaacgaaggttttgtctttgtccttaatttacctgacagcattttctgaagtaatggatgtctcaaaaatgtgtgggatgcaatatgccacatttgcagcaattgctaggcagaataaggagaattggggaaggtgttagcggcatcctgccttatcagctgtcaaggccatttgctcttgtttacctgaagcatgccacttaagaagcacttcattttccactgataaaaattagaggatttaaattttgggggcaaggattccagaatgaaaaaaaccatttggctgaagtgtgtgcatttgatctcttggaaaaaacagagatttgtgaaaacaaaaaccattacaagtcgatgcaagcctcgtacaagaagatgtatgcagaggtttcttcagttggtcaggcttatgcacacgtccctgttatacaatcactgaattactgctttgcttaattgcttccattttaaagagaaaaacaacgtaataagactaagatctaaaaggaaaaacatgcaatgcttctttctcatcaaactgggagaggaataagaaattaacatttattgcatgcttactccatgtcaggctctgtgccaggctcttgggatgggtatgttgcattttcatcttcacagcaactctgtgaggtagagagtatcatttacatttttacgaattaagaaatagagttgttaacttcttcaagctttttctctttggaacttggggattgaaacaagatcagatgactcagaaatccttgccgtcgctgctaatggaatccagttactcccttcccattctccctctatgatgattccaggaagggatgaggccctcttgaccctggggtatatgaggacaagggacctgggacagggacacttttcgtaagtgccacacttcaaggtaaaaatgcccatctttgctacttaaagagcaagttcctcttgaggttctggggtgccttcccttcttcctcattaacttatttctcccacagtgaaagcagagaaggtctcttttccatgtgacgatgacttttgtatttttgcctgcccagtgatagttccctttgcagggtccacaatcagggtgaggtgtggggaggtctcagtctctctatagctttggatgatctgaaattgtctgggagtcactttccagcctgggtcattggtggcctcaggattcactgacaagtccagaagaacaagacatgtttcctgggccgccaaggtccctcttctcagatgtgaggaggggatgcaaaaggctactccaggagacatagcatgattctgcaagtgcattttggctgaacatcatgagatgtatttttctttgtagatcaggttataaaagcacatagtatagatactggactaaataaccatctgtagtagtgtaattcagccacattataggttcttaaagacagtttcgatagctagggaggctgtttaacaatagtagctaggagcatagactttgaagtcagactgtctggctttgtatctcaaccctaccacttagctgtgtaaccttgggcaagtgttcttggacctttatgtgcttcagtctctatctgtaaaatgaaaatggtaatactgaccttacagcgttgtcaggagtattgctgctaagaagtggcaattctgaggatgatccatttgaaggtcatctgtatttttttctctggctgtttttaggattttctttgtctttggttccctgcagtttcactgtgatgtgtgtaggtgtgactttcttcttatataagtgccacactcctaagtaaaaatgcccatctttgccgcttaaagagcaagtcctcttgaagttctggggcatgccccccttctttattaatttatttctgcttgagttaaagcagagaaggtctctttcccatgtgagaaagacttttgcattttgcctgcccaattgcttgggaattgttggttctcctgagtccatggattgatgtctctgattggctgtaaattattttcagttatgacttcttcccatgatacttcttccccattttctcccccttctccctcttgaactccaagtaaataaatgttagactctcccactgtatccaccgcatcgctctctctcttcctttttttgtgtctgtgtcgtattccagatagttttctgatattttgtggtttaattctctgttcagttgtatcttagcagctgttaaattcttccactgatttattaattttgattattacttttttcagttctagaattttaatttgtttctttttcaaatctgccaaatcctcttctcatagtttccaatttctttctaaaatttaagcctttgtttttaatgcctttgagtgctatacatatggttgtattacagtctgtagctggtaatttcagtattcgaaggcagcctctatttctgttgtttctactggctctcgcctgtgtggttacatgtgctcatgaatctggttatccttcacagctttggcttctgctgagtgtggggtgttgtctggtgactgacttattctgagtgcaaggcttgaggtgtcctagatgactcgttgctgcaaggcaggctgacagtccaccccagagctggttcacttgggattcaccctttcccagagttgtagcctttggggcacagatgaatctgggtggttcactacattctccacttttggtgtccctggcttttcctttagcctccttttacccttgaatctgttaaaataagaagctcagttttacaactttttctaccaaattagcaaatactcatgggtactcaatttacccaagtaggttctcagtttctagaatttggtcttccagtgcttactacattgataactctttgaggccttttaagaggatgttttaaactattcagtgttttgagttgtccttattgggcacgttggtcctaatttcttagtgtgccattactagaagtggaagttccccattctgactttgatacaagaagattggttgccctattatgtctgttgctgtttgtttgaggaagatacttttgtgacacctttttctgcccatttccctttttgatactcctttttcctatataagaactatatttatttgatttggaaaggggtaaatataatcatcttatcattcctcctggcagaggtagccgttgaggagtaaggcttttttgatgagtagaacactggtgatttgacagaaaagaataatacttctggccaatattttccattaatttttctgttaccatcttaaaagcatcagagtttaaggagataattttctatttcgacccttccattgaggtcactttttttacgaagtctaatctctgcaattatgacatcacattttattgtagagcaaagcattgtactttcagagggcaaatatcatttaagtgatagaactgatttttcccccaaaataaacacagctcaagaaaaagcagcaagaaaattaattggtatactaggagcaggaactgatctcctggtttgctaggtaaacatctgtttttagggtaatatcaggtgttcctctgagggaaatttgtactttaatacatgaatatattggttcaaagtaattatgaagaaaacagtgttccatgtgtgttgcgatcttattgtaaatgagtataaattttaaagggtaaaggatcgtagtaatcaagtcacacttgaaaattcttcacctggagacacctaatgattaatgtaaatgaggttggagaggaaagactatgagaggtgctatttgctgctgttgtattttccttagcagttttcccctttcacatctttggattccaaattcctgtctccaaagcatcaagctttctaatgattggcaaaaaccactcaaaatattaacatttgtattctgcttcttagaagaaacctttgaaatatgagagaaaaagaaattgaagatgactgcgcctatagatttattttattcatttgaaattttaccagcataaagtcaacttatagtgaacataattctctttcaaaaagtcttcatttgacgttaccctccaaagattgcttagattaatgggacgaaagttttgggtaaaagcttgggatacctgaaatttgcagctgtatacccctggctcttgatgtgagacttgacattgaaccttacaaagagggcaaccttaggtgatatcattggtcacaaatgcattacagaaaatgttttctcttagttaaattgatatatctagctcctaagttgattgattcaatacaattgaagactgaactataatggattttgagtattctatattttatttagtatttatatatataaatatgtaactatattttattgagtatttatagttattactgatatgaagtatgctttcacattcttttcattaatatggcctaaaagattactaaaaagtaatgcattgggactttgtgtggaactaataagtagataatctctatgattgtatccttgcttgaaaaattttacgatgttctgttcagatctatttgttatccattgtggatcacagatacaaaaagaatctggttgctaagcaactagattatatatgatggaactccttgaaagaacttaagtgttaactctttagaaattgagaggtgtctgagacatcgtgaatcccttacttttaaaagtagatatgcattatgctcggaaaagaactacagtgaaaaactgcctcaaaagtagacaaaaatgatctcagaactatttgaataactgctttccaatttagaaaattcagtcattaaaaaaaaattgaaataattgcactgaaaatgataggttagtgctttcttttaagattcccatctctaatgggtttattagccacctcttttctctagtcattgtgtcgttaccaagctcccaaaaccaagtatgtaatgacgcacttagtttccttctgcctttctcacaaaggggctgatctttcaggctttgtttgttttgtctttttttttcatttttttcctatcaagtttcgattttgtgaaatacagttgaacaatggttggaacattaacttgaaatgaaaagaatcataattggagttaattttttaaatcagtttatcagttctccaacaataactgatttcttttgtgcctgctgttttctgttcttcttgaaatgtcttatgttttcctggatggaccagtaatagcagatgcttctgtataggtagaggtgagagctcactatatttcttcatttgtgtatgctctctgtagccttaggggagtacggttgttttaaataaatggaaccttttggggagacagggagggtggatgtgtcttctgattttatgagtctcttttgtttctagagaatctttcgtttctgttgcttgctttttcttttcctcctttcaccatcaagcatccaggggaggtgaccctccaagttacctccctccctccgaagtggtgccctcccaagactttggtcctggcaacttttcagccccttctttcatttcctctgtagccaaggatcagacttgttctcagtatttccacacttagggtggtacactctttttgggggtgattttcatctgttccccaaccaggctctgctgcctgactctcttttctggaaaggtttctgctgctttcagacgttcatttttctccctatgcattaattgaagtttagagtatatttcgtgtcctggctatgctacaggcagggctggcttcataggcatgccaccaacgcggctgcacagggccctattctcagaagggcctctcacctggggtttaatgcttggcagtcactgtcttaaaatccttaataatttagtatttgaatttgtgttttgtaagtgaagtctgatgggacaatggagcatgtgccaggaccttgaagccttggctcacacatgagcctgcctccccttccccagcaacacttactcctcacctccccagccccgaactcccctggctgaattctcagccacctgcctccgtgtctgccttgcagccactgaggtcctctggctgaggcagcaacctggctgcattgcaggcggaggtcagtgctctgtcctagccttccacacccaccagggacctggaggcatgtgtgggaaggttgaggttcctggttgacagtgtcatggtacattcagccagcaactcagtggggcctctcgtctactacagatccgggtacggggtgtgtcctggcacagaggtttcgattccttggaagctgccagttcactgtggtttgggtggactctgggaaggggaaattgatttctctgccctgggctggagccctcattttcatcttggagtaagccctgccaactgtgtagtgtgccctggctgtagaagtgagttttgggtggttttatttgctctcgtggttgatttatatggttttggagagattcgaatttaggcagttgtcattatctcatgggaaactggaagttccttatttcttttaatttgcttttatcaaacttttttccaaactgtaaaagcaatttgtatttttttgcaacaaaacaaacaatatgcgggtatacaaagaaaaagtcaacattctatttccactccctctcaaagtgaccagtgtttacattgggtacgtatatgaggtcttcccacacttttattcacaatcatatcatacacacacgcatgctcacacacatttatatgtgcaaatctacatatacacaagccatgtgggggatttgagggtgtggtaaaaatgcttatatcttgataacctgaaagtccctctacttcagtgcatctgaatccagctcattctttttaagaaaacataatattctatatccatagatttgccattattcagtcacgcatcttgtaatgatgaacatttaggttgtttccagttttttagtgctatgatcatgccactgtgctacagcctaggtgacagagggagaccttggctctaaaaaaatgaggaagagaaactaaataaataacttctatggtgtgtcctgggctctgtacagatttattctattctgtaccttatttctgtattcagacatcaacatcactggtgtttagaatgataataatgaggtactgcaaagttatttataatatactaaacttgtaaggcatgaagagccaactattacattttaggaaaaaatctcaaaccaaaaaagagttgaagcatatagattttctgaataatcttcatttgactaaaaatttactttaccagaatgctttttcttgattattttgtttaactggtattttgcttagctctgttattcaatttatttaagaataatttattaaatccctactaggttccaggcatttttccaggtgctagggtaatagcagtgaattgaatggtagtgatcgtacatagaatatgatgtcaatcacaaaaaagtagatatatctaataaactaacatagaagataagatatattagacatttcagaaatacttagtacatccaaaagaaaacagaaaaaggggaatggggggaactaagaacagagaagagaagtacaaaacaaaaagcaagatgatagatttaaacccaaccacatcaatagttgtattaaatgtaagtagtccaagtatctgaattaaaaggcagagattatcagatgggataaaagaaaagtcaagagccaactatatgctgtcaacaagacatccacttttaatataaagacacagaaagcttaaaagtatagaaaaggatgcaccagcctagtactaaccaaaagaaaacagaagtggctattttcattaatattaaacaaaatgaattttagaactaagaatattaccagtgataagtattatcattttataatttaaaaagaggccagtgagtcaagaggacataataatactaaaatattatgcatctaataatagggcttcaaaatatgtaaacactgatagaactggaaggagaaataaataaataaaccaacatttatagccagagttctcaacacccttttcttttttaaaaaatttaatttaatttaattttaagttctgggatacgtgtgcaggatatgcaggtttgttacatatgtaaacatgtgccatggtggtttgctgcacctatcaacccatcccctagttattaagcccggcatgcattagctatttatcctgatgctctccctcccccatccccaaccctgacaggccccagtgtgtattgttcccctccctgtgtccatgtgctctcactgttcggctacatgcaacactcttttcttaatagcaatttggggaaaaatattcagggcaaaagaaaagtgcaaggatcctgaggtcagaaagagcttgagtgtttagaggaacccagagcagccgggtgcagtggctcacacctgtaatcccagcactttgggaggctgaggccggcagatcacctgaggtcaggagttcaagaccagcctggccaacatggtgacaccccgtctccactaaaagtacaaaaattagctgggcatggtggcaggtacctgtaatcccagctactcaggaggctgaggcaggagaattgcttgaactggggaggcggaggttgtagtgagccgagattgcatcactgcacatcagcctgggtgacaaaagcgagactccatctcaaaaaaaaaaaaaaaaaaaaaggaacccagagcagaccagtgtgtttagagcagagtgaactgatggagcatggtccattgtagaccagggagataggcaggggcaggggctagattgcataagaccttgtgaaccattgtaaggagtttgcaaaagcactaaacatgtttgcttcatactgtggctttgatttaatatttaatcattagctgtatcttagaatttctccacagcctaaaactgaaaacagtaggtgacaaagaaccccacactttaaaaaacaggctggacctgataggataccatcaggaaacagatatgtattcctcccatcccttctttcaaacctgttctgtcagatctgcatctctgaattgtatctcagggatctatcacagcttttgagtcttattttcagttattaaaaagttcagtctgatcttaatcaaaactcccatctcccattattcagttcagtgctcctacgcttccttcagctcagcactgcccttgtcttggaaattgcaacagggaagagctagctgtgtggtctttgtctcagctccctggcttttcctcctcctgtacagactgttggttcctcagggtctgggcaggggcagtgagaggcaaaaagggagaaattggttttctgagggtcttctaactctctctctttaggtactgaataccttctctcatggaatactttggtggttatttttctgttccctgcctccaacacacacacacacacagacacacacacacacacacacccccgccccccccccacacacacacacgaatgtttctgcctcttgacaggggactgtgctctccagctgacctgtttgcataccctcctctcctggttcctgctttttgggtacagctccagcctcttcctgctaaaatcccctcactccggtggcagtcagccctcctgggtagggtcccttccaggtagttcaagtctgctcctgtcttctaaagacattgtccacttggcccatagaacaggttacaaacctttgccccacaagagattggaatgtaagcttctctcgctatcttcttgccctctcccttcaagggcagctccaggcagctcccatctctgtggtacatgccccaactctcctaaaaacccttctgcaccttctctggtggcaacttgtggaggcctaggagtttctttccacaacccagcaagagttctgcctgggaggccagcctctcctccagcaagcacattgctcccttgggtaagttcccttgctactgccctcacttggaaggggaatttcctccccacttctctactctaagaaggagggggaactctgcagcaatccctactaagccaacaactctttcaaaagtccccttcacccagcaagtccccagctttctcttaaagacactgaagatgggaggtgagctcagggtggtgggggtatgtttcccacatcctggcaagttctttctagatgagtctctatagtgtgggatctttatttcagctttcagccatttaatatcctgtttcctgtggaaaaaagtttgactatagaaataaagctatcagccgggcgtgttggctcacctctgtaatcccagcagtttgggaggccgaggtgggtggatcatctgaggtcaggagatcgagaccagcctggccaacatggtgaaaccccatctctactaaaaatacaaaaagattaggtggccatggtggcccatgcctataatcccagctacttgggaggctgaggcaggagaatcgcttgaactcgggagttgcagtgagcaaacatcacgccattgtgctccagcctgggcaacaagagcaaaactccatcacaaaaaaaaaaaaaaaagaaaaaaaagaaaaaaaaaagaaagaaagctatcacacttaattgtactgatgaaataaaaaacaccagctaatttggtcattcaggattcttttgaaaagctctcatatggcagtagaaatttaagactgcaccattaaacatatttttcagaaatcagttcatcagtttaccatttggttgggaaaggaggaggccttttcctgtaaggagcattttaaaagtgacatttaaaaattagctaccacgtatgcaaatacttctgaaaacttttatgtcaaatttaatgatttgatcaattaggaaatagcaaatatatccatagacatcagttgcatagacttgaatttcacaattaaaaagtgagtatatccttgggtattttactgataattttcactgtggctcattttttttttttttttttttttggagacagagtctcactctgttgcccaggctggagtgcaatggtgcaatctcagctcattgcaacctctgcctcccgggttcagtcaattctcacgcctcagccacctgagtagctgggattgcaggcatgtaccaccacacccagctaatttttgtatttttattaatagtagagatggagtttcaccatgttggccaggctggtcttgaactcctagcctcaagtgatccacctgtctcagccacccaaagtgctaggattaccacacctggccactgtggctcacttcttaattgttgggccattttccccaagtaccctgtttctttatcagaaaagtgatgaaaatatagaattatgatgactgttctaataccggctgaagatggaagaacaaattgggaacgattgatcaagaccacacttcagatctgtgagactgtgcataaagtctgcctgaaagctggttgcattctgttgcttttaaatgtctggaaataaaaatggtctggtatctttaaaaagtttagaaaaagtccagtggcttagaaaaatgccagaagccattctgtcagaattctctagaggaggtagtaaaaccagcctgcagttttttattaaaggaactcaccatatgatatatacagatgtgatggtgaggaatgtcacctccacagagacaggagaagacagtcacaaggagcagctctaatcccttaggatctgcatgaagcccagggtttttgagaggtggaagttaaagggttaagtatttctgtttaatgtagaccaaggttaaccaagatgaaattaaacattgcttgacagcagttgaagattggcaagactatggcaactacacttctctacattttactctcaattatgccattttgtttctaattaatcactagcattttaacaaaatgatgtaattgatagctagcaaccagactgtcagtcttctccccacatcagaaggtatctatccatctattcagctattgccagacacaccttgtgcctcatggcagctacctagattgccggccagagggcctgctctccacactagacctgtgaagtactagaaggttcctaagaggattccagtaatgacccttctaaggctgtcagtggaaggaggattgtcctgatgtgcttctaaatcccaatggttgccgggccttactcctgacttttagaaggctaccccagctgtgcctgcagcagcaaagggattttccatgtgtggattcagagaagtgccttgcgttcacagggaaactgtttttattcttgtgtaacatttgaggccatccctctgtaggttgctgacagcctcctgttttccatttttcctctctgcagctttctccagggtaaaataaattgggcttcaatttttgtacataatttttttaatgaggatactaagacttaaaaatagtagcaggaaacataagcctttattcactttacaaagcataaatagtaacagtatacttcatatgtacagtgtgaccagttaaaatggaaagatcctgcgtatgggaacaggggtggcactagtgagtgtgcctggtaaaaaaaaaacagggcaaaaaggcagaaaatggagagaagcaggggacagactgaatgattagctcacagagaaaaaggaagagagaagagcctctttatgcttcttctgacatgtcctctagtactaaagtggtcatgggttagctttatccacagtctccctgtgtggctatcaagcataatcagtattgtttttcaagaatagaaccaagaaaggaaaacaaatgtccctctcgctttgtacccctactgaaatattgaagaactaatttgctggagacaaaatgctggtgtagaaagtgacaggcctgattacatactgctgtcacaaaaattgatttccatactttatagttgtaccttattatcaggtgcatatattgcatgtctgcatttaacatttgtgcacaaaataaacttctttgattgcatttgacttggcaccttgattatctttcttgttgcataccggaattggttgtgcctctgattttctacttctgtctttagtgcacttgtaatatgccagtgtctggaaaccattatgacaggtcctaccaaggatgccagctggacttgaaggagacacttgttttctctcctaaagtctattctgtgaaccacatgacctgaagatctgctttgtttaggactgggagcctgctctttccacttaagcactctcaactggtttcacaaggctgagtacgcatcagattttcacttcacttgacctgtgacataatatcctcaactgaggactccttccttttttctgatgtaatagtaatttttaaaatgctttcctggaaactgattgaaatgggcattgttgccacttcatagaaatacactgaatgttgactctaaggcttacatatgctttggagacagtgttataaggtttcaccaaaatagaaggaagatggaaaaagaaaaatgatcagtggatcatacagaggccaccaaggagagtatttgagagatcagggcaactagaataacagagatgacagtttagggcagaatacatttttgtaagagaataggaaatgttttgtctttaatgaattaagatcaatgcgaacttttattccaatgctgatcttgcagcaggttaaataacatatcctgatgttgcagggcactttctcagaatgcagttaagtaaataaagccttgtttcttggatcatatcgaagtaaataaatgtttttattctttagtactaagagctttatgttgaataccatgtttctgatatgccgttatagaatctgataagtactttttcacagagaatgaagttgatttttctctactgaaaaatgaaattacaggaacccatcctcctgtttccttcccctacccatcaaaataggaggatttgaaaacatggtaattatctcatgtgatttggtttattaaggttaaagacgtcttatcaggttattgctaaaggtttccaagaccccttgcccaactgatgtcggaggacctggtatttggtgctatgtggagtaactatacagctaatttcctaatggaggttattgttattaattcaatttatttttatagcaagtttattgagaaataatttaccaccatacagttcacccctttaaagcatacaacttttagtatactcttagaagttgtgcaaccatcaccataatcaattttagaacattcttaccattcccaagagaaagcctctacattagcagtcactacccattttctctcattagcagccccagccccagaaaaacacaaacctactttctatctctataatttgcctattctggacatttcatatgaaatgaactcatgcagtacgtgcgtcttttgtgtctggcttctttcatttagcgtagtgttttaaaggttcatccatgttgtagcaggtatcagtaattcatccttcttatttctgaattattttccatttaatggacatacctcattttatttatccacatttgggatattttcaagtttcaactattatgaataatgttaatatgaacaatcatgtacaacttatgtggacagatgttttcatttctttcaggtatgtacctaggggtgaaattgctgggtcatatggtaactctgtgtttagctgtttgaggaactgcctgttttgcaaaacagttgtaccattttatattcccatcaacaatatatgagagttccagtatcttcacatttttgccaacacttgttattatctgccttttttataatagtggggacaattttcagaatgaaagtgagcccttattaattatcccaggcatggcatgaaccagtaatcaaatatcctgagctagtcaggatatttgattcttctagaacttttgggaatgaggcctactcagtagcaaaaagtagggggtgatttgggggcagtggagctaagtgccagtaagtagtggttgttggatatagtcaacaaagaggacatatccaattttattataatatcctgtgggtagatattactgtttcaaaggatcaagcacatatttatctggaaaggaatcaagtctttaaaatcatttttacaggagcaattatgttattattcttaatagtaagatgcaataggagatcagctttgttcaataggtaaaataactacccaggtgaaccatagccattttgtccaaaattgattcccagaggcaaatttgtagcaggtaatttaactactcttactttattcccagggacattctttttacattgaagtgcatctctttcctaggcctcaactgagctgcttgtgcagggtactagatgttcaggttttacaaatatttgccatcttattctgtctttttacactgttattgacacactgatggtgtccttgtaagatgttttgagtgggagtctctagccctccaccctagcactgtggcaggtaactcatctggctagcagtagctcatggtactcttatgggatggttggggcgatgctatactgtaaatatcagctaacccagaaaccaagacatcacagacaatcagtggtggtgttggcacaataaatacctgctggactttaatactcataaaatgtatcctttctagatctggtgtgttggcttttctttattgatggaaattatacatcaaaatgtttccctttcttatttgctgtcagaaagcttagagctgattttttattgttcagccacaatcgctagttcatcagtgtctttagtataacaatttctgtgctctttccaatgtttgtttaaattgttttttttaactgtcctaatcttatgagttttctttaacattgttagccacctttgaattatttttaaaggttggagtataaataatttttaaaactcccatccataaaagataactatcttttctctccagaactataagtctcttggaaatttgatttgatttaggtaattggccctactacatagtaccttccctctctgggctcttgaccatctggggttatcctatgtttgtcatgctagggaagcgtaagaatgttctttgggtattctttcagaattaaataagaaaaggcaaaatgtttgataaacagacatttatttcaatattaaatatccttcatataaaatgggctgaagtctaaattgcacgttcttcaagttgtccttgatcaagatgtgtagatgcagaatagttccttcatttccacatcttttctagtgagcaggtgagagtactttctctgaaactgaagagagaagtgtcctgatcctaaaacctttcagagagctgcctgactgcgctgctcaggaaaaaaggggtgctcaccctagcatgatagggatggccaagtgccttggggcacccagctgttcagcggcattgtggtgaaagggaagtacagtcgatcctcattttttgcacattctgtatttgagaatttacctacttgctaatgtttgtttatgtctaatcccaacatcaatacttgcaggacttttgtggtcatttgtggatatgtgaaagtggtaaaaaaaatttgaatcctcctatgtgaatgttcccagctgagatcgaacaaggggatgttctgccttcctattttagctctaatactataaatgtgtccttttctcacacatggctcagaaatgtgccaagtttttcacattttttgtgctcttcattggtgatttcatggcttaaaatggccccccagccatagtgctgaagcgctgtctattcctaggggaaagaaggctgtgatgtgccttttgaagaaagcacatgtgttagacgagcttcattcaggcatgagtcatggtgctgttgtccatgagtcccatggtggttaatcagcactatatatatttaatgtggcatctttaaacagaaaccaacatagagcacagttaagtattgatcagttgaagagaatacctcctgtgaccagaggctcacaggaatctaaccctgtatttctcctaggagcaatgattcaatatttatgaattcagtgtttggggtgacttgataaaacataactaccttgcataaagagaatcaactgtatgtctttttctgctcttataattcttcatgttggtgggcccctgccttcagccccaaagaatgcagcatggggcttattatttcttgaatctgtttttttttttctggagaatttcattcaacaaattatgaatattattaggtgttgaactgagcttttgaaaacttgtcagattcatcttcaagatttttgttccaaacatccaaatttatatactcattgtgagtttttggatgttaacaatagaatttgattcattctatatcctttgagcccacatgatgcatttccctgtgttaaggcttatttgttgctcagttgagtgactcattcaccacttcttacttcctggaggtttagtaccactcttaaaaatagcaagaggccaggcatggtggctcacgcctgtaatcccagcactttgggaggccaaggtgggtggatcaagaggtcaggagatcaagaccatcctggctaaggcggggaaaccccatctctactaaaaataaaaaaaaattagccatgtatggtggcgggcacctgtaataccagctactaaggaggctgaggcaggagaattgcttgaacctgggaggcggaggtcgcagtaagccaagatggtgccactgcactccagcctgggtgacagagcgagactccatctcaaaaaaaaaaaaaaaagggtggaaaacattgcattgcacaatgggttgaagtgagaggtctgccttattttggggtttgtagctccctccctgtgctggaagggggctgttgtgagtgccccacccttgcagatgtcagcaggaaccagtttctcttccagagctgaagctccagcgtgctgcctggcttgaagctgctgccctctgtcccaactctcaccagctctcttgggttgttccctgctcttgatcctaatcagtgcgtgtttctcacaagcctcttcagtcatcatgttgacccaatccccagacaatgggtagtaattaagtcaactttcataaggttatggtatgcgaagtgattacaagagattgcttacaagagcagttagaataaagagttcaggtgagggcagtgtctttagtgagccaataagttgtctataagttgattgggaaattgtttagtctgagattacaataagatgttttctgaagcacataccaatgaacagattccttgaagagatttccttacagaacagtttgcattttcatgttgaaaattagcttagtgattatcttcatttaacaggttaaaaaaaaaaaagaaaaccaaacctgatgaaagggtgacttggtatcaggaatggggaggtgatttggtgaagggatagtgactaccactgaccactaaaatagcttcatttgtttttgtattctcagtgtctcatttcctcccatgttcctcttttttattttatcattattttgttttaaatttttaatttttgtgggtatatggtaggtatatatatatttatggagtacatgagatattttgatacaggcgtacaatgcataataatcacatcggggtaaatgggggtatccatcacttcctttatgtcacaaacaacccaattatgttcttttagttatttttaaatgtaaatacactgttgttgactataatcaccctgttgtgctatcaaatactggagcttattcattttattttactatatttttgtactaattaaccatccccagttcctgccccacccccccactactcttccaagcttctgataaccatcatcctactctctgtctctatgaattcaattgatttaatttttagctcccacaaataagtgagaacatgtgatgtttgtctttcagtgcttggcttatttcacttaacataatgacttccagttccatccatgttgttgcaaatgacaggctctcattcctttttacagatgaatagtacttcattatgtacttcagtagtattcctaactatccatcaacagatgattggataaagaaaatgtggtaactctcttctaactatctcctaactatccatcaacagatgattggataaagaaatgtggtaacattttctttatccaatcatctgttgatggatagttaggtcatttccaaatcttagctcttgtgaatagtgctataataaacatggcagtgcagctatcttttcaatatactgatttcctttcttttgggtatatacccagcagtgggattgctggatcatatggtagctctatttttagttttttgagaaacctccaaactgtccttcatagtggttgtactgtaataatttacattcccaccaacagtgtacgagggttccctttccgccacatcctcgccagcatttgttgttgcctgtcttttggattaaagccattttaactggggtgagatgatatctcattgtagttttcatttgcatttctctggtgatcaatgatgttgagcatctttttatatacctgtttgccatttgtatttcttttttgagaactgtctattcaggtcttttgcccattttaaatgggattattagatttttcctatagagttgtttgagctccttatatattttggttattacgctcttgtcagatggttagtttgcaaatattttctcccattccgtgggttgtctcttcactttgttgattgtttcctttgctgtgcagaagctttttaacttgatatgatcccatttatccattcttgctttgttgcctgtgcttgtggggtattactcaagaaatctttgcccagtccaatgttctggagagtttccccagtgttttcttttaacggtttcatagtttgaggtcttagatttaagcctttaatccattttgatttgatttttgtatatggtgagagatagggttctagttccattcttctgtatatggatatccagttttcctagcacccattaaagagattgtcctttcttcaatatatattcttggcacctttgttgaaaatgagtttactgtagatgtatggatttatttttgggttctctattctgttccattgctctatgtgtccgtttttatgccagtaccatgctgttttggttactatagctctggagtatgatctgaagtcaggtaatgggattcctccagttttgttctttttgttcaggataactttggctattctgggtcttttgtgattccacttaaattttaggatttttttctctatttctgtgaagaatgttgttggtattttgctagggattgcattgaatctgtagattgctttgggtagtatggacgtcttaacagtattaattcttataatccatggacatggaatatcttttcaattcttagtatcctcttcaatttctttcatcagtgttttacagttttaattgtagagatctttcacttattttgttaattcctatgtattttatttgtagctattttaaatgggattactttttgatttttacactgtccactgtttgcatacagaaatgctactgatttttgtacgttgattttgtatcctgtaactttactgaatatgtttatccattctaatagttttttggtgaaatctttaggtttttccaagtataagaccatatcatctgcaaacaagaataatttgactacttccttttcaatttggatgccttttatttctttctcttgtctggttgctctagctggtaattccccatattccctcttaccgttcacttctgcctctgctttgtgcccttagcactggagctacatcttaagaggtggggtgacatgttgatggtatttggctgagggaccctgaagcttctggatcttgcttgtaattgtccactctgttcaacaagatacctagggggcatgtgtgcacagaagatagtgatttttccgggctcttgttattaaaccttggccccacactcttaatatggaacactgctttggcagaaggaagagctaaccagagataccacttccttctgggaagaagcagcagggctgggagaatcctagcccagactttctctggaagctgctccagctcctgaccaggcttatcttaccagccgggtgggagttaggaggactccggagtcacacagaaagccaaaaatctcctgaaaacaataccctttccagtgtagatcctaggctcacccctcattgttcactcaggaattaaggcagctctgggggtaaccccatttatggaatccatgcaatgatggcattgtgggggacactggctaagctcccaaggggatgtgctataactgcatcgcagtggctaggccccacccttctcatgcctcttcccaggtcactatggtgatgagtcactaatatcaagaagtaaagaagaatggcagtttataaaagaccataagatctccctattccaggatcaatggtacatatggttccttttctttcttctttgtcttacttgtcctttaaaacctccatttgagagctgcctcttccagaaagccttccttgaccacctccagctgaagtctggtttggagctatcttctctgagctactacttgccaccctggaaggctgtggctggtacgtgatcttgagaaagtagttccctagctttgtgggagtggaatctagatgacaaatggttaaggagttggggataggggtgtagatgggacagccaaggctgatacctttcaaatttcaggttgaactgtggaatgaagaaggtagtgactgaaggtcactggggaagtttatttatttgttttttgatgtgaagaacttttttttaaggcagagaagaggagtattggaaacattagtaaaatagggaataatcaacaggtcatggcccaggaggaggccagaagaagtggaatcaataacagatggaaggaagtgaaagggaagacacagagggagctctggctggacatccccaaagttgttcaacaatgggagccactgtttcttgaaagttgactagatgctggatagtccttatacattctcatctgatttccacagcagccacttcacattctacggatgagaaaaccgaggcttataacaggttcttcaggtggtacatgttggggagggatgtgaatgtagtcagtgcaacttgcagaatctgctctaccagagtcttacttctcaaagtgtggtcctcggaacagtaccacctgggagcccattagaaatgtcaactctcagccacatcctcagaccaactgaaacagacctgcgatgtttacatatgtttaggtctggaaaccctggtctaaacttctgccccttgttctccttgaagtgttagatgttggcttggctccctgcttagggtaaggttattggagcatgccgagggcagaggcttgagggtagaggggaacagcaaatcatgggaatgtgatggaatgtattaagagagagcttctagaaggttatgatatctattagttcacaggttatggctaaactggtaatgacttcatttaagttgatatcattgtactttgcagagagaacagccaagtaaccttggttgactctggttgttctaatattcttagctatccattctcttgggagggtcaaaccacagctggctgatctgttatcaaaggatttgtggtgcctcgaacatgtcctgttatttcacaatcagtgccctttgtacatatggttccttttatttcttctttgtctgacttgtcctttaaaacctccatttgagagctgcctcttccagaaagccttccttgaccacctccagctgcagtctggtttggagctatcttctctgagctactgcttgccaccctggaaggctgtggctggtatgtgatctttaaaggacttagcatggtacctggcacatagtaagtgctcaataagcactagcttctattattagcccagaagtaggaataaaaacagttaagagtagaacacatggttcagagggcagcatagtataaagggggcaaaaataaccgaaggtcctagcaagagccatatggaagtggtcaactaggaggtttctgtgctgggaagggagggtgagaaggcaagagagaggcagtagaaagttcattattttttaatgtatttttattgtgtatatttaaggagagaaagtgatgttttgatatacctatgcatagaatgattttgaatgggcctaattgctacgacgtcagttacaagacggaggagaaagaagacaagacatgaatttaaagaaacttgcttatccaaatcattcttcttttaagaaagctttgtattcattatagctgattataagagttaggacaaatttatgatgtggcagacttgtgttttagcttattagtgtgtctctgtgctgcactgaagcccttgtcatcactgcagtgtacgtagctcccatttatgtactttctatagaatctgaagcctaattttaacattgtatcgttttttatagttattgacactttgcttctatcctatcaattctatctgtaatttatttcaaatcaatttcttgaacaggcaggtaatagcctattatattatttttcctatgggaaaatatgatcgtttattaatttggttttttaaaatttactaaacatctattacccagaaagcactatagaaaatgcttttgagagatgcagttatgaactagcaatcgcccttgtccttcaggaagctgacaggctaggaggggagatatgataggtagagatgactttaaacacaacaatgtgagatgctgtaagagaggcagggtagtacacttactgaggaagaataacttgcttttgcctggggacaggagtacaggataaaagctttgaggcaaaggcagtggttcaacttgaccttgagattttgtctgggtttgacaggaagaaatagggcaaaagccatttgaggtggacaaaatagtatataaaaaataaagtttgatttttattaacacaatggtgaaaagagagaacttccaggtagttccatctgttttttttttatttattttttattttttatttttttttgagatggagtttcattcttgttgcccaggctggagtgcaatggcatgatctttgctcactgcaacctccgcctcttgagttcaagcaattctcctgcctcagcctcccgagtagctaggattacagacatgcgccactatgcccggctaattttgtatttttagtagagacaaagtttctccatgttggtcaggctggtctcgaactcccgacctcaggtgatctgcctgcctcggcctcccaacgtgatgggattacaggcgtgaaccatcttgcccagctagttctatctttagactaaaatttaagtatctataaaaaggaggaactgctgtttaatgaatgcaaatgtttaggtacatatatattatctcaattaatcctcaaaaaatccctatgaggtagggaggtattattatttgcattatagaggtaaataagctgaggttcaggaagttaatcattttgctcaaggccacacaggtcatctgcggcagggctggaaatccaacacagatctatctgattccaaagctttccactgcttcctgctgccttcctgcggacccattcataagactgacatattcattcattccactgacatattcattcattccacaagtagttattgagcatctgacatgtcccaggtgctatgctagctcctggacatgcagtgatggccaacctggcctagctacatgtgggggacaaatggaggcacaaatagtaccttggtattctgagacctacagatttccaattaagtataaatttagaagattaatgtgctttattgatctcatcaaatagcctattgataaccctcctcaaataactagtaaaggcacagtgttcactgaggaaaaacagatgggaaaatacaggatatttcaatgtcatagttggaaaatttacaacttaactattttattaaaatgtcagtactttggaattttagcagttgtagacctgagagcccgagaggagactgcacccatgccatgcaaattgtcataaaagttttagataaaagttcatatatacgtttcagagagagaaaaagagaaagagaaagagattttgttgacagccagatgaaattaagtggtcagaaatttaatccactggcccactaaaagaaatattttcaagatactgagaaatgcaaaaaaaatgtaaaaaccaagcataatatcaccactttacaccacatagtatcacacacacacactagttgagtacagtggtgcccacctgtagtcccagctacttgggaggctgaagcaggaggatcacctgagttcaggatttgtgaccagcctggacaaaatagtgagaccccatctttttttaaaaaagaaaaaatatatatactgtatatgtaaagtccttccccttgatcactactcctccagccccaccctagaggtaaccactgttaacaatgtggagtttaccctttctgaatttgttactcatagtgacaaatctgtttaggtttgcccatacaatctttcttttctttccttcccaaaaagaggaccacttaaaaaattcttatttttctgccattatccctttggtctcattaattaatttatttttgtcttttaagagaacagttttaaattgcttcttgtgagggtgcaacacaccagtaggattatcagcaaagtgtagacaaggctatgaatgtggatctgatgcttgggagaagagaattatcttgtgactcaactaaaatacaaccaaagactcaagaagttatggatttgctcttaattgctttaattgctgcacaattctccttagttactctgtgaacttgtaagaatccacccacagtaaaagtcgaatttgacaagttgtgagaaattgttatgaggattacagttctttgtgtcccacgtgcaaagtgcttccaagatatttctttaaatgttgaatttcatttaaatatctcaaatgaagaaaaagatatctaaccgcatgaggttggaaagcttaaaagtaattgttatcctatcctacagacacaccaaagggtacttaaagatgatatgaagtgggatataaatatctatactgttgtgctctgaactaaagcaagtagtatatatttgttatcctttatactgaattaattatgtaaaaaataaagttcaaaatatgagtgtagttcctgtgtgacgaattgcctgaattactcaagtgattgtctcaaacctctatgtcatttgtttgtagagttctttagaagaacttagtacaattatctgaaagtgtctctaaggtatgacacttctgtgtgcattattgtactcagcatttaaaacatggcattgcactgatgtccttcctgtttcttaaaataagccaagtcttttctggcctcagggcctttgcgcctgctgttccctctgctgggttgctgacgctcttctctgtatgaggaggcagaatcactcctcatccttcagggcttggctcagctcaaaggcctctacctcagagaccctcccaggatcacctcatccagagtgtcttctccctccaatcacttcctattatctgatttattttcttcatgccacttgtcataatctgtcattctcatgtttgtttgcttactttttgagttaggcctctgccttggcacccagtggagtcttcaataaatacctggtgaatgaataaagagctttattagttattcttttcctcattcgttcatgccttcatttatctgttcagcatcagacacaatattgagtgtctaatgtgtctaactcacagtgctggactcagtagtagtgattgcagtggaattttcaggtaattaatgcttagcccttcagataccaacatttacttaaaagtaaatattggctataaataagtaaaggataaaattgtaaaatactggatgagagtattccttaaatacattacagcacatctcagatagaagctctagtattgatatggtgtggtcctcactgtgaagtgtccttacagtgaatttttaaaatttacattttggtttttctgtgagcccagagggatgccacttcctttaccgtaactctgactagttgctccaacaatggccccttcctgcctctagacacaggggtgctggtcactgatctcctgggtcaaaagcaggataagacagttgctttcacggtggttgttctcaccatgaaccttgacattccagttttcccacagcatgtgaaggccttaagttgttcagatataaccttgattctccaaggggtgctgtggtagaacgcagaaggagatttttggaaaattgcatctatagagttaaatactatgaatgtttcttatcttgtcataaaatcacctgcatacattctttttataaagccatctttgtaagatgagatttatattaatgtaatatgttagtgctcagatggcctttagcaaaggattttaggaaacacctattatctatgactggggttgtcagaatgcaaaaattcaaatcatcttccacataggaaactcttttctgggttctgtgtttgtgcttattatttcggtgtttcccttttaactgttttcagaaggcatcttctgacagtggcaacatcaaactgcaaaatatcataggcttatttggtggggattttacttctggatttgttcctcttgacatgaaaaacatatattctctgcttcacatcaaaaatgtaggcttacttttaagtagctatatttttaaaatctgtgtcctgtttttgatctagtttttattatatcttgcattttacctgccatttctcttctttctcttttgttcattttacaggaaatgggagatcagagatgctcagattttttcagcgtagtttcccctaacatcacagctctctcctgtctcttttattcacagtgagacactaaagacttcccagtgagcaaatttttcacataggtgaaacttactccattaaccgctaaaactttgaagaatgattattttaatcactctggaaatacatttcacagttccttcatttgcaaagtaaactatgcataagatgtacatagaatgtatgcctatctttcacagagtcagagccagcctagtgagctttcacttttgtccatggtttggaggctgttgagctaatcagagctgttttcctgggcaccaaatgctcttatgtcttgcctctgcctaccactctcagctgccatttcctgggaccatcgctgggtctttataattctcatgttttccttattgtaatgacagctggccgagttcacgttcaagtttacctccacctcttctataggtaaacgtctcccagcttcagtactctagagccactgtcttgcagttccatgctcctgttaggttctggtaggtaggaacctgacttctggctaaagggaataggggatgtaatactaagttgtcattacaaatcccttaggccttactgatagccttgctcaggatatccattttagtttttcaactactgtgttctcatgagatggaaatcataaagccaagtgtctttgaagaattgtacttgagattcagaacaagactccatgttattttttaaagagagatacttcttttcttttttttgagacggagtctcactctgtcgccctggctggagtgcagtggcgcgatcttgtctcattgcaagctctgcctcccgggttcatgccattctcctgtctcagcctcccgagtagctgggactacaggcacctgccaccacgcccggctaattttttgtgtttttagtagagacggggtttcactgtgttagccaggatggtctcgatctcctgacctcgtgattcccaaagtgctgggattacaggcatgacccaccgcgccaggcccaaagagagataccttttttcaagtttttgagtggctagttttgcatattaatgctaacactgaaaatagtacaacatcaattttttacgctttttatctttttcttgacaaatactagtttaagttgctatttcaaactagttcattcagggtatgaaatatacaatggggaaactttgagactcatgttacttcctgttgttagagtgcttgatttagtgctttaattactatacactactgaaacaaagtgaatatacaccaccttaggaaatcacttgttattttcttgaactgttttgtttcatctacaattacatctttatatcacatttcacaaaatactggtgattatgtggtgttctaatgagtgtgtatagataataaaactaagaaaatggagtttagatttagtggggctaccacctaaaaattaaacttgcttagttccaaatttccaattctttgatgatttgtattgtaaacaggatagtttttttattacatttacagaacatgggcatgacttgaacaaaagttgctattcttaagtaaattacttttattttatgctgtatcttgccttcttgatgttctagatggtatgtccttttagtcccactagagtctataatgctactgtagttcccagcttccagttgtcatctgtgtggtgatgccataagcattggaaagtgcactgtccttatagccagaaagcactggttccttcaccctttagctgtggctctcctccccgtcaatcctctttttttaaaagccaacgcttattgaggacttcaggttatatgctgtgtgtcacgtgttttctagatgttccttcttttaattatcacaagaagcctatgatgcaggtattagtatccacattttacaaatatgcagactcaggcccagagaggttgaataactccaaggttatccagctggttagtgacaaaggtggggtctgaatacaggtcttacttccaaagtctgcacttgaattacctcctgtaccacctgtgctacctctgtgcctctctgaaccaactttgggttttctggaagtgagagtgacaatctcagtctcatggggttgtccaggggcacaagtgaggcgagggaggcagagcatccttgtcttatgctgcacttgagcaatataggtagtccagcctagacagtcatcttcttttcattgcatgcctttccctatttctggattatagatagcagtgtctcccacctgggccagctttatcctgacgcccagcatacaccccacctctgggttggtgtgcattgaggaagtgcaaataaagtggaatatgcctcattaagcaggaaagtagtcatgaggaaaggcatgcacttgagagccgtacctgggctctttatcttctgacagataggatcattcccaaggtcatgagagtgcaggggattgggtgccaaccaggacactgaagagctcccggagcctgtgcatggtgtctagcccttctgtcttcaggcagtcacgtgcaagccctcccctggaaggattgtcagaccacacctgtgccactgctgctgtctcctccctgtcctcctgcaggagggtgtgtgtgtgtgttttaaatttccaatttactatggaccaagacccttgaaaaatacaatgaaaacaaatttctggaaaaatagtttttaaaaaggcattcaaaatgtaagcatagtattttattagaagattcaacagcaagaaaataacattgcaaaaatgacctggcaatgccaaattgctggaagtttctaagcacttattgtcagtttttttcctaatctctttactgttgggtagcagttcacagactggccaggcgcggtggctcacgcctgtaatcccagcactttgggagtccaaggcgggtggatcacaaggtcaggaatttgagaccagcctgaccaacatggtgaaaccccgtctctactgaaaatacaaaaaaaattagctgggtgtggtggcacatgcctgtaatcccagctactcaggaggctgaggcaggagaatcgcttgaaccggggaggtggaggttgcagtgagctaagatcgcgccactgcactccagcctgggtgacagagagagactctgtctcaaaaacaaacaaacaaacaaagaaacaaaaaacagttcacagaccaccaccagtgcacagactgccggcccagagcctaccctgactgaggtgggcacttcatatgtgaatgcaggtccacctgccgaggggctggaggtgtgcttgctgctgtaaacttgctctgtggaatgcatgcgcaagccccaggccacagtgcccgtggaagcgccacttccctgctgcccttcatgacaccactgcccttgtgacttggcctctacctcagctccagtttcattctgtttgcctggtgctggagctcattcctgaacctaactggtttagtggctgtggtactgagagggtcttccagcgtccctccccgaggcctagattctgttgtctggatgcctagctgttggccaggattctaatccaatgttttagtttcctcttgttgctgcaacaaattgccgcaaatttaatgacttaaaacaacaaaacattattctcttgtagctctggaggccagaaattcaaaatgaatcttatgggataaaaccaaggtgttggcagggctgactccttctggaggctctagggcagaaatcactcttgcctcttcccagcttctggtggctgccagcattctgtagcctacggccaccttatcccagtctctgcctccatggtcacattgccttttcctcttctgttgccaaatctccattcgcctccctcttatgagaacacttttgattagaggtaggccccccaccccagtaatccaaaatgatctttccaccttaaggttcttaacacaatcacacttgcaaagtcctttttgccctgcaaggtggcattcataagttccagggatcaggacctggatctctttggagggtattattcagcctaccacgacaatgcttgggaatttgtgtcattatcacttcaccccctgtaaattttgcttctactgtgcgctactccaacccctaccccacctcaactggactacctggtatatgggatcatttgtgggagcgatctgaggttttcagagtctgggggtgttggtggcagctaatacttagtaatgtgtgtttcagattctctgctaaggactttatatactatcccatttaacagtcacgtcaacccaagaggtactgtggcctggggaagccacatgcaatcctgttcagcctgacttcagagccagagtccttacctgctaactgccccgtggacagaggcagaccctgtgatttgggcttaatttaagcacgtctcttccccacagggagcagccacatggcagtcctagtgctccagcctggccctgtggtcccagcttcttttctttcccagatagcctgcaggatgcaccttcccaagagtggacagccaggatgagcttattcagctctctcccagcaggataagtgcagctcaggaacccaagcagaggactgtgtgaataaccctgagtttccaggcaatctggctctcagcccccacactgcgctgccccttggacagtcagggagttggcagtcagcagacgctggctgagtttggatttgtttgctgatcctgtcatgatatgtcattaaacattcctggctggaagtcagacatgagagtgctggagggtgttctcacacccctgtgctgtggggaggccttcccttctttctggctgccctggtaccctctagagcctcctatctgctgctcggaggcagtgcctgcagcggctggactcctgcagcagctggaggtggaggaaagattcttaggccgtgagtcctcttcttccgacagcgaatttgagccctggtggagcaatgtccggcacgctcaggaaagtgtgaaatctagaactctctgtagtggcctgaggcaatagtcagacatggctggtagagctgtgctgcctcagaagtcatcctggataagctgctctggatccccatcgtggaagcataaaatgtcaagcagaaggatgttatgagaattggaacctaagccctgtgctgacctcggggagcactccctggggctacctttgctgggaggtgcctggcccagacctgtccaacctgggcctgcagccaggaacattctcccagagtagcaatcttattaaattccctgtaatatacatgttttaataataaaagtatggatatattattgatgaggatacaaatagctttacgtcttttacattatgtaagtaagcactgaagttatttcttttttaaaaaaatagacttaatttttttacagcatttttagattcacagcagaattttgcagaaagtagagttctcatatattcgaaaccctgcaccaccccccactccctggagccatatgcacagcctcttccactgtcaacatcccccaccagagtggtacatttgttacaattgatgagccaacactgacaacaacataatcatccagagtccatagtttacattagggttcactcttgatgttgtaccttctggggagtttgacaggtatacaccactgtagtatcatccagaaaagtttcactgccctaaaaatcctctgtgccccacctattcatctctcccttcccactaattcctgacaaccactgatctttttaatatctctacagttttgccttttccagaatgttatatggttggaatcatacagtatatggccttttcggattgacttgactcctttcacttagtaatatgcgtttaaggttcctccatgtcttttcatgggttgacaaactatttctttttagtgctgagtaatattccatcattagaatgtaccacagtttatttatccagccacctactgaaagacagcttagtttctccaagtttgggcaattatgaataaagctgctgtaaacatctgtgtgcacgttttgtgtagacataaattttcaggttatctgagtaaatatcaaggaatgcaatttgctggattatatggaaagagtatgtttagttttgtaggaaaccaagtcttccaaagtgactctaccattttgcattttcactgacaatgaattagagttcctgatgctccatgtccttcccagcatttagtggtgtcagtgcttgcaatttttccattataataggtgtatactggtatttcattgttgttttaatttgcatttccctaatgatatgatgcagagcatcttttcacatgcttatttgacatctgtgtatcttctttggtgaggtgtcttttcagattttacccatttattaataggttgttcattttcttatggttgagttttaagagttctttgtgaattttggttaacagtcatttatcaaaataattttccaaatattttcttcctgtctgtgatgtcttcccattctcttgacagtatcttttgcagagcagaaatttttaactttgaattaagtctaacttatcaattacttctttcatggtcatgcctttggtgtcatacctaaaaagtcattgccaaactcaagattgtttagatttcccctatgctatcttctaggagttttatagttttgcatattacatttaggttagatttcctttttataaactttttgattgaagaataatatgcaaacaaaagtttaaaagtcataagtatacaagttgatgaattatcacaaagtgaacacattcataactatcacacaggttaagcaatagaaccagtacttcagaagcctctcttgtcccctttctcaatcatagctccctccctttctattcacacttttaaaaccatagggtaatgttgcctgtttttgaacgttaagtaaaatgaagtaatatagcatatactattttatgtctggcttcttttgcttaatgttacatttcagaaataatccatcttattgggtgttgcagtgtttaatacattttcattgccatgtagtcttccattatgtgattacatcacaattcaatgttaatggacatttgagatgtttccatttggagctgtcatgaataatgctgctgtaaacattcttggacatatcttttggtgctcactgggcacattcctattgggtatttacctaagatagatagtgagtgtcactatatttccagtttgtgccccactgtcccagcttatgcctagacgtccagagtaataattttcctccctttcattttcagaagtgtcccagtttggctaataaatgaattatgtcttttgatgaatagaaatgtaatgtagtccaagaaatcttttcctaccccgaagtcatgaagacagatgcctgtataatcttttagaagtcttattgttttagtttttacagtattttatgttcacctagataaaataaccttttatatttaccacttgtatgctctttattcactcctcaacagtcaggtttccttctggtatcatttcctttaatctgaaataattattgtcatatttcttataacgaagatctgtgggcaatgaactgtccttagttttactttgtccagaaatgtcttaacttgaaagctgttgttcctgttttctgtttccgtagtttctcatgaaaatttaccagtcatctgaatcattgtcccactgtgtgtattgtgtagtttttctcgggccgcttttgtctttggctttcagcagattaattacaatgtgcctaaacatagttttctttgtatttttcctgtctgtcatttgttgactccttaaatctgtaaatatatgccattcagcaaatttggaaaatttcccatctatttttttcccaaatgcttttatctcctctcacttttctccacctgggacttcaattactaatgttaggcattttgatactgcccacagatccctaggtctctgtttatttttttcaatctttttctctgttcttcagattggacaatttgtattgatgtattcatgttcagagactttttcctccctaatctctagtctgttattaatcccatacagtgaatatttatttccaatattgtattttttcagttctaaaattctcatttgttcttacgttttctatttttggctgagagttcttctttatttgttatgagttttttctttatttttctgcactgaggttaatcataatagtgatattaaagtctttgggaattccaacatctgggtcatctcagggttgccattatgtttcttaggtgatgtgatttgggattgtatcatgggcattgtgaatgatatgttgtggaggctctttattgtttcattttagcaggcgattagcttgattacactcacagtgtaaacatgatgtcacctgaggtgggtggcagctcaaatctcagttcagagatttttaaatttttagttggactccttaaaatcttccctgtgcatgaacagttccaggatcagccagagatgtgagcagagtttgtacacaaaatttaggttccctcctcattctctagtaactctggttgccccaggctccatcttctggttccttaggcaagattgatggtaggttctccatcacagttggaccgtcccatgccgtggtgtgactgtggcctgccctcatggcaaaactgaaaaactaggtaactcaccagatgctagattccttctccagatctttctccaaatctgcctgcttttgttcacgctccagagcccttaggttgtcattttttgtgtgttttgttaaagtgtgttgttgttatcagtgagagggttggtggttataggaatttactcgttcttactggaagaggaccccagttcattgacattaaatataattagtcatgtatttgcatttaatgctgctatcttactatttatattatacccacctattctattcagaatgtttttcttatcttgatttctatccatttaaatattttccatttcctccccttttagcttattagttaactccctgtttataccctttttgtaattagtagaaattacaaaattacttttaccttgttaacccaatgttaatatctctacccttctttaacacagtagaaggaatgtagaatacttaaattccagttatttccctccggattccatgctcctgttgtcgtgcattttaattctatgtatttttaaatcccagaagaaattactgtcattttctacactcaatattcatttagatttacacacaaatttaccttttctaaatgacattattttctccatctgtgagcttccatctgagatcatttgccttctttctaaagaccaccctttattattattttttttagtgcaatagttctagtaacaaattctctgtttttgtttgtctggaaattcttttattattattattattattgaagtatatttttactaagtatagagttccaggttgccacgtattttatttcagcattttgaagatatcatttcattgtgtcccacctcccattatttctgtttttccttggctatttttaaacgtttttcacctatattttgcttttaccagttcttctttaatgcacttaggtatttttttttcttcatatttttttttctctttagggcctacagtgcttcttgactttgcagcttgatttgtttcttcaatattggaatattctccaccattttctcttcaaatattgttcctgacgcgttctctctaatcctactgagagtgaaattacatgtatgtgacaccttttctctgtgtcctggatgcctctcacattcttcttatatttgccatccttttgtctccctgcaccttagtctggatctttttctttttttctgacatatattccagttccccagttctctgttcactgtgtctaatatccatataaacccatccatctggtaactgattttaacaatggtagttttatgactaaaatttccacttgatttttaaaatgttttctagttctttgtcaaaatgttgtttcttgtcttttaattctttgaacatattttcaagtctgtgtgtgtaaccctagtatctggatcttccacgtgtctgtttaatgttttttccctctcttggcttttggtcaacctttttttcccttataactgcttatttcttctgagcattggattttaaatttagagataatttgatgctctgaatgatggcatattcccgcagacagaatttagttttccttctagttggcagctgggaaggggacaggcgataataactcagtgactgagatgagtcaaagaaccatttcgtcctatgtgaaggctggcctatctccaggtcaattctgttcctagattgcagctcattggggtccccattgaaaacctaacatgtttgccaaggtcctcactctctgatgggccctgaactccagttttatccttccatttctgtgtggtggatggaagctctgctcagcttctcggcttctggaattgtcagtggccttcaggggatatggacaccaaaagccacattttccttcttgccttcctttctctcgcagatcttggtctgacaaagtctcactgcactggtatctatctgatactttcaaatagatttttaaaacttctttccaatttctctagttattcttattggagagtcggcccaagaaaagtaaggttcagagagaataaataaattgtccagggtcatacagaccctgaaagtagaatctctatgaaatctatttaaataggtggcacaagaccagagaaatctgagacttacagcagcctgcatgcccagccttcaccatcctttgtcatttgggtattaagtttgacagttgctatgtttaactctcttgttttacaaaactgatatccatagagatggtgtgatttgtccatgaccacacagcgaggtaatatgtgagttggggtaaaatctaggtctgtgctcctcggttttttcctgttaaatcttgctgcccccatctttttttttttttttttttttattgttacttaggtacccagacctacatcccagctttagtaagacatctcagtgctcagtggtccaagaagattcttctcatttgtagaaaattgtccttgatttatgcagccacaaccacatatgagtgtcacctgttaccttcttttttcccctctttcttcgcttctctttttatctctgaatttttacattgccactgacatcttgcctgtggctaatagacacgtccacactgagagacatgctctagtagagtgggttcaggactgcataattagtttgtcctcttttatgcctgggaatattatatcagattctctaaaaggttttgaaacgtaaggtgaaaagggaaatgataaaataaggcatttgagatttttaaactcatgatcagctgcttcccttgaaaataattcataatctcttccagaattgcttgtaaaggcttttaacttttgtggtttatctgctgttctcttaagcacatggtatatatttataggttcttaccttaaattttaggcagaatcatgaattagatactgggaataaagctgaccagaagtaaatcatttcccacatcttatctttgtaaggcctgaaaatgtgatattccacgctgtttttgaagagaaagcattttggtggttaccaggaggaaagaatggggcaggttggaagtgtcactggtctggcagcctggagacctcaattttatcccattgtgacctctcacttatgtgcgaccttggacacatcacatacaatttaggccttatttggcaatatgtaaaatgaaaaggttggacaagataccccttgggagccttacaattctcaaatttttggaaaactatcctttactgtgaggccagtgtctggaacagcattttgtaatatgaatgaggacttaaagcaattttttatttcctgtgatcttgtgggaagagggtgggtaaagttagataatctagaagttgacatttgtgttttcatgtaagcaagtcaaatgttctggactacattttgtttcaagctaaagagcttatgctgtgatgacccagcttattaagttagataacaaatgtaaggcacctatttcatttccttatcactgtggggctcagtaaggagtttccaaaagaatgaatgagagattatcatcataatatctatcacttatcaactgcctgctgtgccaagatacatccgtgagtaatacagatttggcatctgtcctctccaaggggtaagtattattacccctagttccacgtgtggaaaatgaattccaatctggtcttacattaaaaaccattgatgtggcgcctgcctcgcgcactgtgtgtgcacgctgcaaagaccagcaagctccttggaccttggagcaggcctgctgccttcatgtccactctcctcatcaatcagccccagtatgcatggctgaaagaggtggggctccgagaggaaaatgagggcgtgtataatggaagctggggaggccggggagaggttattatgacctgttgctctgctaacaactagccaatagcaagagtccgacaggccagtgtggcagactatgaagaaactgtaaagaaagcaacagaagcatggaaaatctgggcagatattcctgctccaaaacgaggagaaatagtaagacagattgacgatgccttgtgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagacctggccatgcactgattgagcagtggaatcctgtaggcctggttggaatcatcacggcattcaatttccctgtggcagtgtatggttggaacaacgccattgtcatgatctgtggaaatgtctgcctctggaaaggagctccaaccacttccctcattagtgtggctgtcacaaagataatagccaaggttctggaggacaacaagctgcttggtgcaatttgttccttgacttgtggtggagcagataccggcacagcaatggccaaagatgaacgagtgaacctgctgtccttcaccgggagcactcaggtgggaaaacagatggccctgatggtgcaggagaggtttgggagaagtttgttggaacttggaggaaacagtaccattattgcctttgaagatgcagacctcagcttagttgttccatcagctctcttcactgctgtgggaatagctggccagaggtgtaccactgcgaggcgactgtttgtacatgaaagcatccatcatgaggttgtaaacagacttaaaaaggcctacgcacagatccgagttgggaacccatgggaccctaatgttctctatgggccactccacaccaagcaggcagtgagcatgtttcttggagcagcggaagaagcaaagaaagaaggtagcacagtggtctatgggggcaaggttatggatcgccctggaaattatgtagaaccgacaattgtgacaggtcttgcccacgatgcatccattgcacacacagagacttttgctccgattctgtatgtctttaaattcaagaatgaagaagaggtctttgcatggaatactgaagtaaaacagagactttcaagtagcaactttaccaaagatctgggcagaatctttcgctggcttggacctaaaggatcagactgtggcactgtaaatgtcaacattccaacaagtggggctgagattggaggtgcctttggaggagaaaagcacactggtggtggcagggaatctggcagtgatgcctggaaacagtacatgagaaggtctacttgtactatcaactacagtaaagactttcctctggcccaaggaatcaagtttcagtaaaggtgttttagatgaacatcccttaatttgaggtgttcggcagctgtttttgaagaagacaaagaaaattaaagttttccttgaataaatgcattattatgactgtgacagtgactaatccccctatgaccccaaagccctgattaaatcaaaagactccttttttaaaaatcaaaataaaattgttacaacattaaaaaaaaaaaaaaccatttaccacttagcaacattggcagctttagttctccagcagcctacatacattttgtgctaaggagcaaagtaatcttccatttaccaagagctttttttgctttttaatgatgtattaaattaaacacccactcaccaaatatctgtgagtgttggttgcgcagatggatttgagtgtttggtgctggggtgcatcttgtcacagctgatcacttactggttctctgactgtggctgggtggagttggcatctgtctcctaggttcctcctgcccccaacagtttgtggttatggtgataaaattattgtgtgacaaatatcatggcagacatataaacagaggaaaggggacagcaattgaaagagtatcaaacacactttaaggttctaactgtttcagttaccaaggctcaggaaggcgtatgttgtgtgttaagggatccagagtcactcagacagtgttcctctccctctagcagggtatgaaactactaatggccccagaccctcatcatcactgtgaaattcactgtaaaatctttggaattttgatgagtcaaaagtggaatctggttattttgatttgcatttttggattgccagagaggctgagcattgctgcctggttttacagcccatttgtgtatttgttttgagcattgcttgtccttttcttgaccctttttaattgggatgttcgcctgttttattattgtcttagtagagattcaaaaaactctaataaggatgccaatccctttactatcatatattactaatattttttctcagttttgtatttaaatatttattatgctttttaatatgtttttcttactaaaaacctaacaatcttttcttggtttatgtctttgatgttatttttaacaaaaggcttccgggcccttgaatgctggaaatgttcacttaaattgtttttcaatattctcatgggattttttttctcatttaaaattttaatctatctggaagtaatttgggtatatgtcatgatgcatagagctgacttaatttttctccatatagttaaccagttatctcaatattattattgaattatccattactttctcactgatataaaatgacatttttattacataataaatcacatatatcgctttatatatatgtatagatatgtgtaaaattgggtcagttctagattttatctttttgttgatctctctgctggaagcatactattttgatagttgtatctttgaagtattattgtcacaactggcagagcaaaatacttgtaactcttcacagttttattagccagtggctggaatttattcctctatatggatttgagaatcatttcacaagtttaaaaagttgtgccagtgtatttatagcaattagtatataggttaatttgagagagacttagcatttttttagtactggttttccacccaggaaaacagcatctcattccatttatttcagtcatattttctgacactcagatagtctgagtgtgcgatatgatgtgttaaggcacaggttctggagtcagagagtctcagttcaaatccaagtctagccatttattagcttgtatatcagtgaaaggttttccccagtgagtgggacatagtgttgctcagtaaacatttgttgaagaaatgtttgaatgaaataatttattcctaaattttttgtttttgcagttgtgaatgagttttagtctgcatgcttgccagcaattaacattgtcagttttttagattttagcccttctactaggtgtgttttaattagtaattccctggtgacaaatgatggcaagcatcttctttggtgaggtgtctgttcagatcttttgtccatttgttaattgggtgtttgttttcttaatgttgagttttcaatgttctttgtgtatgttggatataagtccggtatcacatttatgtttgaaaatattctctcctcatatgtggtttgtgtttttattcttcccacagcttattttgaaagcagaagtttttaatgttaatataatccaatttactatttttttctttcatggatcctgctctgtagtataattttaagccccttatatcaactcataaaaacagacagggcaataatgtaaattgacagagcacacagtccataagcagcatctttcataaaactaaggattagagtatatgtctataaactaaaaaatatgagcagttagggccaaaccactgaccgtaacaaggaagtctgcaggaggaagcagctggcagacaaacagacttctggggatcccagggctggggacccagaaacttctctcaacacttgtcccaagaaggggacagtcccccaggagtggagggcttgctgttgatgtgaacacattcgcttaaagtggagggggcttcccaggctccagttggcaaacagtaaggacaaatgagaaaagtatgcccacaaagcagaagagaaactgcaacctaatatttcaaatgagctaaaagaaattaagaaaatgattaaaagttacaaaagaacaggacgaatgcaaattaaaaaaaacacaggttacatcattagacaacagaaaaatatgaaagggaattgattactcagaaaagaaatagaaataaaagcaaaaaaaaatctaggaaaggaaggtcgaactggaagaaatataagagtgaataaacagtgcagaaagcactgtatagaaattggaaaggaagaagaaaaacacagaaataaagaagacaagaaactatttgagaagtgatagaatgcaagacaggcaaaggagctccacaaatatatgatgattcattatataatatatatatgatatatataatatatattatatctatctagataggtccacatatataatacatatacatatataactcctctatataataggagcctctgaagagaaaaaaccaaaccccgttgtgtactgggaaaatcaatccaaaaggacaacatcaatgcatattctagtaacataattgcactataaaggaaaaaagtcttttggggcatctaggcaaaaagaccaagtcgtttataaggaaaagaaatcagattggcatcagaacctgagagcaatgctttaagccaggaaatactggagaagatatgttaaagataatctagaaaagaaaaagtgagccaattattctacattcagccaaactggaccctcaaatataagaaccacagacaaaactgtgcgaacatgccagacctcggggaatgaatttcccattaacccttcttgaggaaccttctgacaattactgtgactggagaaactttagcataaggactggtggttgacacgtgagactttggggtacgttagcttctggtgagacccctggctttctcagaattccataagtgttcttgatccaaagacagctgtaaaaagtggttctatgatcccttggttggaataccatttctcctctgctcaggtgttggctttgactccagtcatttggcttgtgattatttcatatccctccttttaagaagccacacaccaatgcacctgtagcttgtgtggccaattgcccacccaaaggatacatatcatcagatctctctaatatcaacaaggggaagtcatttgtttccattgagattctttctgtttaaacacaggagagctcattcaaccttatttaataaggagaaaaaagccaattaattggctcacctaactgaaaaatccagagttagatatggctttgggcaagtcttgatctggtaatttggaagtgttacaaaggatcttgtttctttccatttctccactctgctttccatggtgttgctttcgttctcacatggtgtcaagatgttacgagaaacaacctcactacacatttctttttgataaacagtgagaatatttattaaaagtagaatagctttttcccagcattgctagcaaaatcctgggataaactgagtggactagcccaagtcaaatgactacccctaaccaattgctgtagcagtccaagtcacgtgactactcctaaccaattgctatagccaggaaaatgaaatgcttagttatggttacctgtcctcctcttcttcctcctcctcctcttcttcatcatcttcttcttttttcttctttttttcttctttctctccctccttttcctcctcatcttccttctcttcgttttcctcttcttctttctctccttctccttcttcttctttcttctttcttcttcttgtttcactctgtcacccaggctggagtgcagtggtataaacatggctcactgcagcctcaacttcctgggctcaagcaattctcccacctcagcctcctgagtagctgggactacagatatacaccaccgtgcctggctaatcttttttacttttggtagaaatagtgtctcaccatgttacctaggctggtcttgaactcttggctccccaaaagctgggattataagtgtgagccaccgctcccagcccacatgtctttagaaccaaacagagatttccaaacagaagtcagtgactcctggaaggagaaaggaaggaatggactggggaggctatctaaaaaagaatttttaaacgtgttgaattttatcaaagtgctatcttgacatttcttgagatgatcatatattgactcttattgattgtggtgagttatgtaaatagatactctaagttagggaaggcaacctacttagctgtgctctgtgggagtaactgaggttctgggagaatctgcttgtttccccttttcttctctttttccttcttccagctcttatgtgtacttctctgcctctcctcaaccctctgatactggtgttctccagagttctgtctttggtcttctgctgtgagtgatggcaaggttttaactgcctttcctgtatgctggtgtcactctccctgagcttcatacttacatatcccagagcctgactttgcattttgaaaggactagagacatctcaaactcagtacaaaggcaggggcctttgtactgtgtcatctcatggagaaggtagaaagggcaagtgagtgtgggagacagaacaaagaaagcaagcggaattcatccttttatcaagagccctctcctgtgataactaacccactctcaagataacagcattaatccattcctgagggcagagccccatgacctaatcacgtcttaaagatcccacctcttaatatagtcaaaatggcgactaaatttcaacatgaattttggaggggaaattcaaatcatagcacccctcaccactactcctagtgtagacactcatcatcttttgtcaacaccagtagttcccaaactttagcaagcatcacattcatctggaaggccagtcattacacactgggcccacccctagagtttctgattcaatagatctcggatggggcctgaatgtttccccttctaataagttccatgtgatgctgatgctgctggttcagggaccacaccttgagaaccacggggatcattgcaggaactcctttctgatctctgttcctcccttagtctatgcacatttcaaccagagtgatccagccaactacaatccagctatgctacacctttgtccacctagcaaagcccaggcttctcaccacagcagccttctgtgacctggctccttcctccctctctagccacatggtctgttccacattgcctgggactgttcacacaaactctgttctttgccatccttgtgccattccatctgccaaaaatgctccttccatcggtcttcacttggctcattctcactgatccttcaacattgatctccagtgtggtttcctggaaatttgcctgaatccccagattgagctaagttgcccttaggtttctctggcttcatggtcatctcactcccactctgctccccactcctgtcttcagactgtgggctttttgaaggcgtgaacactcagtcttgcttatcttttttggcttattttctgtgtagtatctggcacataatagatgcttgatgaaagtttgtggatctaaactaaatattggtgctactcttgagtataactatctcccctcaggggccctgccacccatatgctagtacctgcctcccatcataaggaaacagtgccttttaggcattgctgaaaagtatagggtctggacctcctgatactgggacttgttaccctttagacatcatttcaatcttcatatatcttcctcctgtggttagacttaaattgagggctgtgggctcagccacagaacatcatggcctctgttaccctaagtttcttcctgttcttgaaattgtgacggtttggaaagagatggggagaatattgttacccacgtgacaggctgcagcaaccttgaccactaaggtcaaataagcagcattgatgaattttagcatgtgggcacccctggagggggcgaggcaagtctttctgttacaaagatgcagatttcagtgcaactgaaggcagaactttctaatgagagtataaagttgtccactggttgtttagaaagaggctggacttacaccagtagaactccaagtccacatagacccgccatttggttcaccagacaccattcccagggctgtattttagccatctgactgtccagggatccccgggaatccttatgtgtgatgatggggctttagagactttgaactaaaatgccaaggcctcagctccgtgaattggtcttcttcctttagattggtgcttctcaaacctcttcaaatctgagggtgaagaaagtggatgcctacctccaccaggtaaagtgatctgctgcaagcattagatttttgtgaaatttcattctttagcttaaaaattcatgtgaactttgcattatactctggttttctcaactaagataaaaatattttgaaggactttgtagttaaatcactaaacttgtttcatcttgacataaaaatggatgctccactaggatgcacttgtagctttgtatgtctcctggccctatctctgcaccatcaccatttctaaagcattgcctgtcttacacaaaggccccaaggcccgtaagaaatagtaatgattttaaacaggattccaggagagtggagcccatgaatctgcattgttgcttacagaattacagcaagattgggaacatgagagttgtttttttgtttgtttgtttgtttgtttgttttattttattattattattatactttaagttttagggtacatgtgcacaatgtgcaggtttgttacatacgtatacatgtgccatgttggtgtgctgcacccattaactcgtcatttagcattaggtatatctcctaatgctatccctcccccctccccccaccccacaacagtccccggagtgtgatgttccccttcctgtgtccatgtgttcttgttgttcagttcccacctatgagtgagaacatgcggtatttggttttttgtccttgcgatagtttgctgagaatgatggtttccagtttcatccatgtccctacaaaggacatgaactcttcattttttatggctgcatagtattccatggtgtatatatgccacattttcttaatccagtctatcgttgttggacatttgggttggttccaagtctttgctattgtgaatagtgccacaataaacatacgtgtgcatgtgtctttacagcagcatgatttacaatcctttgggtatatacccagtaatggggtggctgggtcaaatggtatttctagttctagatccctgaggaatcgccacactgacttccacaatggttgaactagtttacagtcccaccaacagtgtaaaagtggaacatgagagttgtaactgaaaagcttgtgaggcagtcttctaagatcaggggctcccatgtatgcagtggagtaggccagaattgctcccagtgcctgatcaaagacacatgaagccatgttctgtgatgctagaccgtggtcagagaaccctggtgctgggcatagagtacccagtgttctgcagtgtaggcattttaatgccttgagcactgaaggtgagaacctgaggctcatcaaaatgagcaagtaggcagagctttagagttttagagcaagaatacaagggagccccttgttctcattcctctcttagacgagaatacgttactcagcctgttctgtagccaagagaagaggatgatgtcagtggatccaagatagcctgtgagtttgaaccgttttttaaaagaaatatactttgattgaacacaaaatggtcttttaggacttacttaaccctttgctgtgctttgggcattttctgttttctattccaccaatggacacagaactgtacccctttcatactctctagggtttggggagatgggagggggaattaccatgggagcccatcttcagcttagtcacctgcctgtaaacagactgcttcctttcattgctgctgcggtgcttacctctctaaatcttcaaaaataatacaaggaagaaatatagttccttgggtgttgcctcgttggcttttgatgtaaaacatagtggccccagagggtcaaggtgcagtggggattgtcttccatgtgtgttagcaaagaggaggggccaagggctgggcctaaggccttggggaccttcccaggagaagctttgccggtctcaggcttctggtgtctttgctaagcttctgaaaatgttgaggttttaattgtgtagtgtttcactcaggttgtatgtcattaggatgttaatggtgctttttatcaataactgcttggaaatcatgattgttcttgccacataagtgaaattccttttcaaaaaagtgggcatttgcattttgtggctgactttgcatgggctacttacttttaaatgggattcatttcagtgagattggtttttaaatgggaattagtgcccgacaaggattcattacccctggggccatctaatctttggacttggtgactgaaggtcatggttcatcccagcatgagtggtcctgacacaccagagtcgggaaagtgagtgtggttggattcttgatggggtaccagctgtggctaaaaatccaggtgcttcagggtcacaggtccctaatgggagattcccatggagacaagcagggaagacatttcactcttggtcctctaaggcagttctagcttatcaatgataaaattgaggacagaggcagcatgtataattgaaatccacaggaaatctctaaaactcatttttagcaggtggtttctgtttctttgcccatcaaatctatttaccagaactgctgaccatgtagcaaaatttactgatttgaatatcatccctccccactttctcccaacttcatgtaatgttcaggagaagggaaggcatcagaggcatgcaggaggatggaggtggatcagaaatgagtgcttgggtttttccacagtctggataattgcctcctgaataatcagagctagactgttctttgcttgttctctattacacaatgtaattttacatgcttgaagtcatccggcagtgtctattatcagtggtatctctaataaaaggaaggaagtcagttgagggatgtcacgttttgaccattgcctttaaattcctgtgttctcccagtcagaccctgcatgatctttgggatcttggaatggagctgtgtttacacacactcagcctagtcatttgtggctgaattattacattatgaaagcttgatgccttgattcctgcactgcatgtacgacagaaagaattttgacataatcatagcatcgaactgcagtttggggttttttttgttttgttttgttttgttttcctcctctgaagttaaatctctctaaggcttccttgtgctggcctcctttgggtacttgtcattttgtggattatattctagaccatttttttctttccattttaatgcataatcgacatcaggctgagtttttttctcatgactgtagatgacatgactatgttgtataaataatttctctttaatctgatatttgtcagggggaaatggcttctccattatactgtgccagccaagttttctgtgtttagatctgatggcatctgcatgacttctgtgtttatttttctcattacgacttcagagttagcaagacgatggcctctttatcttttctcactgccatattttccaggcacagtgggatgtagcatcccccctccactggcacagcaaagctctctgagtctagtagtagcacttcttaagaaagaccagtgacagtggggaaggaaggagagggcatgggtagggggcagtgtaagatgctgtgctggaaagcacatcactgtgtctagtgcatggggggaggttgacggtactgcctccttctttgcagcctgacctcactgtctgggtggcccactgcagcgggagcgggtgccttgtgccaaacgttgtgcacaccgacttccctacctgcttcctctttccatgctcattgtttctcagccagatctttcacatcttatttataagtcatttaaaaaccctcacctcatttaaagtctctttgtacaccatcttaaggcctttctggaacagtctgagatataagtaaatacacaaataagagcatggccttcccagtgaggcagacctgggcttaaatctcagcttcatcctctcgggtaagtggcttaacctttctgcagcataacctcttaagccatagaaaggggcccaggatgccctgtgggattgctgtgacctttacgtgagatgatgtacgtggggaattcatcagccccttttgtcttattgaggcacagtgcagttactcatcttgagcaaggtcccctgagtcccagcccaattttctagaattttattttaccaagtttcagagaaaccccatctatattctgaggaattttaaatacaacaccttattctaccaaataaagactttactggaaaaataaaaagcatgtgtagaatatttatgtagtggctaatgctccattaatgttaacaccaaaataggaaatagactttcccaataaaattaaacctaatttccatttatttggaaatatctacatatacaagaagatagaaagtttaattcagtaaacacccatgtactcactatttactgcttaaaaaaataggtcatacgctgagtgtggtgcctcatgcctgtaatcccagcacttcgggaggccaaggtggatggattgcctgagctcaggaattcaagaccagcctgggcaacacggtgaaaccccgtctctactaaaatacaaaaaattagcagggcgtagagaatttttgtgttccctactaaaatacaaaaaattagcctgtaatcccagctacttgggaggctgagacaaaagaatcacttgaacctgggaggtggaggttgcagtgagccgagatcactccactgcattctagcctgggcaacagagcaagactccatctcaaaataaataaataaataaataaataaataaataggtcattcacaatatagttgaagccccggcacttctctccctgaattcatcgtcccctccaccagcaggaccacttgcctcaattgggagtttgtcagcatttctttgtactgttataatatattcctaaagtctattcagtattgttttaagtatttgtaaacttcaagtggtatcctaaggtatgcatcattctaaaacttgcaattttttgttttgttgtttaactcaatgtttgtaagattcataagttttaaatgagtaactctagttgtttcatttttactgttgtataatattctattgtatggctagtccttgatacatatatcagtttcttctggtgatattaatagactatggattcagttttctaaatttttgttacaaacaatactgctctgaatattcttgtaaatgcctcctatacaccctagagatacactcatataggaggctgaattgtcagatatatacttcttcgtcttcactagatatccccaaactgtttttcaaagttgctaaaccagtttacatgcccaccaacaatgtataagagtttctgaggggccactttcttgcctatgctagataatgtttgactcttaattctgccattctgttgataaaaatagttggatgtaagatagtatctcattgtaatttaaaatttttatcttcctgattactaatgatgatgagcatctcttcatacttatatttcctctcctgtaaatttctttttcaaatcatttccccggctttgtttttggctgtcttcttactgatgtttaaaaaaattttgttttatgttctggttactagtatttttgggtttttatgttttagatttcatctctccagctctgggcctttttctcttttattacagtgctctttgcttttttttgttttgtttttggtgaatagaagctataattttaaagtcaaagtgattaatcttttatttcatggttgtatattttgatgagtagacatttgtatgtttatgtgataaaacatcatgctgccaaattaatgtactattctaaatagtagggcataaaacataaaagtaatgaaatatgtcactggctgtgagtatcttgtaaccatgagtaatcgtccatctatattatataacagaaaaactatgaaagagatttttgattgattttgattgtaacgtagggatattgtttgggggggataattcaccaaatataaaagactttatcttcctcatgccaacattataatcttgtgtttttcgtggagctatctggaaaaaaccagtggaggtatctggaaatgaacacagatagctgtcaatgtctgggtccaggcatgatagctgagtcttgggtgggtgttgttaccttccacgaggtaagtgttccaccggtgtttgttgagtaaatggatatgtaatagagtctgcaggaggggccattaaagaagcaggaattgaagttagcaacagacaagtctgctcaaaagaatagactagtggttctcaaccctggctaaacccaaggagataaaaagttgaagacacttgggccccattcttagagattttagagattccagttatcttggtgtcaaataggacccaggcattgatatatttttaaagttccccaggtacttctaatatgaagcccaggttgagaacttctagaccagaggattggaagcaggaaggagaagggaagctcatgggctgcccagtgagctcttgggccctgaaaggtccagggtatcagagttgccaggaggtgctggagggcagccagaccacagccaggtaaggctggaggctggagtgagggcagcgccagccagcagggcccacaactgagaggggacagaaggaagagagtgttctgggtgtgctaagcacagttggcaggggagagagggtgggatgggacagagtttcccagcatagagcagggaggcccagcctcacagtgggatcacctagaggctgcagggccagtccctttctgactggaagccagaggacagacaggggcccattaaaaaggcaaaaggcagacacaacctttgtttacccagagctcagacgaataaagaactaagtttggcctgagaatggagggtggacagggcacatattgagatcattaaatgctatttttaaatcagagccaacagggcagcagacagagttgatgaagagcatttaaaagtgcctatttctgtgcccacagctggtgtcttttcagtgtgaaatgatcttcaccgtggacccgtcacaaagtgcaagtcaagcttgccttaagctgtgtgtgtgcgaacactcagtactgtagatggtgggaaggaagggattctaaaggagaagtcattgaagtggggaagattcagactctgagttttggaactcagacattccacccccacctggacacacacgcacatgcacacgcatgcataccctttttcttcttggtgctgggccagccctgttaacagactaccaggcacaagcagggatcgccaggcactgcatcatctgttttgcagagtctgaatggagtccagaagccataccagaaagatgagtgctgcagaattaatgcttccaattttggagcataatggaagagcagtgcactgggagttaggaagaatgaagtctcaatcttcactctgttacttaaaagctgtctgttcttttcagtttaattcaattccacaaagcatttactgagcatcttgtagatgctggggataaaattgtgaaaaagacagagactatgtcctcaagaaactcacagtcttgccaaggagtgagatatttaaatgagtaacaaaatcagtgctatgaatacaggagtactgaggagagaaatcactggttcttctttgggtgaagttggacttgaaccattgtcagagggcaagggcgttggagcaggcccttgaaggatgcgttagctgctgaggcaggaaagggctttccaggtcaactgctttccttcctgaatccttagcttccctcttgtctgaggaaggctctaaaactcgatgccaagttacttaacaaaattcctgaagctgaaactattaagagctgcagcaatcacctctagagaatgtggtggcgtgacaggtgaattaaccaacctgaactaccttgatttctctcgtgagtttgcctcttccatctgcctaccctgcaccagctgggttgtatcgtggagttccctttctattgaagtgaagccaagctgagtttttttcttgatcattgcagtgtattttcccacttgctttcattgctgtagttcctactcatagtggtgtttttgtttagtttttgctaaatctctgttcttggttgttcagaaagtgggcaagccaatgtttgattttcccaagtcacagatcttattacgttaatcctttgctcaaacacctgcaatgtgattggtgcttagagattaaaaaagagagctccttcctgtgtcctctgaggatctgaccccagccttcccagtcgaccctttctcacactgcaatccagctctctggacacttgttttctccccaccagcaccttcgctttcctgcctccatgcctgtgcctgtgctgttccctatgcctagaatctccttccccaacccagtatcttcgtccccctattcttcaccacctgcctgccttcatgaagccttccttgatctccccacctcccaaaccagaagtattacctcctctttctcaacttcaaagtgggagagaaaatgtctctcaaccagaattctatattcagccaaacttcaagcaaaagtgagtgatagacgtttacagatcaacaaagactgagtgactttgccatagaccttctctgaatgaaatgatgtattcctaattttgcagtcatggacccatgttgccagcttgagatcaacaatggtatttataccacggaagtcaacaaatgctacaaaatagtacttgtgttttttttttcatgtgaaagtggattggtgaccctgcttccatgtatatatgtgtgtatgttaccattcacacatgtacacacaaatatttgacacactacgaatgttatacagcacagttaaaactacgctgtagttcagcagtccttcctcattaggctactgtggaaacacatgtggctaggaagtgtgtctctcttcacactctggtcccaccctcccctcttctcaggtgttggaattatgttacctatgcccccacccctgcatttgtttctctgaccctggcaaacttggccacttcctggaatcagagctaatacactaattgaagagtctgtgcatctgcagttgctcaaagttcattctttgaagtagagaatcttggcctggctacacagatgtcagtaaattatctcctgtttctgttcatagttgctgttttataaattggtgaaatgcaggcagttagacgcctgtgtcagaagcagaactctgcaaactgccgtctgtgaatacacctgctacaggttttttcctgctggtcactacctagtgccagccctcagagtcagcaagaacaagttccagtgttcttttgggacagttgacctcttttggacacagaagccaaggccagatgacttggagcacagaccaagaaggaaaaggcaggccaagagacacaaagcaaagtgtgggtcaggactagaggagctggtaaactgaggcacccacgccggtagtgcaggtagagtgacaacacgtgggagggagcacagtgaagtgaggctgggaggagagaggcaaaggatgcaaaggatggtagagatacgagaggcaggggtttggagaatgtcccttagcagcaactttacagccccacttccgggctctgctgtcctcccacgagctcacagcatgccttcctgctgggtaggtcagacaggagttagaatactggatggcaggcagagaactgttgtggctatgagagaaagtcgtagggtctttcctgcctttaggaagaaaaatgatatatcttctagcttgaaagttgcttttaaaactccatgctgtgacacagtggccattgcctgtctgcccctaggattacaggtgtgaatgcgcctggcacaatgcctgggtcagagggacttaaggaatgttcacagtcatcagatattctcctggtagagtcaaaagtcgcctgcccttccccgccagcccaccatgtaaggttagctgtatcaacacttcatgcacatattgattatttggaaaagtatacaggcaactgggcacaatggctcatgcctgtaatcccagcactttaggaggccgaggcgggcagatcacccgaggtcaggagtttgaaaccaccctggccaacatggcgaaaccccatctctactaaaaatacaaaaattagctgtaagtggtggtgggtgcctgtaatcccagccacttgggaggctgaggcaggaaaatcacttgaacccaggagatggaggttgtagtgagccaagaaggcaccactgcactccagcctgggcgacagagtgaaactctgtcagaaagaaagaaagaaagaaaaagaaagaaaggaaggaagggagggagggaggggagggaggggtggggaggggaaggagaggaaagagagagaaagaaagagagaaagaaaagtatacaggcaaggtattggttaggggtgaattattattttttggacagcctgtgcccttcttgcaggaatccttccctatctcttggccttccaatgcgagtcactttttattttattccttttaagcttctatttatgatttcattcattgctttattttctgccactgagtgactcttttaggagcctaattttgctggagaaatcattcacaggtggtcttgttggagggggcttttgtgtgtggtggaggcagtgaactcaagagagatcacagggcaagcgaaaaggtaccctggcttatcaaatttatcttagtatatactaaattggtttcactttttttttttcagagtctcactctgctgcccaggctgaagtgtagtggtgtgatcttggctcactgcagcctccacctcccgagttcaagccattctcctgcctcagcctcccaagtatctgggattacaggcgcccaacaccatgcctggctaatttttgtattttgagtagaaatggggtttcaccatgttggccaggctggtctcaaactcctggcctcaagtgatccacctgcctcggcctccgaaaatgctgggattacaggcatgagccaccatgcccaactggtttccctttttaatcattaatctttttttttttttttttttttttgagatggagttttgctcttgttgcccaggctggagcgcaatggcacggtttcggcttactgcaacctctgcctcccaggttcaagcgattctcctgcctcagcctcccaagcagctgggattacaggcgcccgccaccatgcccagctaattttttgtatttttagtagagatggggtttcaccatgttggctaggctggttttgaactcctgacttcaggtgatctgcccacctcggcctcccaaagtgctgggattacaggcgagagccaccgcatctggcccaatcattaactttttaatcagcgttctggcagttgcactgctttggaaagagggtgtctatttcaataacaaaaactggcttgggagtggagctgggtgaagggctggcagcccagtgacgcagcaggttctggtgctggtcctctcccagtagagttgctcttggggctgtgcccctaggctactggtgtcagcacccacaccttgcaggatactgacttacttagacaaaagaagagtaagagaagtccacactcaacatgagcctgtcactttgacctgaacacagcagtgaaacactgaaggaacttgttcacaggctcagggactcaaagcctccagttggttttcattgtgccaggcctgctgagtggacccatggttgaggaggctgcctccccaagaggagcagaacaggcatccttgccctcctgagaaccccccacagagggccaggaacctcagatgagcagtcattagagggctctttgagttttctgctggctggtttggtgagaggcccaagcgccctgcatgagttctttacactgctgtgttggggtggggtaggagaatcaggcctacagaggagaagaagactggtgctttggagagtgttcatagcaccagcactaagagttaagcttggggaaaggagaagaaaggagaaagggaaattattatggtcttgcaaagtataatgtaaagaaagtttgcttttcttgtttgttttttgtaactgaaaaggctcccatggcccttgggtcactgcaagtgtctctggttgtgtaaatgctgctgcgtgctgaaggcgctccttcagactgacaaggggccagtacagagtgtggaatgcaggataagcttccaatagtgacaaatgaccacagtctcttagagaaaaacaaaattggatccatggaggtgaggtcaagaccgtcaaccaaattagtctagagaatagtcacttttagaaatctcagtaaagtaattaaaaataaagacaaatatttgctttatgcttgctaccatctaactgcttgccaaaggcagccagatggtgttggccagtgaacactgaagagccctatgctcactcctggagttgtggggcagagacaagcctctcgtggtcatcatggtgtggtgttgctcagtttatttgtggaactacaactaagatgaataatttatccatggtaaatgtgagtaagactaagctgtttgaccctcatagtaaaacatgaagataagaaaaccaagatctaaatataggaaaggctcttaaaccatacatgtgatttagcctcaagatttgagagaaatgtttattctcttttgaaatttcagaataataatggcctcagcatgatgcccagcacatagtaggtgctcaataaataattattgaattgaattcttttcttccataaaatagtacatgcttattataaaaatccagacacttctagtaaaaatgactcaaagtccaaccacttagcatttggggatgtatccttaaagacatttccaatgcatataaatggatactttttttttaatacaaaaacaggactgtgctatacatatacatcatgcttggtaacccatctccagttcagtaagctggattcttcaatttagtgcacacggtggcataatgcaatgcgttgcgtaaggaaggatgtatccatttgtgtagtttaagacttgacgcttctcttgtgctgtcctttatttagcaggtgtcttctgcggaggtgcgcatcgggcccatgagactgacgcaggaccctattcaggtacgcctcctttactcagccctgtgactcagattattttcttttttttttcttttttttttttttttgagatggagcctccttctgttgcccaggctggagtgtagaggctcagtctcggctcactgcaacctctgcctcctgggttcaagcgattctcccacctcagctacccaagtagctgggattacaggtgtgcgccaccatgcctggctaatttttgtatttttaatagtgatggggtttcaccatgttggccagactggtctcaaactcctgacctcaggtgacctgcctgcctcggcctcccagagtgctgggattacaggcgtgaaccactgtgcccggcctggctcaaattgttttcttgaagacctaaacatttccccattttgagtataaatatgatggacagattgcatggtggattgtgagaaagaacagctcttccaccccaaaactagtctgctccacatcctactgtagccagaaagggaagaagcaatgaaatggtgaagggctgggctttgccatgagtcacaactgggtgggaatcttggctctgcctttaatcagctgtgtgaccttgcatatattgcttcactcctctgacccagtgtcctgtctgcaaaatggagatgattatgcctcgggaaattgtaagttaaatgagatagcataggatgcctagaactttctctggcagttaccattaatgatagcagttgctgttgtgtgggaatagaagatgataaaatgctcccctacatcttctatgtgacttaagccaagcagcctactgggctctgtaacacagcaggaacttgtgtccaaggatacaaggcccaaccacctgtaggactgacttcactctaataatggcagcaactatgtcctccttgcagcccttccaggttcccgtgcccccttaagagaaacatgtatgaagagggagtttgtacccttttaaataatttctaaatccttatctgcatataagccatcctgttaggcctaaataagttaacttcttccttgtaaaaactgtagcttattagcacctggaatcttgccctgtacttgggacaagtaaagatgcagaaaagatgtaaacaagtcaaccaacatatagatgaaagtgaaaaaccaagcaaggaaatgtgctatttgatttatgagcaaatggaaaaagaaaatagtgttttatagttgcttggaaaaagaaatgcaaatctaggaaaggaaaaaaaaaaaggaagagattagcttgggaaaatttgatgaaaacaaatttaggaacagagagagagagaaaaataaacaccagccacaactatttgtatagaatacaaacaaatggaaaatttcagtaatcattctgagccatgccctttgtactccaattttgaataaaggcaataacaaataaaggcattgatatcaaggacttattcccaaagcaatttccagaatactttttgggattagtgtggttttagatcaatttcatttaccttcatttttgtcctatgctacactggcaattaatgctcataaggatgtctcattcttttaaaaatgtaagttgtcaaatgttaaaatatttcaaatattcataaaggtgcatgtgtgtaccaacacccacttctatcaaatattaatgatatgtcttatttgtttcagagttttctcagaaacaaaagattgtggatactgtttaagccctttatttatccctttgctacccctttctttcctctctgaaagcaaccactatgatacatatttgtatactcactcttcgtatgtatgtgtccattcataatatgtacacttgttttgaatactttttagctctctttgaaaggtgttgtgctatacacatcgttcttcattcatcagttggtgtcatatctaagaattcattgcctaatctaaggttgtaaacatttacttctttgttttcttctaagagttttatagttttagatcttacatttagctctatgatccattttgggttaatttttgtttatggtgtgaggtaggggctttatttttatctagttgtcttagcagcatttgttaaaaaatactcttctccattgaattgtcttggcatctttgtcgaaaatcagtcataaatgtgaggatttacttttggactctcagttctattccattgatttatatgtctgtccttatccagtaccacactgtctcgattagtgtaattttgtagtaagttttgaagttgtgaagtgtaagtcctccaacttagtctcatttttcaagattattttggctttctgtgtcccttgcatctttgtatgaattttaggaccattttgtcaatttctgtgggggcttcggggagctagctgggattttgatagggattgcaatgaatctatagaccaatttcaggagtattactatgttaacaattttgttttccagtctatgaccatgaaatatctttctattttgcaggatcttgtatcctgcaagcttgctgaactcatgtattagttttttgtgaatatagaaattcctataatcctaagcattatgtattataggattaaattccttaggattttctatgtacaagatcatggcccagtctagatgcttttttttcttctcttgccgaattgccctagctaaaacctccagaacaatggtgtgtttagctttttaagatacttctagacctttcctcaaagtacaattttacactcttaccagcaatatgagatttctggttactctaaatccttgataatatttgatgttgtgagtcttttaaattttagctattctggtggatgagtagtattatcatgatttaaatttgcatttctccatgactaatgatgagcacttttttatttgtttattggccattcctctattttcttttgtgaagcgtttggtcaagtcttctcctcattttttaattgggttaatttttaaaagttattgagttgtatgagttctttatatattcttgttatgactcctttgtcagattctgagaacattttctctcaatccgtggctcttttattcattttcataactctggcttttgaacaataatttttcattttgaagaaatctttcactttttaaaaatggttattgctttctgtgctttaaaaatctttactcccaggtcaagaagataatttgttgttttcttctagagactttattgttttaacttttaattttagatctgtaatctacctcaagttagtttttgtgtgcagtgtgatatgggtgtcaaggctgatccccccaccccaccatattaatgtctgattgtttccagctccacttattacaaagactattcttccccattgaattgctttgaggcctttgctactgattttttttatatttgttgcagcttgtttggtggccaggtatgtagtcagtttttagattaatactccacaaaaagtgataaaaagatgtattctctatttgttggacagagggtcctatttacatgaattacttcaatttcattaatcgtgctattcaaaccatctctattaatttttgacttaaattttgtgactatgtgatctatcagtttctaattacagtggatttgttgaaatcatcaatatgtgttaatacttgctggtattttgagtctgtgttgttaggtgtatccaagttcttgattattgtatattcttgatgactgtcccttttatcattacgtagtgtcctactttaaccttttcccttatattctgttttatttgttggtaatattgccaggccagctgcctttctttaacattttcctagttatctttttctgtttttttctttcagaaacaaaagattgcagatactttataactttattttgagtagcctcttttaagcagcatattggggtttttttttcaataaaaatatgggaaataaaatctgtttctataatctttgtcttttaataggtgagttaaatctgattacattgagtgtgaatactgatatagttttattttgtattttctatttattaatcttttccttttttattgtttcttgtttctgcttattatcaagttgggaatgtttttgaagttacattttcttttctctaatataggtatacttctgttcttttagtggttaccctgaaattattattactattattattgagacaaagtcttgttctgtcacccaggctggagtgcagtggcacgatctcggctcactgcaaactctgcctcctgggttcaagcgattcttctgcctcagcctcccaagtacctgggactacaggtgcatgccacccagcctggctaatttttgtattttcagtagagatggggtttcaccatattggccaggctggtctcgaacttctgacctcgtgatttgcctaccttggcctcccaaagtgctgggattacaggggtgagccaccgtgcccggcctgaaattatttttaatatgcttgcttagcagtcaaattttataacaaaatctcaccatactatctttctgtcttctcaaacatgatacagtcctttgcagaatttaagtacctcctgacagccccactctcccacaactgaaaaacacttgtctataaatttgaatgtattatatgtggcatattaaaacatacaaaaatatttttgatatgtgctcataacctatgaaacataataacaaattgaatatcataaactcataagcctgccacccagtgcaagacctggaacattaccagtgctacggtataccccattgatttccctcatgtgagtttggctccaaataacagcagatgcaagtggtaaagagtacctctttgagtgaaggacacaataattaagggtttcttttaaaaaagataataagctcaacttagaaccaaggatggcttcacatggtctcattcaaacatagagtttgactcaatgattcatgcaataagaatctactgagtacctcctatgttcagggctctatgctaagtgttgcaggggagagagagaaggcaccatgttccctgaccacagagagaggtctggaaggtcagttttattgtctataacacactaactttcagtgtattgacatctagtgtttttatgcttcttctactaacattgcaattgacttagaaaaatgaagctatgtcctaatgtttttattttacttttttttctccttgaagaaaactattctgttgcttcactgcaatgccaaaaatattaattagctacatcagccagagcccttagggcttgggaggaaatggcttgataagaatatttcaggatagagttgcttttgagggtgcatttctgagctcatcaggggaaatttactcccatgtcaggaaatgtactcccatagggctccacacaccccacacagagctggcaggagcacagttaggagtggaatggattggaagtgcagagtggtgctgtggagcacgtctctcctgggtgagttgatgtgacccacagggaaagtcatattttccaatcttggctagaaaataaaaagcagaggaagtgttatgaggcagagattcaaatcaacatgatactgtctgaaaaatcaagtggccttttcttcatccatacctggaacacgtttacttccccagtgtgcagaatgtatgtgtttctgcttagagagtcccgtccccattcccgtcatgctgggctttccaactggacatggaaatggatccccacagctgtgacctaagctttttcttagcaaggtcacacatctcctttcaaagcctggccaagatggtgaaaccccgtctttactaaaaatacaaaaattagtcgggtgtggtggcgggcatctgtaatcccagctactctggaggctgaggcagagaattgcttgaacctgggaggtggaggttgcagtgagccaagatcgcaccattgcactccagcctgggcaacagagtgagactccatctcaaaaaaaaaaaaaaaaaaaaaacacaacaacaacaacaaaaaccaccttattcttccatgttgtagggcatgggttttctggaaccattatattttggggattttatatagtggagatcacatggcctcatagggagctgaccttcacacattaagtgaaatgactgagggatggagatgttcagactcagtaacttgctgtggtcagcatttcttttgctgtctgtccttactgctgctaccaggttgtgtcttctacctcgtccagccagtttcaaagaaccatagagttgttaagaattttcatctaatattataggtaaaaatatttatggtgctgagagatagtaagttacttaacatagtgattacaaaggccctggggtcaggccagcctcggttcacatcttgctggcagtgcagctatggacaagttttttaaccatctaagcctcagtttccatgtctataaaatagggataatgcccaactccaaagagtttctctaacgggttattgagtgagacagtatgtttctagtgcattcagtatagtggctgccccttaaaaaactcccattaaactatagctgtaatcagcatcactttcctagggacatttaaggaaagttctcagaccattttttttcagctcaaatgaccactcccctgatcaaattggccacttgtttagtattatgcagacagagcttatgtgatctatatatgtggtctgctttagaagctccattaccaggtgtttgcttaaagccaaaccaaatattccaaaaactggatgtttaatggtagacattgacaatccatttgaagacacatagatacaccctcatttagaaataacgctagtaataatgaacacctatattgccttattcaagatgaggaaaagttagtttttgttttcatctttttttataattagccatcaccagataaagtagtttcattctaatttagctgtcaaagacagattattgctatcctcaaaaagatatgtttcagctttctttgaggtctttgtagttacctttgaaaagcaggtatctcttgctttgtacaggtccaatgtgcacagatttcatggtttacttagataacaccagacccccaacaacatgtttcaaattgcggttacatcagtgttttaactgtgaataaatgcataaagcataaactttgcagctggctcttcagtccacaaatcactatgtaaataacaaatgtgcagcatcatcagtaacttatcgctttttttaaccataactttttttagccaaagactggttggtttctgcctatctgttattcagcctaagtacagacagcaaagcatgtagttgtgttgcctcctatctctccgtgataaacccaaatgacattatgcaaaaatagatcattgaaagagggaatgagctaacaaagatgaaagtgcaatgaagagatgcaaaatgataatgctgtgagtgaaatttgaattgaatgtaaatggacttagaggagaaatagttgactgtggaatgccgacactgctgtctttgagagattctagacatgtagctggtagaagttagtgaatgcaagttcatcaacataaatgaggacagcggtgtggcaaaaaggatgaagatgtcatagaggaagtgaagccagcaaaaaacttcacattaatgaaaggagctctggggatattgcatgatactgaaagcacagaggataaaatgtcagcagctgatccaaagttaggagtatgacaatttgccaaggcataggaaagatgctcacttcgtatcgtaacttatacaactagaagaaggtggcaagcactgtccaaactactcttgataaatttttttaaatacataaaacatcttaattttcaatgtttctaatattttaagttacagtatattaaataaattttagctttatattttttcatttccctatatatttataaccaagaataagaaaattttcagtatgttgacacaaatttttaaaggtcacaaaacaatcataatttttaccattatttattaagatagctttacatggtcattttttcatttttatttttatagaatataaaaatgcagatttcttgcatgcatatattgtgtactggctttcagtgtacccatcacccgaaaagtgaaaaatgtacccactacgtaagttttcaaccctcgtgcatggtcattattacagtctgattctactatgcaaagtgaggattgccgatagctatgttctgactacggacagaacacaagttggctgagctctgctccagaaagaggtttcctcgttgttccaggcttcagcccagatcagttctgcatcttctcctcttttgctgtgtttacaagggtacagtgagatcgatgtgacaaaactacttccttctgcttgttctcctgtgcttggattcttgtccatgctttgtttatctgtggtcaccacttattggtgcatttattataattatctgcttccttgactggagcccaggggaagagactggcctatggctatttctgtcatctttttattcccagttcttaacatcttgcataacaagtcatcgataaatattctttgaacgaatgttgaggatattattttgagcaagcacaaggtcagttagctgttactctttacagatcaagttcagttataacaccattagtaatgatttttcaaaaatatattttgcagaatcatttatatgagttaatcatttattgacctcagttaatagtcaataaatcttaaaaaatggccatgtcaaagaaatcagaaatactgatacacagaatattaaagctgaagagggaatgcattacttaagttttgttttgtttttattttttagttgcaagtaataactgccttataccaaaaaagtacataagtaaataagaaatgtattagaaggatagtgcaattttttttttcagactccaagaaagagttgaaaagggtgggtggcttgcgaagggtgtccatgggccatctctgagccgtttgacatcagcagtttaacattcttccatcagtatctctattttttttttttttttttttttttgagatggagtttctctcttgttgcccaggctggagtgcaatggcacgatctcagctcactgcaacatctctgcctctcgggttcaagcaattctcctgcttcagcctcctgagtagctgggattacaggcatgcaccaccacgcctggctaattttgtatttttggtagagacagggtttctccatgttggtcaggctggtctcaaactcccgacctcaggtgatccacccaccttggcctcccaaagtgctgggattacaagcgtaagccaccatgcccagccaatatctctattcttaatgggccacaggtcccagttcctagcctttatgtctctctgttcaaattccaaattcccagaaacagaatatcattagcctagctatagcctgggagatgggaacaaagagtccaatttgggctacttggatctacttctttcctggagaaggtattatttttaagagctaggcagatatttttaaaaggtgattactatagtgttttactctgaagtatatattctttattcccataaattttcactttgcttaggaattgaataattgaaaagcagtctttctaaattttttataaataggaaaaaatttaaatattagccaaagaaattctctcctgagtgccttaccatacctaaataataagatctgttggccttgcaacagatacagattttattattcaggtatggtaaggccaacagatctaggaacaattggcattgaaaaaatcattacagttcccagagcaggaggcacagcatgccacccagggccacactgggaagcaccgcagtcagtcaggaggcacagggagcgggaggagatcccgggcaagagcctccactgtggtttccatgggaaggcttgggtgaggcagggtgagcagggttaggctaggctagtcggattaatttcagaaaggtctgggacatattggtggttctagttgtctggtacctggccctagggtgattagggttggggaattgtggcctggagtgtaagagccaaaggtggtggtggttggggaatgggctctggattggttgatttgcatatgaagggcatgctcacaggagaattgtgtgctatctctaggaattagcaaccctgagaagggcagtccttccagggtcagcaaagccccagaagtcaaagcatcagaaacacagaaaataaaaatatacaattaatacagctgtccaccttcaatcagttttgtgagtttccatgtgaaatccagttttgtaacaccttcaaatgtcctagaaggccttatcatggtctagccctctgccgtgaacctgacctgctcccacccttttgccctcacaccctcccttcagtcacccaggctcccttgcagtccttagaacacaccaggggctcatagaactctgcctggaatgcttttccttccaacataaactgggcttgcttttctcttgccttcaggcatttgctcacacgtcactttctcagcaggacctattctaactgcctacttccttctgctgccggcacccactcctgacccccttactctgctctgccgggtttcacatagcacctgtcatttattaccattctgtataatgtgcttacttaatattctatttattgtgtgtgcctctaccactacaatgcaaagagtctttattttgttcatcaacataccataagcagttaatagcagtgtttctgaaaattagtgatagctgttgtaatgcccaacaagagaattgttatattcttactgtattagtcaaagattgaggcataatggtgtcaaggaaatataaattgctgagattcttgtttagaaacccataattcagccagacaggtgagagacaagaaatgtttcaccttttttgacttctaggtttggcatattgagtttcttgtgttaataccacagctacaccaagtaaaaggttattgactttttgcaccaaccagtttattctacctgatttttctcattcaggcttccttgttaacagtttgatttgaaggctttcattatcaaaatccacaaggttgtgtccttcatttttcttgggagagccacctcctgtttcttcctggaaggaactctgtggctggaaatgttaggagcttcctgggctgaagaagttcagaccctagccagtccagggtgctcctaacaaatggcatatataatatatccagatatttattgatattaaggaattattggggaggtttagatatgaaatgatattgtggtttgttctttttaaaaaatctttatctttcacagatgcatatggatgagataaaatagctgtatttgccaccatctattataagagctaggaaaatgggtagggatagagatgaactcacattggctaggagttggttattgctgaagccgggtaaggagtacgtgagtttcattatattattgtttctacttttctatatacttccaattttcaattaataaaagtatttttcagctgggcatgtggctcatgcttgtgatcccagcactttgggaggccgaggtgggcggatcatgaggtcaggagttcgagaccagcctggccaacatggcgaaaccccatttctactaaaaaaatacaaaaattagccaggcatggtggcgggcgcctgtaatcccagctactcgggaggctgaggcaggagaatcacttgaacctgggaggtggaggttgcagtgagccgagattgtgccattgtgctctagccttggtgacaagagcaagactccatctcaaaaacaaacaaacaacaaaaaaaagtatttttcaaatgtaatagtaatgattggacaatttggcttgtttctgattttaagtgaaacacgtttggtgtttcaccatgatgaatatattgactattgactcaaaagctcttcatgttgagaaactacccttctattgttaattatttaaaccagacgtgggtgcagaagaatattgagtgccttaacgatatcttgagattactataggtttttcttattagatctattgctgggaggtggttttacatgttattcatagtaaagccctcttgcatttctcagaagaccccacaggtagttattttttcatttctcagatatttgctgaacatctaggaagtgccagcctggtgctgggcatggggggtacaagcagggaacaagccaggccgagccctcactctcctgaagcttacttctccagtgagggagatggaccataaatacataaatgagctcaggtggtggtagggtagtctgtgtctttctggctggcagagaatctgtgttcctggacccaagggatgttgagggggaaactgtgtaaagtattgctaccttcttttctgtgggtggaattgcttctcaatgaggcagttcatcaatagaagcacttttccctcgacttagctccatcagctttacatttcatgatcattctttccagattctggcaaagattggatgttaaaattcatttttgaggttgttttgagttcccttacttccttatgtctataggtattttagtgctaagttcaaagaggtggcctccagggacttaaaggcaaataccacttgcaactggaatcaaatatatgtattgtaaatgtaaaccataatctaacctgtgttaactatctcgttaataattttacttatttaaaaacaaagctaattaggaaattagaaatacttgtaattgcagtgagtaacaatcaccaccagagtgaatgggcaccttctctgttcttattcagttctcagaactaacttatgtggcactgttctttcactcttagagcccagaaactgtaggccaaagaggtgaaataccttgttcaaagaccactgtaaccaactggaggagctgggatttgaaccctggtagcttccctctagaggccccatttttaaccagtataccataggcctggtcttttggttgttttggggggattgttttggctttgttttagacagggtctcactctgttgcccagctggagtgcagtggtgcaatcatggttcactgcagcttctacctcccaggctcaagtgatcttttcatctcagcctcctgagtagtggagaccacaggcatgtgctactgtgcctggctaatttttttgtattttttgtagaggcagagttttgccatgttgccctggctggtcttgaacacctgggcttaagtagtccactgcctcagcctcccaaagagctgggattacaggcatgagccactgcgcctggccactaggcttgtttttaatagtctctatggatgatgatttatttcaagatgccctttttgttgtgtttcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtaccttctctaatttaatatgcttagtaaatgttcactttacatcttaaaacgaatatcatttatagatatctttagtttatttcaaatatttttaaaatatgcgttgatgtttttaagcagtgtatacagatgtctgtggtgaaagctatagctccttcctgtagatttctctctcctcttctacttttccacatttgagttgtactaaatttagaggtgtgagctgggctcccctgataacttcagggtattccccccaccctgtgtattgctcataaaaaacattaaaattcacacagttcgcattacacagatacggtttggatttaaactagctattttaatcttcattattctctcccaaaatgaacatcggaaatgtgtgaaatataaattttttcctgcctgacacagatgggtagatcccatagcaggcttcccagtcatggagtgaatgcagccacttttgcagcaacagaaaatcttccagggaccaaaaccccctgcttgtttatagaaatgcttgcactctggggaggaaacacaggcctgttcataaataaatgctcagtcataagagttagctctggatgaactgattcatttagcagaagtggaatgctttgaagctagatggaagaggtcactaattaaatgctagaccaagacagagtccagttgcatggggagctggaattttcttgaatgttagtaagtgaaataaaaggtgagaaaatggctttttagactttggtaccctgacaagaaattagtggattaagagaagtttcttatcgcaggcatcatcttgctattctttgatgattttcagtttcccaaagaagaatttttcttaagcatctgttttagatatgttttaatggcttcaaataatctcatctttctgcataaacatatttttctatttaatagtgtatataaatatacatatagtatatcataaaatatctggatgctatttttagtattaggaaatatttttgatgattttataatagaattgggtcttgtaaaactaagtatttctgatttttcttggccttcacttacttttcctatgtagttttgtagtagaaatatcacacttctttgttcctatatataatcacttaagataagctttacttaaaaagaaaaaaccaacaggaagaaatcttttaattcaggcaaaggcccagtttagcagataagctttacatttttctttgaatataaataaataagagttttatttcctaccaaatatatttctgtgttagctgcacagaaaaccaatagcggtctatgcagtttagaagtcagatgtacatatctggcagtgtgtttcctgaccattattggtcttgttgagggtggccagattccaaatgcttgactcccagcacacattccctggggagatgggtgggtgacacgctcctggcagatgtgcattctttgttgtcacctgtggtgctagatccctcacccttgagctaggactggaccttagcctaacatgcgtccttgagcctcagccccaccttctccttagtcctctcatccaggaagaggcctaggtctctcttaccataccggttcctttggagagatgagagaaaagagacagcagcaggaagcaacccaaaagatggaagccagtcccaaaagaaaccaagagagtgtgtgctccagcccagttatgctcattacatgtttcagcctcttgcctaaaacccacgccttaggatatagcccagcagtgtgtccatgatgcctgctggggtgggaaagactgaatgaagttgagaagtacttagtgtttccctagagataagaacatgcctctaaaacactatgtattttttcattaggtgctaactggtatttccactgagtatccacccagtaggctcctgagtataaaataagtatagcttcaccttagcaggacctgccctgtggggtggctgactgggaagtagcctgtgctggcattggagggatattgacttatgcctcctgccccattgtgagttaatagcattttctccaaaagatctctttcaaataccatttatcaacagaggaaacttcacttcctgggaatatggcagccgatcatttccgggagccttccccccacacagtgtgagggctcaaggaacaggacatggagaaggtacattttttgagaaaggtcataaaatgttggagttgaagaggatgaagcaatacgagctggctgtcccttggggagtggtagttcaaatacattaaagtagagaggagcagaaatgcccacagccagagagaaaaacaaatgcatgttgtttcacaaattactcaggagtaattctgttcttggagatcatggttcccttccaagatatctcagaataagcagaggccagaccaagagaataggtcaaagcaagctgctgattcacacctagattcaagtgtgtgggcctttattaaaagtttgtccaatttacaaccccctgaccagaacagtgcagaatctgggctgtagcatggcacagctaagaagtttcatggacctcaaaattctatgtcctgattattttggtcctgtttaattcctagggaataaactaactatatccaggtggtcctagtacaacaaacattatatggtgacaggtactatattgcaacatttctcagccccagctgatgatcaagttgtttaaagtatttaagcacaaactacagcaggactgaaaaattgaggtggctctttgtaccacctttaattggctttaactggcatttgtacatccagctgccagcaagtgctttaatttttatcataagctcaactttctgaactacctgctattttaaaagaaaaaagatcaaacccagtgagctcccccaggtacatactgataagaagaggattgtaggactgccaatttatttttgttttgaagagtggagtttcaattttaaaaaatggaatttaagtggaatttgccagttttttaagtggaaaattggcaggtctgacctattggataattgcctgggagttaagagaaaaaaaattttttaacgaaatgaagagattgtcctaatccacaagggcatctttctttgttgtcttctctgtgttttgagacgttttctttagagaaagatttgatgttgtatcattttcagtgtgaagaagttccacattcatttaatgtaacaaagcccagatcaccttgtttgacttggagccttctcattgcaggtcgatccgggccacaaatccctccgagcacacggtgatcctcgcagtggtttcgcgagtgtaagtgcacctcccattcccagatggaaggagtactgttcattctgaaatatttgtcagatgtaatctggtttttgagctatctaagcaatgggtgtgtcttgggtcctagaacaccagccttagatcttgatcttgctttgggggttttgtttgtttcacaagttcctggaaatatttaggtttttctctgtatcttgtgtaattgcctttagcacctagtcatacacctcagggagaaagtttactcattatatgccaaaaatgaatggaaaatttgaggaggaggtggtctggagaaaacattgttccagtttatctcttttttttcctttgaagaaaagagatggggatatgcttgtttttcatttaagaagaaacacattttttttcatattcaagcatgagaacaaaggggcactaaatccacaagacaagggttgtgaaattgatgttgggactgatatgtggctagaggcaggacagtagagtttatccaatgctggaaggcaaagaaaagggattgcgctgtaggtgcaatgaaactgtaggatgagcgcttgctctgctgggtttatcgtctgaagtggccagcacttaaaataaaagagccagcaggaagaaaagttgtctgtgcaagctgcagtggtagaaatcttggcaggtaacaaaatttgttgtagtcttttaatggctgtatttagctttgcagagaataagaccttatttaggacctaggacctattggatttggctgcattatggcatttggcacaaattctgcgacaaaggccaggaaagtctggcccaggggacttgaaatgcctcattccaaagccatgtggatacaacaggaaatcatggctgcaaagtcttaccctcactgaagactcctacttacctgctactccttgagtgtctccctaggggctatgtcttctcactttgtttgatacccaccatgggatgtggtccagagaaagcagagacattgtcctcactggttcattacacctctccatcctggtgggagattaagattccacagggaatgaatgaggggaactgagacataagatcagcatccttcagccctcttttttacatttatcttctggacactctgagatctgaatgaggtcatagagtcttggacatcaataccagaaatgttcaaggccacacagcatttttcccaagcctggctattacacgggtccaagaacaaaatactcttgtttttctgactcatatggcaaaaaggtttgctagtccttgacaaataatggttgactatggcttatttgttatgatgtcaccgatttttcctggtttaattatacaatagttcatatagagagagtagtaataaaatgaatgtgtgtgtctatgtcacccacttaagaaataaaacattattaatacccttggaaccctttttgtggccttcctaacagtcagagaagatagaatttggagttccagaagaaaaagaaagtgggtaaaatagcttttcccttagggcaggaatcagctgtgggtaatgccacaagtcagcactgggacttctgttcctgttttctatctgcgtttccacccaatcccttttattccatttttcttccctggttcttaggatatgtcccccatgttacttgctggctgtctcagacactgtttctctatcttggtgatagagagcccagtgatggcatgtcttcatgacaagccaatccacatcccaccttgtactcaaactaaagtcctgagactcagcagtaagctcactatagcaaaccctcttgtgaaatgagtagcaattatccatttttgttttctctccttcccttctaactgtgtgttcctgctgatacttctctcccatttggattgggggtcttgcagcctggaatgctggctgtcttcctcatgttgagagctggaccagctcggttttggtgtgggagtcatacttccagatggtttgggaacaattgtctccgaatgaacagtgcacgtaacatgtccctttatgggactgctcccatacatgtggctcaaccccaaagggcagctgagttggaaagggccattcatgtgtactgagggtgatacctccaggtacactgctggagctttctctgctgtttttgttctttttgcatctggaaggtagatgtggggtctgtatccttgaaggcaggtgtgccccgtgggcacgtgctcgtcaggaagccactcttggagctaacgctgtgtggcctcattgctctctctccgtgtttcagtgtgaggaatcctggtttgtatctgctgagtgaccacattttctgctttgctgcagatcggatgaccatgaagaggcgtcagtccttcctcttctccacgcaggcttcaacagggtatgtacaagatatccagcatctctctcagttgcaggcaccttaacccctaactctcccataacagggaagcaaagctgccacggagaactgttaaggaaattaagccccaggactgttggggaaaggaagaaactgtgttctcatgggaaagtaacgagcagctgccagtcgagctctttgcgtttttgctctctgggttatttccatatatcttagcaatagatatacaatgacataaaaacacatcttattatatcagactaaaattctgtcatcctaaagtaataaagtaatcttatttaaatcagtacagtcaattcgatttaatgtgtgtgtgatcatacatagatacatccaccaaattggcacccaagattctgttcatcagggctggccagagcttctaccctagggacaggcccatgatgactgtagcatcctgtaaactcccggttgaaaccattaacatcagcaaagaaaaattctttgagtgacaaactacacaaataacactgagattccacttgaagattaagaattactccaaggaaactcactaacaaactaaataaccaagctcacccagcatctcagggtagaaattagattggaggcaaagctgtgtgcctgcaaatggaaaggaactgatagaatggacttaaaagagaagaaagagaagaaagggaggaggaaaaagattatcaaaacatgaatgtttaaaagaactatattccctaatattaaaaagaaaacaagtccttatagagaaattgtggaagaccttacttcatattttaatttttttaaataacaaatatatatattactcctatgtaaaaagtaaaaggtttcccttaggagaataataggatagaggaccatggtttacttatacagcttttgctgataatctaaacgcaagtaatcctatagcatcctgtgacctcctggcttaaactataaacatcatgaataacactgatattcaacttgaagattaagattggttactccaaagagacttaccaaaaaaactaagtaactaggcatacccagtgtctcaagatctcttggtaagagtaatctgaatcccggccgggcacggtggctcacgcctgtaatcccagcactttgggaggccaaggcaggcagatcacctgaggttgggagttcgagaccagcctgaccaacgtggagaaaccctgcccctactaaaaatacaaaattagctgggcgtggtggcacatgcctataatcccagctactcaggaggctgaggcaggaaaatagcttgaacccaggaggtggaggttgcggtgagccaagattgcaacattgcactccagcctggacaagaagagtaaaactccgtctcaaaaaaaaaaaaaaaaagagtaatctgaatcccaagtaggtggagtgatgtatttcttaaaaaatagggtactgcgtgtgccttgtgaattatgaaaatcctctgtgtgctttaagtaatggtactttgctactcctggcttaaaaatatatatatatattcctgttagttgtagaccacagagaagcaaaaactacctttgtgatgcagttgttttgtgctttggtatgcttcagtgtggaagaaagtgctatagagaagattcaaggtagtctagtggctcacgatgcgtgatagaaatgaatgtttccagctagcaatatttttcatgctcctaacacttttttcttgtctgttatctcttctcacaaaggttggcatttggttctgaaagctattcttaggtgctatatcttaatgagaatgcatgagacaatgcttctgagtttttggaatgaagagttgcaaaagaaaaatcagcaaagaagccatgtggttgagacagattttctttactcactcattttctaagaaatagctctaaaattattcacaggcttcatagaacttctgtgtaatattgaccccccgactctaccccattccaatgtcatccttttcaagtttgagttgggacctcatggagtgtgaggacatagattttcctcattacctaggagatgattggagaatggcaatgacacactgtgggttttatcgatcaggacccatgtacgtgctgttgagtgtccttttggaattctacctttagttcagtgatccaacctcaaactggtctagaattgctgccatctgaagcgatagcatcttgtctggaaggctgagattgcacatctgctcacagttaggagaaacaactggaactctttgggtgcaaatgctattgagaaaatttaaccaaagttccattgtttccttcttacacattttacaacctgtccatggggctctggaaggcttcatttgccactatccagacatgttactgtgttttgcagtcagcctcagtgaataaagctttgggggaggggcatgaacagcggtagctgtcagggaccacctggtgttcttcagtgctggccctgatagaggccatttgcccattaggtcagggtgcccccagtagcttgggctcattccaggagaagcacgctgcacctacaacagctctcctggcattactgtggcacaccatcagctgagactgatcttcatgtggtggttctccttttttgggcaaaatcctgtctttcacaactctcttcccaagcaccttttcaaatatgccagttatctttgccttccatgaagttgtttcccatctctgagctggtttgattgtattagattatctgctgaaactcacccctgtgttgctagctaattggctggtgcttcagtctgtggtccctgagtggggatctaggaacaaattgtgccatcacatatcccacaacaactccccttgaaggctctggagctatgtgtaagcagccgactatatagatgctaattccatgctgagccttttagaaaccagcatcttagcaaaggacagttgcaactgtttttatatcaactttatgtgcctctttttctatttgcaaaaatatttgttcaatttaacaagtgtttatggagttctgcctctgtgcaatgtgctaggcatgccgggggcacaactgtaggacacagttctctgtggagaggccttttgtggagtaggaagtggggagctacgatttattgtcaggcccagttcccagtgatttacttaatcctcctctacatatgagggatttgatattttctccatttttgcagaggaggaaacaggctcaaaacaactaaacttgccagagctcacactcatgacaaagtccagaagcaaatacatgttgtttaactccaaactctatattgggttcactaaagttagatttcccaagctagtgttccacagaacaccactgtaccaaaagctattaatacatggtccatgaaaaaagccttctatgatcaaataagtttggggaatcagtgaaaactcagtttccccctcctctcacacctgagaatccacagagcacttttgcaacattgcatattagcattttaaatactctgagaagtcccatagtaaagaaacctgctaactttgtttatcccaacattttctttccattttttgcaaaaactaatccatgtttgttatagaaaatacagataagctaaaaattaaaattatttatgccaccagcctttcagatttatttgtaggcagaaatagaaatgactgtgtattatttacaaaacagtgtcgtgatatacatacatatctttctatgttattccagcattttcaaaacatattttatcatggttttttcatgtttttacaaaacatgagctaacaactccctgagttctgttataggctgatatatagcttttatccatctaaaagctcaaatggaatctaaccatgtttaactttgctctgtaaatcaaacagaaagtatttcccttatgtgtatgtttatggcttcctctccttccttagctcttcccagcttccacgtaagaattgtggaggaccagaggcccagggaaagccagggagaagccaaccactccagatatgtggagccaaccactccagtgtatatgtggggtgtgtgtgtgtgtgtgtgtgtgtgtgtgtgtgagagagagaggaaggagtgaggagagggattgatttttttctctggccaacttgggtgaaggaaatctaagaaatacatctttcagcagggcctagtattctcctcctccacttatatagctaccggagaagcaaaagtatgtgactagtagtttggaatactttggaattctgcttatctttctacttaatagtttgccagccatatgcttagaaaggtttgcatgatatgtttttttaatcaattaaaatgcataacatttcccctttcctaagtagaattgtccttaaatctcttcccttactattttttacttgcttttttttctgatttcattatttctcattaagtattgatgtgatcatgtcagagaagtgctcaatttcctatataccctacactgaatcacatagcatatataagaaatgtaaaccaaattactttgggattaagtgaaaaagggcctactcctctttaaacgcgggacttgagcagctcatgcctagcataaataggtgcttcgtagttctttgatgaatgacaatgtgtgctgcattttcttctatgttattatttgcttatctatctgttcattcattcactaagtttatttataaatacatgaaagccttttttttcaattgagatgaaactaaaattagccattttaaagtgaacaattcagtgacacttagcacatacacagtgttgtacagccaccacctctctctagttagagtgagaacctgttgcaaaacaaacaagcaaaaagccattttcatcattcccaaatgtgttcccattaagcggtcactcctagtcctcctccccacagccctgacaaccaccagtctgcattctggctcaatcaattgacctattctagatatttcatatacatggaatcatacaatatgtgaatttttctgtctggattctttcacttaatacatttttcgggttcatacatgttgtagcatgtatcagtattttattcccattttatggtcaagtaataatccattgtatgtatacaccacaatttgtttatctgttcaaatgttggacatttgggctgtttctgccttttggctatggtgaatgatgctgctatgaacacacatgtatgagtatttatttgagtacttgttttcagttcttttgagtatatacctaggagtggaattgctggatcatatgagaattctgtgtttaacttttcccctgcattaggcactcagaaaattaggaaggaagtaaagagtaggctctcccttccaaagagatcattgataatgtggtgcacactgaacatgctgagtgttgggttttagatgattttattagtgcaatatgaagcaaagtgtttcagtcatttacatggctgggcaggcattccgtgctctagagcattcataatgtagtttattctacctttgttatgcaggaagtgaagtgtacagtattacttgctctgttgtttctcatacatttaaacaagcactttgaacaccttgacagctgtttcatctcatcttacctactaattgtcttatataacggagttacctggggataggaacaactgttaagtttctctatttgactctctaagaagtaattatatatgtcttatgtattgtctttgctttcttttcagagatttatggagaatagcagcataattgcttgctataatgaactgattcaaatagaacatggggaagttcgctcccagttcaaattacggtatgtagcaaaatgatacagtaacatgaggttaacaattctttagaaaatcttatctgtcaacaggctgatgttcaggggttcatagctgaatcccagggattttgaagcttttaaacaggcaatgaatggcagctggccaacagcagtatctaagccagaaggcccattatataaagaaataaattggaagcatttcttcttttgacagtattttccactatttacagaattttaaaattgtaacctgggaaaatgcttaatttttgcacaattagatcgagattaggaatagccttgagaattattttctacttcctactttcaatatttatacatttttacttggattgttacgcataggggcaaactaatggcgatatttatcatgctaaccataaaaatggctaagtaaccacaatagcaattttattaagtctgtttgtggcctcaatatgcatgaagtagctttaagaaaccagttttaagtctctttacaagcatatagtgttttaagagcaggcttgtcattggtgctcaattccagggatgggattctctgcgtgtctggctgctggccagaatgctgggctgggggatgttctgctcctgggccctcttaggaatatcagggtcctagctcctgcctggttttgctcaggctccactctggcaggctttttggaccctgatgttttcctctcttctcagccagagagcagggaaaggaggaggctcttctccacccgtgggccactgcggggcccagtccccaggagcttcaggctgtgtgatgccagaaaattctgtagcatggcctctctctctggctgactgagaagtcatgcatagtttgaggctcaacacaaaataagtaggagagcatcctattatagtaattatatgccttatcttgattacttattgtcattcaaagacgacaaaatccttttcaaacttaattatcctccgtcccagggaggcaaaatgaatcgacataaacccagagaagcaggttcccctggggtgcaccctggtcagggaagtcactttttggtgggtagagtgatctaagaaataaagtgtggggataaacagtcactttcttaggtagaaaagtattaaaaaaagaatctcaaaccagtgggaaatcagatattttgggacttcaggtatttttaacagcccttggtaagaaatattgccaaagactttttgagcgtataagtaagctagatcctgtggtttctttttatgtgtatgtcagcttcagagaacttcacagaatttttctagaaacccatgttgcctgtacttctgtaatttatgccttttaataatgtagattaattgttattattcctgggggtctctactgtttttaattgaaggttaaaagacttagtacttttattttagatgtttacacaataaatagaattagaaagagggggattttactgtggtttaattcttcaactgtgtattacccaccataaaaaatgaacggcgcaacacctcattgcattgacaggcaattccattatttgattttaaataagtgcttctggttttttaggcaacattacatgtgatggcatatgttaggtgccaggagatgccctaatacagattctgcagtgcacatggggcactggggggctgtcccaggaatgttaggggcaccttgtccatgatgagcagggcaaaagcaggcctggaaatttgaaataaatatccccagccaacacaatagcataaagaaaagccttcaggttattgtactgctgaaatctgtttagagccagggcaccaaagactttttaaggtcttatcagattcagaactttgcaagtttctaagtacattatgtaagtactatacttctgacccctcacttactagaactggttgggggcattggacccgttgttgaggtcataatgaaaaggctcaagttcttactacaaatcagtgtcaaattggataatggacttgacccacgaaggtagtggccccaggaaagaaggtttgcctggcacagagattatcttgccttctgcacaagtttcagctgttgctttttggtgggttctgcctcaaccttattcaagttatcgcccttttgggtgtgtgtgtgaacatgtgcatgattttatgtgcatattcccaggtattctgtatctaggcccagcagataggggcagtgactcatgccacggcctctccccagctccttagggcactcagggacatctagcacatatacctgcaccccaaggcaggcaagcaactctatcatttgttgcagactgggaaaatgaggctctttattatacaatgctagaataattatagtctaattatataatactttcccctacaattccgcccccagctgcagctaaatatgtatcattactgtcattctgcaaggacagtctgtactgcaggatgatggtgaatgttaaaggtagacacctctgcctaggtcccatgtcaggtgaccatatttacttaaccgagaaacaaaaaggatcacctgatgtgatcaaacagaagatgtagtctaattttaagattctattatataaaataacttaaagatataagaactaaatcacatatctgtatgcctttgatgaattactctgttgaatagaagaatttatgaaatggagagcgtctaggataatctagattaaatgatgactatttatctcttctgatgttcttacacctctttatcatgaaaagatctattttatctaaaataaagataattatttagctacttagcaggagtttgggctgatcgatatatactaatgcagtaccagctattgtttgattcattagtcagtctagaagttacatccaagtcattatgtttatttcactccaaatcttaagacagtagcaatcctcaattttagaaagaatcaaaatttttggtgggcaaaactctgtattctgtggaacaccacatctctcagtattaacagacatttgtagagcactttattctcatatgggctctgcgtgatagccattgtgtttcaggggtggaaactgagctgtgaaggcttaaaataaccagtccctattgctttattgcccagtaatgagtgccaacaagtaacaaggtcacgatcctctcacctcttccactccctgctcccaactcatcccagactcctgctggtatgtggacttgtgttcagaatcttttccctacaagccaccgccttgcccagtcctacccttgttccaggcagcctcacagtgtgtgtgtgtgtgtgtgtgtgtgtgtgtgtgtgtgtgtgttgttttagtggagtctagatagagcacttttggaagggacacaggagataatgtaacccaacaccctggccatgattgacagaggaaaacactgagaaccatcacagctactcagcatgttggtggcagtggtggagtagaatccaggcatcctgctttttcagtctggtgcactttccactcagcatagcactatattatttatagactttatacctggacccctgtaatatttaccttttctctctggaccttcgagggctcttaagaaggtgcagggaaagtggtgatattacctatacttcatgggttcccacaactaggttacttttcccttgtgtttcttttttctagttttccaactttttaacctgaagaataaaacataaagatacctgagacaaaagagttatatggttcccaagaacagatattaataaagctaaggttcttctgccagaagagtatgaataattaatacaagcaattaagttctaaaactctagaaacatgactcaagttgattatctcattttgctgcaggtttatttaaatagaaccatcaaccaaagaggttgagagcctgaataaacgttgtggtctggtagtgtttgttgtggggggcaggggtgggaaatagtgtgttctttctaccaatatcctttcatttcaactgttgataagcatttactttgtcttatggggctttatacttattgaaaatttcatgctttgtggataatcataaaatgaatgtttaataaattttggagattggatctaagatcatgtataaaggcaacctcttgaattgatgaaaatgataatagtctgaagtacctgtttatatacttagttgaaacctgtttacatagttagagaaaatacttaggcaagagaggaatttgtcatttgataaaatgtgttaattaaagcttaattatccagctctcaaaattaacaaattagtccacatagagtgtgtttctccaagagtgacttctgaaagacagctgctgcccaggaaatccttccctacagtgcttcgtccagttttggaccaggtgcctggaaaacactgttgataagactagctcttgctgtctcttatgaggcagtgcagtgacaaatttggtagcagttttaaagcccccttttattcttgtttcttattttaaattgtgtttacaagtggtggtactaagacagtatacagttcaaattaggtagactggagcaatttaaataagaaaatatactactgcgcctgtaagccatttcagttgagttaggttaatattctcctctgctcttctaacccgtatcatgattacttgttacacttaccttctcacactgatatcttcatttctgcaactataggaatggcgtcttgcagttggctaaaatattgcactccgcacgcatacctcactattattgaatacagttcttggtttgacatttcaggtatacttatgagaaaagataggttacgattcatttttttcaccaaagccttttgaaagccttagagaacaaagaagtattactctgtgatcttaaacataacaacaggtatctacatgtgttgtattctcatattgtcccaagcacttcgagaaatgcctcacataaactatctgttttgatctttacaaaaacctgtgaaatacgtattattatcctcattttatggatgaggaaactgagggccattgaagacaaaaagttgcctcaggtcgcataactggaaaaatacagagccagatttcacccagttctttctgccttcttccctctaaacggatcaaaataggaagacaaagttagaatgcctttatgagtggaaaaaaataacatttttcagagtttttttttttaaagaaaaaacatcaatccagtaaatcaacagtttttttttattttgtaatgtgtaagaaagctttttattgggattctttaaacagtcagtataaataacagagctctagctacatgcttgctgtgttggacagtaaatagcttactgtatttggagttgctctagattaggaaattagttaaaactatgataaacaaaatgagagtttgattccaaatattccagaaatatagggaaggtcaccaagaaaagtccccactggagagctgcagaggtgcaatgaaccagcaaggggagttctgctgggtttgcctttcaccatgccagggggaatggttggaagccgagtaacatcacaacagcaaaaaaggagaaaaaatgtttttgtgtctgttgcaaaaggccagaatacctcacatccaatttgggcccagttaagttctctaattgttggagacttaacttctccatgaccacaactgtgaatgaaacagaagaacgtcattgcctcgtgttagtgttgaagtttcattcagcacacacatagtccattccatgatccacgaagatttcactgaattacaattctttttgtatcatacacacagatatatatgctattgtttatgcatttagtttgaaagattagtttttttccctcaaagcatattattaaccctcttagtctgttaggattgcaataatgaaatacagtcatgcatcatttaatgatggggatatgttctgagaaatgtgtcgttggatgattttgtcattgtgcaaacatcatagagtgtacttacacaagcctacgtggtatagcttactacacacttaggctacgtggtacagcctgttgctcctaggctacaaacctgtagagcatgttactgtactgaatactgtaaatacttttaacacaatggcatttgtgaatttaaacatagaaaggcacagtaaaaatgcagtataaaaagagttaaaatggtgcacttgtataaggcacttagcatgaatggagcttgcaggactgggagttgctctgggtgagctggtgagtgaatggagagggaacatgaaggcccagggcattatgtgtataggactatagactttatcagctttgtactcttaggctacacaaaattcattaaaacattttcctttcttcaatagtaaattagccttagcttactgctactttttaactttataaacctttatatttttaaactttttcactttcttaataacatttagcttaaaacacaaacacatttcacagctgtacaaaaaaaatgtttctttataacattattctgttagcttttttctatttttaaatctttttttttttttttttttactttttcaacttttttgttaaaaactaagacaaactttggctggtgcctacacagagtcaggatcatcaatatcactgacttccccctccacatcttgtcccactggaaggtcctcaggggcaataacacacatggagctgtcaccttctatgataacaatgccttcttctgggatacctcctgaaggacctgcctgaggctgctttacagttaacttttcttagtagtagaaggaatattttatctaaaacaatgataaatagtatagcaaatacataaaccagtatcctagttatatcttatcaaatgttatatactgtacatcattactgtattgctacacatttatacagctgatagtttagtgggcttgtttacaccaacatcatcacggacacgtgagggtgttatgtctgctacgacaccactaggcaataggaattaggttataatctcgcaggaccaccattgtatattgagtccattgttgaaatatcgttatgagttgcattactgtatcttaaattgagtaatttataagcaacagaaatgtattgctgacagttctggaggctgagaagtccaagatcaaggtgccagcaggttctgtgtctggtgagggcctgttcctcatagatggcaccctctctatgtcctcacatggcagaaagtgcaagggagctcactggagcctctttaataaaggcattaatcccattcatgaggatgaagccccactgacttagccacttcccaaaggccctgcctcttcatactatcacattggatgttagattccaacatatgaactgttgggagacatcagcattcagaccatggcaataacaaaaagtacgtagatttgatgaacctggtatctgtttactttgttaaattaacagatgaaatgtgaatggttttcatagaagaactaacttcaatcttttataactttcagggcctgtaattcagtgtttacagcattagatcactgtcatgaagccatagaaataacaagcgatgaccacgtgattcaggtatggaaagaaaccacctctatcattaacattcaaaatgaacctttcaggtttaagccacactttttatcaagtactttcccatcatcctcatgtatcagcacattttcttaggagaaataaatatcaagctgtgcaaagaatactgatagacttaagaattagatattcaataaagaacaaaaaattattacttcagatcagaacctgcaatttctttgacagaaatggggtttaaaaaaattttatttttttgagacagattgtcactctgtcgcccaggctgtagtacagaggtaatcttggctcagtataatttctgcctctcaggttcaagtgattcttgtgcctctaagtagcgaggattacaggcatgtgccaccacactcagctaatttttatatttttagtagagattgggttttaccatgttggccaggctggtctcaaactcctgacctcaagtgatccacctgccttggcctcccaaagtgctgggattacaggtatgagtcactgcacccagctagaaccggggtaaattcttttgaccatctgtgaagacactattgacatagaagtaagtcagaatggtacagcaaatgcttataaatgtctagggaacagagtattttcaaagacattcatttgtttacctgcagtgggtatcctaattacaaagcattcttacatgaatgtcatcctcctaaggaaatgtgtgtagcagagaaacctttcaagaaatgaggtgttcttattataattgttggaaagtaagacatctgtatttgtaaaataccctgaaatatagactttccacgaattggtgcttgcctgcctgctgttggtttgcagagtggcatggagtgtgaggagcacttatcagtagggcaccaaagacagtgggcaacacacagcgaagcccacagcagaagcctcacatttgtctgccctgaaatctcccagtgcacacatacacaccttgttctcataccagaccaatgacatcaatagcccaccctgcctaggccctgtcatcagcactttcattaggttgtctcatttctattcaataagggtaggcaagagacatcattgccctatagtgcagatgaggaaactgagtcccaacaaggccaaggaacttatccaaggaaagccttagtaataagtatcagaactaaaatatgtagtcatgtctccaaagccttcctacctggtttcctgtttagctgtattgttagaatatgttttatggctgccccgtgaaatgtatctgaaggcttcctcatgatgctggctcttagtggcccacctgcccacaggtctgcctcttggacctcagagagagccagacgtgtttctgttacagaccaagcacaaaaatcccacatctcccccacttataccccgacttggacaatcgattctattcatgaagcacatttgctttgcacctccctgttttgcagtgtgcagctggatttgatttcagaaatgaggagaaggggctccctgcccactagccgcccctccacctgtaatctaacaaacaacttctagaatagggaacagagtctttcattctccagttatcaattggtggttagaaaacctgtatccttgggagaggtaatattgtgatggtgtcacattatgatattaatcatctcccagcctttgcgatgaacaggaagaagcaggagcatgaggccagtataacagatgcctgtaaaggagaggtggaaggagagtcactgcctttaaagggaaacttggattctgaaagaagaccttacagcttttttctcagggaaccttttcatcctcctttagaaaaatgtatcagcaatctgtagtatggaacttaaaacaagaggaaggaggaaggagctgaatagaggatgttatatgtatggtgaaattacctatgtgctataaattttgaggatgtcatcattggatgggatagttaatatatgttcttacttgatatcagcatccttttcagggcactccaatcaaatagttagatgcctttttgaatacaaatcttcagaggtcaagtagcagcacttaaaatttagaagcaatatctacctatctgtgtctgtctatccatctgttatctatccacccatccattcctccctcctttccttcctgtcttcctccatgcccccatctatctaaactctatatgtatttgctttaaaacacttaattgttacttgccatatactaggctcagttctaagcatttcacacatactcatttatttcttaaagcaatcctgtgagtcaggtatcactattgtactcattttgcagatgaggaaactgaggaccagggaagttaagtaatttgtccatggttctgtagctggtaattggcagagccaggatttgaacttgggtgccttggctccagaatccatatctgggagtacctgctgcattctgaggtttcaggaaccctggtgtgaaagaagggccatgacttctacccaaatttacaacttaatagggaaggcagaatgaacacacatgaaaaggtatgagaatatggctaacaaataaagaaaataatatattctctaatattttctattcattcctcaaatagttaataaacagtcctgagtatccaaagatcaattcaaaatagcctttgcccttgaggagttgaatgtccactgggagagacagagataaacaaaaatttaaattcggtgtaataagtcactgaaagtctgcacaggcatcagtggcagctcttgggagtggactaggtaggggaatcagggaaggcttcctggaagagaagagggataaattggagttggagagggaaagagacagggaagggtattataagcagagagagcacgtggggaaaggcccggagatgagagagacatgcagacagctcagcagcctgcagaggtggccccgggaggtatgaggctggctttgtgagcaggggctacgctgtaagtgatgcccttccctgcctagggagggccctgagtactacatgtcagtaatggggccaggagggggtctggagatccatgaagacaatatcaggcctccttctcttcagtcacccaccaaaggcctgatgaccagagcatcttccaaaccccttcaactctcagggttgatcgtgttaatagaagctgtgtctcccaaggaacagctccccaagtgtccctgtgccaccctgttcatgactgctgccatcacagttgagggcaagagtgattacagttggttcgaacatctccgaagcagcagatggatgcaatttaagcccaaagaaattcatgacccagatgcagtctgtttacattttcccgacattcttcaccgcttgtctctctccactcagcccccatctgtgatctttgaaaagaaatcagagggtgggacaggacctgggagtcatctagggtcatggctctaaattccaggaccccaggcagaattttgaaaagaaacctctgagtctgctggccccagaatctgccgaggggagcttcacacctgcctgagcccagcactgaaagggctgcctcctgccccagccatttaactgaatttattgttctgattctactggtagtgtccccaaactgtagcaaacattgatcaatagatagtggcaattggaaaggagacatgagaaatccagttgtggagatgtgcataatacaagccgccactgttgaatggagttcttatttgttcgtttgtttgtttataagagacagggtcttgctgtgttgcctgggctggagtgcaacggtgcaatcatagctcactgcagcctgaaactcccaggctccagtgatccttctgcctcagcctcctgaatagcagggactacaggtgtgtgccacaacaactggctaatttttttatttttgtggaggtggagtctagctgtgttttccaggctggtcttgaactcttgggcccaactgatcctcctgcctcagcttcccaaagggctggaattgaattacaggcatgagccactgtgcccagcctgaaactttctttttttaactacaaacatatggacccagtcctaatttatttttatttctttttttgtctgagtttttccttattcatggggcggtagatggtgaatgagttccccaagaggctggtactgctagatgagggcttcctgtgtttttcctgctgaagtttcttctgatatcctacaggggatcaggatggcagttgaatgaataaattgctgccaggaaggagggaactcctccaggaagggtttggggatggaaaggggcagcaggacctggccagctaactgcattagagaatgtttgccctgggaacttcttgcttgatattcctctgggtcccaacaagtcttcctacggggcacacagacatttcatgaattctgtcttgtgtccccgcactgatctgtaccaacctcccattaacagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggtgggttacaccagcaaaaccaatccacgaaccctctccccaatgcacttttttttctgagttttagaatttcatccttaagattagcttttttaataatgtcataattaagtgaaagatctattatgtttgcaaaatgagttcgtttttaagttaactttggaactcaagtgaatctggtgcttatcattatggtacagaatctggtgattttgtgtgaaaacatttcatcctgtgcatgaatatgtcccatctgccattgctggaatatcgtgggtatctctgagcagagttccacccagagagctgttgtgttttttcagtttatccagtgtttgggagactagacatatttaataccagtatttataggtaggccaggtttttttcccagttttccttttctgttctctgatcgctgttcaacatacatttgtagcttcctcctcccagctgcacctgttcctccagtggcttccccttcatctgggtagatgaaggtaatgatggaagtccgagaggaattttccctgaagccctctcctcctgtagagcactgcctctcatcgctggaactgcctgtgcattttctgttaagcattcagaatgcttcttcacatacaatttctttcatcttcctttctgtgatgtgaagtagttaaataagccctgtatccatttaatagagggaacattttagagggataagataaatttggattatagatgatgatcaaaatgtttttttaattgaggcaatgagaccaaaaaggaaacaagacattgttaactattccaaagattgttgccaaaagaatatagccacacataccaaggtgcataccaattagccaccttatgtgatagaggggacaagaaatggctgcagggaatcggaatctcagtttctgattagccaaacctcccatgttcagagaacaggaaccaatactctccccttggcctctttcacggaagctaagaggagccagagtaacccccgagaagccttggctggggggcccgtaggatgttaggaagatgatgggcttcagcgagtgttaagtagacatgaatttatacgcagattttctgcatcctcatgtgggcaagttacctagactctctgagcctcagtttacccacctgtaaatttagtatgataatgccaagttcacagattgctgtgaagattttgagagagacctccaaagaatcccttgacctggtgccacagcagccatagggctgagagcagaattccacccacaggtcaagtgtcctggaagctgggacagacaacctggtggtggatatgtggatctgtggtcttgttttcacacatgtggccacatcagcattgcactgggtacaacaatacagcaggcattgggaaatgtaacgagagcatgtgggaatgttccttctcagccttctgagaccctctgcaggagcagctgtcatccttgactgaaggattttaagagctctctttgtccatgtaggagtggcagggggtttactatgccagacggaaatccggggacagcatccaacagcacgtgaagatcaccccagtgattggccaaggagggtgagagcaaactgttcaactcttttagctgaagataaagactcaaggccctcatgggcattgggcttgaaatgccagtatgagccttacatccacaaatgcagtagggttgtgctgaatgtagtatagatcgagggtgcttccactcagccggcagcaacccccaaacatggttttccatgtcttttatgaagcatcaccccaacctcccacctccacctgatcacctatgccttctgtcattcccagtgtgctctaaaggggcttgatttctgggcttccctttccccataacaacaatgatctcctgctggtgctctctggcctctgcactcagtgcatagggagccaaccttttctcctgcttgaggccctcgctccatgctggttcctccaggccggttctggacttgttccttggaggcccactgtttatggagagaaaggtgtgtctgaccaggagctgagggcatctcaatccactgaatctcagattaccagagaagcttctctcttttgtggagagataagaaaaatatgcaattcctcttccttcctccagttaaattttgtgagatttacaaagccaaacaggaccccctaaccatacatcatggtgagccgtggggagccagcctgaaggtcaacaccaggttcatagcttgggtgtataaggaacacaacgttgtgtgacatgtcagaaaaagatgaggccacagtcatcctgccaggaactggaacaggagccccacctgtgactcttaggactacctgagttccttgcaaattgttgtatgaatagaaaacgagatgtttcataaaatcagccaggtatttgtaatagcttgtttcccctccaattttggttagtttcaaaattgctctcccatcaattcaggctacgtcccgtcaataccacctggtatttcatgccattttgtaatttgaagctccctttttgcttcactctggatgatgggggcactgacaggcccctgaccgaggttgtgagctggagagaggctgcccctcggccctcctcctgagcagcctggcctcagcgtggccattctcacccacaggcagtgctgagaactgtggggtggagatgatgcccgtgactgtcacattgtttttatcctcatccttataccatctcctcagaaaatcaaagctaagaatccctttctgtgtgtgtgaccagaatcattaggcaaccaaagcagaggagacatgctattgcctggtaatttccaacagaatacacttttctggtctctctgattttacagataagaaaaagaagttcttttgtccagacacaatttccagtgttattttccctgtaattgtaggcagtgagctatcagaggcaattcttattaaaagtagggaaattttacctcttcctagttgggtgaagtttattacagagtaaccagtattttatatcctcttttcagaggcctacagagaaaagtgaaccaggtaaagagagagagagagtgggataccccacgggcttctgggggcaaaaaacctaatgtaactctctggatttcatggttttactctcagtaaaatattgactgtgagctgatttttgcatggggctgaggcacctgtcatcttttgcccggttttccttgtgacagtgataaagagtgaggctgcccactgagtttcaggacccagtccatgacgttgaaatgagaggatttttatctgcctgagaagtgccattattatgacaattatagtgtgaaagaatatgggatatttaatataaaaacagcagccatgaaatgtggtcattgtccaaatgaatcttttgtagctatgcaattattagtatcagcagaattaaaactaatttatttgtagcagcattttatcctatcaactgaagatatctaggaaccaaactttaggagtcagttacaaaataacatacccattagggaagtgtttctgagccctctaggatgtataaaggaggcccagtttccaaaggcatgtgtgggctctgtgtgaaaactgtgttttctgtagattgagtcttgcttgaattttaaaactgccctaggacgaaccctggagtttagctttaagaagtctgttgacatttttatttgctgatttgttgaatcatctcatatctgactcactaataactgattatttgttattaggaaaattaggcattttgtctcgctcaagaaactgtgttgtaccactgacaataataagcaggtatggtattagctcacttcgtttgctctgtctgtttggccatgcgtcacctctgttctctgcttatctcaccactgttctctgcttgtctttctccatgtctaattgtagctgccaattaagcagatttatgggaaaatttggttcctctgacaaatctttttatttcccagcaaacctatatcactttatttgtagtgcacatcggttatgatttagcttgtggctgaggaactctctagactaatatatgaaggcataaaatttttcctccaaataaaaaatgttctatttttatcttaatttcttaatcagttggaaagtatatatccatttgagcattgcacccctacaaattcatatcaaaaacaagaatcattccaaattagtactgcaattttttcttacccttacatcatacagaagaatacatctggatgttatcatctgcagtaacagaattttaagaagccactttatttaagaactttttaaggtaattttgtaatggagggcaacattggtgtaggtattttttctatttgattagtacttttactactggattatgtgtattttcacttcatgcattgtaatttgtagattaacaattatacaacaaacataattatcagtgatctatttttgaaaacttacaacatgtggtctttgatttttatgaggattttaaagagggacagtatctctaaaggatttcaagggcttctgtggcataatccattttagtagaggatggcagagatgtgtgaagtgctggatgagaaggtgaagcccagccaggcctggagatcaactggaaccagcaggacgtgagtagacagtggggtgagcccagtgagcccgtgagggtcttcagtcggttgtctcaggatatcaaaggggtccacgtccatgtgctcctttataagatatagttggagataaagtccttcctccagcactgagaatctcatctgaaatcaggatgttttcacataataccatgaagtcatgcaagaggcaagtccttggagacctctggtaaaggaaagaatggcctttcatagggaaaaaaaagggttccaacagacattttgctacataccaggagaaagaatgagttcttcataagagctgacgcaggcagaaagagagggacaggacacctggtgtctctttcgagacaaacttctgaacacaagcagtgcagaccaacatttcttggctgtggatccacagtagaggacacaggtccactggggttcattcattctcatgccagaaattgaccaagcacagttcatgtccagttcatgcctttcccccaccaactcagccttgctcctcttccttaccttctttctcacttaatgacagggacccctactctccctgtcaccagtctccctgcaactccatgtgcccaagtcctaccagtccttcatgacccagtgcaagaaacattaagtatcaccttctttctgaaggcccctgaggtaccctctttgctttgtatcacccaccaaccaccgccatcatcttcacagctatttgcgtgctaaactgccctctcccctctagcagggccactggtctgtgctgtccttgtgtgcccacactgcctggcatgtagtaggccctcaagctggtggctagcgttaatgaaactgaatgtctcagtcctggcctcctgccagctgtaaagccctcctgcctcacagggagagcaggcaagcccttagcacaggactttaggatacaggggtggggggccacctgctttttttctgaggctctaagtagaaacgcctttactaccatgaattagctgctgctcctagaaaagaggaaatgcagagctcggataccctgagccattgacgtcacctaatggtactgcacaggcctggagagacatttagattttctaataacaaagcatttttatacctctggctaactacagtgtttttcctcttcatcgaaggaggctgcagcgaatggcaatgggatctgtgctggggagggcacctgtctgcaggcggttccggtggtgtggttttctggggtttagccctgatgtcaaaatcggcccatgggtttgcattttaacaaggtgtgacgtggtaagccaggctgctctctcctggtaaggcttgccgtcagcaaagatcccttttcctgtatgagccctgtagctttttgccaagaggctggaaatgctcagtgaggtttgtctgttgtcttcctctcctctgcacacacactttctccccaaatatgtgttaaacacctgttctgtgctggcaccagggacacaatgcatctgcccccaatgtcagggaggccacagacaggtaaacagaataaatagaatgcagcacagaggaaatgtgaatcaagcactggaggagctcaaaacccaggacctaaggaggctgtctgggatttttagctattgtgtaaaataggggccaagaaactagagcctgcaggccaaatatggcctgttctgtaaataaagttttattggaacacagccacactctctagtgtgttgcacctctggctgctttcatactgtggtggcagagctgaggccatgtggcctgcagagcttaaatatttaccctctggtcctgcacagaaaaaggttgctgacttcatttcttgaagataattttctttcttggatgttccattttcttaggccagcaacagtctgccctgacctcccagaagtaccccttctccccttcatacacttctttgggcaccttttgccttcgtgctagcctctgcgtcctgtctcaaagcctatctcagcccctgcatactggtgcggacacgagaacctaggtcccctgaggctttttccttttcacaaggacaaaatccaaatgcaaattcatggctcagacttcagaatttcaaggatctgcaaccatggtccaagagtcatattgcatagggaaaaaaggaggcagttagggccctgacattatatctgctcttgtgtcttgttttgttttgttttgtttgagacagagtctcactctgttgcccaggctggaatgcagtggcacgatctcagctcactgcaacctccgcctcctgggttcaagtgattctcctgcctcagcctcccaagtaactgggattataggtttgcgccacagtgcctggctaatttttgtattttttgtggagatagggtttcaccatgttggccaggctggtcttgaactcctgacctcaggtgatccacctgcctcagcctcccgaagtgctgggattacaggtgtgagccaacacacccagccatcagctcttattcttgttacatttttaatgtggctactagaagttttaaattacacatgtggtttgcatgtgtggctcacacaatatttttattggacagacctggtctggactttccctaccctgccaaatcctatcacagattcacctcacttgcccttttgcaggtgacgggatgctaatgagctacagacttcctctcgtttctagcaatgagtcagctccagactcactgagcctccaggaaaagatactgtaaccagtttcccaggcccctaggaggcttttaccctcactagaggacattctgatgggtgcttaagcaaacctatagagaatgtctttgcggggagatgcagggcccctttcaatcattctcaaactgctgcagaaagttaggtctcactttctagagcttggtggacagtggggagtaccatgtcctactgagtgtactcaggcaaggggacaccacagccctcagaaaactaagcagaagtgggatgcatgggagccagtgagggccagtggacagttaggcacagtcatcatccctgcttgtctgggcagcaaagtggggatggcttattctcaaagagaccacacatgcttagaaaccctttagccatgggttgagatgggtttcccaaccatgggttaaaggagatggtcagcctcccctaattaaaatgacctcctgcccttttgtgggaacagagcaaagctaccagttgacagctagtaagattttttttcctggcacagcctggcttcaccagcatgtcacagaggagactgccccacagttctcaccaggatctaggagcttctctccaaacccagcaggtcctggatcatgggccttgtctgagatgtgtgcggtctgagtgtgaccaacaggctgctccaccaagcaccgttggtcgatttcttttttgcctcgtaggactgtgctcacagccccctgaacccacaaggacccaaggactcaaggactctgtagttgcttgtgcccagtactacaggaaagaggcaggctgacgccatctttcttttcttcctccctcttttgccttctctcttttatccacactctaccttcagtcaccttctgtaggcctccagacagtccacagattttcccatccagtccttacaccttcatggaccatcctctcaatgggtttctgctgcctgcaacccttggtggcccattctggttcccaccgccaggccagccttctcttgggtgtgtccttggccttcactgcccccatgcctttactctccccacatttgcccatttctgtttctctcatcccttacctttctaggggtggtgtggccgatgggccttctcatgatttggggccttctcctccagcttctggcaaaccatgatccttagcactaacagagtctaatatctcatggcattctcagcagaactgagagaagagggtggtgggggttctgttcattgctaagtagtgataaaaacaaaatttcaatttgtcctaaattcccagtacttggctcttttacatgcttttaaatagtgtggaccttttgttgcttccctgtcctttaggactcaactcagcttctcttccccccaggaaatcttccaaaccttccagcccatgtctctaccctgcaaagagggagcagggacactttttgtctgcaccacccattggatcattaatcttatgctgctttgggtgagttctcgccttagggcggggactgtgggttatgcctcttcgtacttcctcctatgtatgccccatagacatcaggaaattattttgaaaactagtttttactccttaacacaataacctttggatggcataggaaattaaagatgcaacttctgtcttatcccgaattcttattccatgtagagttgatctatatgtagccaatatatgtctcacatggtgttacaaagaatagtttctgtactcttccaaggcacacatccaagtgtgacttctttttttaaaaattggagaaaaaggctactgcaactgaaaacatgactgcagttatctctaaaagcagctagtcacagaaatgtattttatgtaattggaatattactatgatacagactttgtacacgtgcaccttatttgtgtgccccaaaatatttattgacatatttggtaaagccacaaggtaaacaaaattatccaaatttttccatttagctttagtacgtatttacaagaatctatttaaagaaaggcctctgatattgcgaaaccacatttttttttcctgagaaaccacgtttggaacagccaacccccgagcagacatgaatggaatacctgctacacatcagggactgtgggaggctctgagggcacaagataagcaggggcttgcagccgggaggaggggacaggggtgggggtactgagaatccaggggtaggattctgtgtttgagaagtcttgacttagaggagggagagacaacttcacgcttggtggtgatggtggctgctggaggtgatcatgccaggctctgtgaagttccagagcatctgaagctgagagggggctctcttggcttgcgagggaaagggtaaaccgataacattctgggcatgtgcacctaccctgagcatgatgtgagaggaggctgcctagtttcaggtagacacaggtgccctttgccctggcagagaagcttaccctcatggcccgcaggacagcaggctggggggtgtctgccctgcacggatggggttttttgacccgtctgttctctcattctatcctttctgctacatcgaggatgtttataaggcaatggatgtttgtttataaggtatccctatggtggggataagtgggaggtggagaatgggaaaatcagagggaaagaagctataggtctgagctggaaataaagtgtctccttgtgtgagaccagtaatgcctgctcaccagtaataaccagcttcagcagggacccccaccaccccacctcacccttagctgagcctcagtcctggaggcctaaacatagagaaaaaataatttgacttaagaaaagtaagatagactgccgggcgcagtggttcacgcctataatcccagcacttagggaggccaaggcaggcagatcacgaggtcaggagtttgagaccagcctgaccaacatggtgaaaccccgtctctacgaaaaatacaaaaattagccaggcgtggtgcacctgtaatcccagctacttgggaggctgaggcaggagaattgcttaaatccaggaggtggaggttgtagcaagccaagatcatgccgctgcactccagcctgggtgacacagcgagacttcatcgcaaaaaaaaaaaaaagaaagaaaagtaagataggtttggtaatggataatgaacagacatagctgagctatttcttaaaaattaatgttatctattcatctctaatgcattgaagaccactaggatttaaagaggagtattatgttggcgtttgggaggagggttttttcccgataagtttaaaattccaaaggttgcacttctacatgacttgtgtcattcagactattacaagattctgctcactccggaggcttgtactaattaagcccaagagacttacagtaccttaggcctgacttctgttaaagttttacttaatataccaatttttaggccacttatgggtgttagcactctatggaaaattttctttttccaaagcaacagttggtggctgacttttcagaaggaattattcacctcacatgaaggaatcagtttctggcattttgctcaacctaaatcatccattcagtgagcatgcatgcctgctggcacttggcccagtggaagatacaggatggatgagactgaagtcactccttgcatctgctcttgctagaatagaatccctggcttggctaatgagacccccatttacccagtcacccccatcctaacctgggaaccacctttagcatccttgctttcctgagccccctgcatcctagaagccacttagttccaaaggtgatgtctttgaaacaactcttgactccatgcccacttcccaacccaccaccacttcctttaagccattatgacctctcatcctacagagcctcatgaccactccctctgcctccttgtaatgtgtgctggagccagttcatactgacttgtgagaactgattgtttaattttctggtattttgtgatttagtgttaaaccagccattattaaaaattaaattatataagcatgcatttaagcaaattttatttgtaagaagtaataagtacttacattccatcccttcccaagcacataactatattttactatcatgtgtgctcttgacatttgtacgtctgttttatctgtattatggaaatgccagataaagctgtgccctgcacacatcttcccaactccacattcagtgacatcattctggcagctttaaacagccatgaagggagtatttttagatcaagaaaattggcaaactctacaaatcaggacctttttttaattgatttttctagacttaaaaaaatgatgaagaaaatgttaataatacaagataaacttaaatgtgtatcatgtctatagtagtttcattgtgaataacccaaaaatatcaagaatgattcccccagtatttacaaactattatttgattcaacaaagaagttcctcacatcactgacaaatgagtgaaatttctatgtacacctttgttatttgtctttcatcttacttttttttttttttttgacatggagtctcgctctattgcccaggctagagtgcagtggcgcgatctcggctcactgcaagctccgcctcccaggttcacgccattctcccgcctcagcctcccaagtagctgggactacaggcgcccgctacctcacccagctaattttttgtatttttagtagagatagggtttcactatgttggccaggatggtctcgatctcctgaccttgtgatccacccgcctcggcctcctaaagtgctgggattacaggcttgagccactgtgcctggccctcatcttactttttgatgtaagtgaaaatatcaactaacatttatgccaagactccactcattcattaactgtaaccataaattggctgctgatacaagaggtcaaaaaaaccagcaaaagcattttgtgggaatccattggctatatagactctacaaccaagagtgccttatatttgaatattgttttgaaattgtgtgttatacattctttgtattagggattgggaaatttatttcttaaagggccagatagtaaacattaggccttatggtctctgtcaaactgcttaactcaactctgccattgtaatgggaaagcagcaatagatgatatataaatgatgggcaaggctatgttctaatgaaattgtatttacagaaacaggtggccagtacatactgacttgcgaaaactgattgtttgattttctggaattttgtgattcagttgttaaaccagccattattaaaaattaaattacataaacatgcaattaaacaaatgctatgtttaagaaataataagaacagcccatcccttcccaagcacattactatagttcactatcgtgttagtaatgtcaagagcatacatgatggtaagctatagtaatgtgctatgtggccatatgctaaattatggcctggaccgtaatttcctgacctccgctttatatcagtaaaatgtataataaacttatgttcggctatctttgctttttcagcaagctggtggttaaactcttagcagcatactgttgactactatcctatctggtccccagtcctcattgtgaagggctcagtggtggttcctcatcactgactaaaccatcatcaggcatctttgaggagcacgctcctgacttcctgccccgctttccctgccaccttcccaagtcacactaggctgtttgtagttctctggacatgccaggcttggccatgcctctgtgtgtcactccctctgtctagcatgctcttccttcctcctgtcctcctggaaaaatcttggtcccctgagccaggtcaggagccccctctgtgactgcccccggccacctctctcctcctccccgctgtggagtggatttggcactgaccacactatcactgctcagcctgaccagaccctccagggcagcatcatgtcttggtcgctgtgtccccatctcccactgatgctgctgaatgcacttagtaaagatttgatcagtggagctcatggaagagcctatgttttagtaatccaagtaagatgtctttcgtgttgacactttgtatctgttactctccaagtgcatttcatacattaactcctgcaatccttaccacaactccaggagggagatactaggctcccctttctacagatgaggaaactgaggcttgaagtggtcaagaagcctgtccaggcttcacatgggatgcgtgtggcagaaccaggattctaaccctaaagtagttagcaatatggaaataaaggaagcacaagtgtatcttcggagaattcataagagaaaggtttcccttgcttgggaagtgaggggatgacttcatagaggaggtgttgactgacgtgggtttgagcagtggatagaatatgtcattgtaggcctggtgcggtggcttatgtctgtaatcccagcactttgggaggccgaggtgggcggatcacgaggtcaggagttcgagaccagtctggccaacatggtgaaaacccatctctactaaaaatacaaaaagtagctgggcatggtggcgggtgcctgtaatcccagcttctcagaaggctgaggcaggagactcacttgaatccaggaggcggaggttgccgtgagccgagatcccaccattacactccagcctgggtgacagagcaagactccatcgcagaaaaaaaaaaaaaaaagaatatgtcattgtagggagagatcctctgcaaaagtgaaaaggcaacgaaaggcaggagaggagataatcaagcatggctggtcccctcaatgtgtagagtaggggagcttgagctgagggtacagttggtgcccagatgctcagctgcccacctggcttggcctggcttcctccacagtccataccctacctccaggtgcttcagggtccacagccaccccagtgggtgtttgggctgaagtagatcatgtcatgtggatgggcctgtttacgtgatgtgccatggaagggagtggcaggtgggcagcttggagtgaaaagctaagagagtgaggtagctaactgcatctgtacggagaatcctgggtctcttttatggaaaactggaggcccagacctgcgtagctccttgaaggccatgagagcacctcgtccaggagtgggcaaggttgggcatgcagtaatgtaaatggagtagtaaatgtcagctctgactgcagcatttcagttcagctttctaccacactttggaggtatgcagccaactgcacctaaaacccagccattgtaccacctgcttctttgtctataggaccctttatttctaacatggtcaaagcagtgttcatcacataagattagactcaagcgtctggatcttcgcttctgtggtgcctcatttaaataatttctaagaacaaaattccaagaggtatggtttcctctagtgccattgcttgaaaaagaagtgaggaggaggaagaatttgaagtgttcttccttccgcttctcaccctggtttgctgaaggctaggtttcctgggtgagatttcagagcccagctccaggaaactgaagaaagtatgcatttactcatcctgaccagctgcacctaaacccagaatcaccatgtaaggagtggcttcaacttttcctcattatttgttagtcaaacaagatggctgcaggatgggaggctgaacagctgcaacgtatgtactcgagggtctggggaggaagaaaagggccaggtctcagtgggtgccattagttctgcaagtgccttttgagcactttcatagcaaacacaaccctgaactatggcacgatgaagagaaagcacgggggagcctgctctcaagctgctttgggtctagtagaggtttgtgagaaggtttcagatcactggaactgttgaaaagagtttaagtctattcgcagagctttggcccacaagttacaaaggaaacaaaaggcagattcataagaagccagttgtaatccatagggaacactggacctgtctgatggcggaaatccctacaggaggaacgttcacatctacccactggtgctagggaacagcagctccttcagcacctgtgttcgatgaggaggagtgtggaagggctaacatagtggctcccaaccttggctgcacattggaatcacctggagaattatcaaagaaaacaacaacaacaaaaacagaggctctgatagattgggtctggggtgcagtctgggcatgaggatttctgagagcgccccaggggattctgatgtactgctgagggtgagaaccaccaaatttctgagtgaattagatctggcgcgatcatgttatattaggctagggagctttcctgctggatgtcttggagggggacaagactgatttgaccaaaaactcctgttagggcaggctgatagaaggatggcctttgtataattctcacaaggaagaccaggccactgtggaactgccaggggtagggaccatgccttcatcgtcatcatcttatatctgtctcctaggtcctggcacacagaaaatatctattgaataaatacttgcatccaggcagagagaagccatggtgtttgggtagcagcagtggtttctgagagacaggggcctgtgtgtgcccttcctcaggctttgtcagggccagggagcttggagcatagcttgggcttccagagcagccagtggcccaagagaagtctgacctgggcaaagctgctctcctctctggactcagagagcactgtgatgatgtggctctgcctgtcttgtcagccatgtttccagcacttagcatgaagcctggtgcacaggaggtgcttccgtaggggtagatgatgtgctgggcagtcagccctcttcctggaactggcttcaggcaccgaagctcctctatctgcagggcctgacctgaaggcactttacttcctgattacagtgagatttggggacaaatacaacaaaaattcattccacagtctacaccccaagccccattatctgattcagctgacaggtttttgggtttttttgttttttgtttttgtttttttcatgtctcttgcacattaatgttttatggtttgagatttgataggggaagtaatagtgtgagtgggatttatacagtttcctgctttaattgaaattagaaaaattcacccaacatcctttaggctatgagaactttggttttttttaaaaaaaatcttcaatagatcatcgtccctgcgacgctgcaccaccaaaactccaagtcttgtttctctgcctgtcactactgggctctcaggagatgcagcaaacggctgccccctttagccacagaagcacagtgttctgggtaagcagttgaggggtaagatccaaagcatgtgccagtgtatcaccatggggtgagagtccagagacagcggttgttgagtaggccctggggtcggtcagctgtgccaagtggtccaggctcaggcaggggcagctttttgcattagagggcagatcaccactgctccactgctgtcaggggctcttcctctgtgcctaagaaccttggcgcctatgcttggggaactcactgctgtggaaatacagcctcgtgggtgtgtgggggtctgcctggcctgcagcagctccatgaggccagagcggggcctatgtatgttctttcatcttctgatgaatgttgtccctcagagggaattgtctgaacagtggccccagagacatgttctatattaggaatttaaagtgacattaaaaactgcaacatctttaaaacatccaaccaaaggttctaggggcttcggggctctaggccttgctcctggatggcagccccccggtggccatcaagggcgctttggtccagatgtcccctggggcatctgtgcagagaatgtgcaaggtcaggcccaagtaggccctccagaggcagaagctgatgatgaccaagggggtccaggccccttggggcctctcaactcattagcttctatggggccaacagggtaaaactgttgggaaaatggacctttcaaaaattctttttagacaatgtggactgttatttgtaaacttagaaagaggagggtatgctaaaacattgttttctcaaaacacacacacacacacacacacacacacacacacaaatgtcttcacataaaaaggaaagggaagagaaacttcctcactgtcttcagaattcagttactccttcacagctgctgaaggtgagcagcgttgtgatgaattcctggggtacactctggttcctcttgattcagtggtggagagtgtagaagcagatgctgcagccagtgagtgtcgtcccttgtggagtggccagtgcagaagttatcccttccccttgtgtttgaactaatctggggctgaaagcatactttccagctagtcttcctggtgatgaccttgacctttgatctggaaataccaactggaagcctggggagttccttctctttttctctctttttttttttttttttttttgacagagtctcgctctgtcaccaggctggagtgcaggggcgcaatctcgactcactgcaacctccgactcccgggttcaagcgattctcctgcctcagcctcccaagtagctgggactacaggcacgcaccaccatgccctgctaatttttgtatttttagtagagatgaggtttcaccatgttggccaggatggtctcaatctcctgacctcatgatctgcctgccttggcctcccaaagtgctgagattacaggcgtgagccaccacgcctagctgggaagttctaccgttttctaaggcttccagcaacactgagtcacagacctgggtgagtcatctgcacttgcagcgttcttcacaaaagcccccaacttgttctcagtgctgaactggctcccctggccatctctctggcatgtgattgtcagggccaatgaggctggcatggcctttgtgactaatatgtccccatgtgagaataagagataagttggaaaacatttgattccctggagaagtcttaacccttggcctcccattttcagtagcagcatttagagaagaaagtgtaattttgtgtttggtctttcaaatccatctctcttattcctttggaagcatcttcactttctccagaatcactgtattaaagccattcctcctctcccaatccatcctgcacccccttccagattcatctccccaagataacacttgactcttttatttctgtcttaaaaacttacactgactccctgttgtgtataaggtctgtcttgctgacttaaagtcccagcccttgatcctttacccttcccgtgactcctgtggagcctgcactgtagaaggctcagcttcttacaccctgttactcctggctcctgatccccaggtatactgcatattcaaagggcaatctagaagtctggtccctctcatggaatgttcccttcacgatagcttactgtcctttcggagccctgctgcacttgctggctgcgtcacacagcccagcactcagccaagttttgtctcactacacaggtcatcccaggcagcattcagtatcttctccatcttgacctcttctttccccaagggccttacacggtgctaggtaggtgactaatacattcagactaaattagattacctgaaattattcataattaggttaccagcatcatgtcttataaatcaatcactagaaaggcacttacttgatgagctacacagaaggaataagacagcccctgttctattctactcttattaagtcaagtggacaatactcagatatatggaaacagaaagaaaagcaaagaggtgtggttagaccccatcttaaagacaaaagaaaaagaagaggctgggcgcagtggctcacgcctgtaatcccagcactttgggaggctgaagcaggtggatcacctgaggttaggagttcaagaccagcctggccaacatggtgaaaccctgtctctactaaaaatacaaaaattagctgggcgtggtggtgcaggcctgtaatccaagctattccagagactgaggcaggagaatagcttgaacctgggagacggaggttgcagtgagccgagatcatgccactgcactccagcctatgcgacagagcgagtccactgtctcaaaaaaaaaaaaaaaaaaaaaagaagagatagacataagagatgttttgatcaaaacattaaccagaatgtttttgaagtgaggtattgaagggtgagatggaaagaagaataaagaatggccccacctgagtagcagggcattgactgttccatgaattccaaggtggaaggagtatcacagagccctgagcgaaggtttctgctggacaagagaagcagggaggatgagggtgtgctggaccgaggtgacataagagccaacgtctggctagatatgcagagagaggaatccaaggagatccgaaatggcatgctgtatctgaaaataatgaagtgtaatacaataatattttattgagtgtttgttttgggacaggccctagactgtcttaaaggcatcgtctcaattaatcatcttatcaagcccataagatagtattatccttattcagcagatgaagaaactgatactcagagagcagttacacagctagaaaatgtgcaagcttggcatcatacctcgagaccactacacagcccttccctgtggtgcctttgaacaaatgttttcactggcacaggccactcacaacatgaagtacactcagccactttttgtaagtcatgggggaagcaaacattgtgaaaaagacacccagagctcaccctcagttcacattccagccaattttttctcaagcattttattgtgaaaattgtcaggcatacagcaaagttgaaagaattttacagtaaacacctgaataaccaccacctagattctaccgttaacattttactatatttgcattatcacatctctttaaatatacatccctctgtacatccttaatccatcttgtttttttaaaataaatttcatctattagtacttttcctcctaaagcctttagcgtgcatatcattagcaacagttctatatctgcttacattttatgtaaaattaacatacaaagaaatgcacaaatggtaagtgtacctttgtgtgacctttgacaaatgtatacacctttgtaacctaaaccctaagaagacgtagaacatcactgccactccagagaaggtccttcttcctcttcccaattaatgtctgtcccccagtcctcagaagaaaccattgagctgattttatccaccatagattagttttgcctgttctagaatttcatctaaatggagtcacagtatttactcattcgtggaaggcttctttcagtcaatataatgtttttgagatgtatttatggttttgagtatatgatttggttgctttttactgctgagcactgttctattgcatggatataccacagtttgtttatccattctcccattgatgggcacctagattggtgccagtcttgagctattatgaataaagctgctgtgaatattcttatacaagtctctttgtgaatatatatttttatttctcttgggaaaatacctaggagtagatttgctaagtcatggattaaatgtgtgtttacttttgtaagaaactgccagttctcccaaagtagtttttagcatttgacatcgccaagaacaatgtatgagggattcagttgctgcacatccttgccaacagttggtttgccagtctttacaattgtagccattttattaggtgtgcaggtcttaatttgcacttctctgatgactaataatgttgaacaatttttcgtgtgctattggtcttttttaaatgtcatcttttgtaaagtgtctactcaaatcctttgctattttaattgggttgttttattattgagttgtattagttctgcatatatcctgatgaatacatcagtctattactaggtgtatgttttgctcatatgtactttcactctgtgagtttcctattcatttaacagtatattttaagaagtttttagtttgatagtttaatttgttaatattttatgttcgttgttttctgtgacctacctaagaaaactttacctaccctcaagtcaggaagatattttgtattttcctttaaaaacttagtggttttacatttaggactatcatccatctagagttagtttttgtgtatggtgtcagatgggatcaagcttaatatttttccatttggatatctattattcaagcaccatttgttgaaaagactttcttttcttcattggattgttttgacatctttgtcaaaagtcaaatgagtatgtaatattgatctgtttctggactctgttctttgcattgatctattggtcaatctacatattgcatgctttcttaattactttatagtaagtctcaaagtcaggtaatgtaagttcttcaacttaacattgcatgatttggtattctatgtcctttcaatttctatataaattttagaattagcttgataatgtttcccccaaaagcctgctgagtttatttttaggattacattgatgctgtagatcaattggagagaattgatatttgatgatattgattcttccagtccatgatatggggtagttttatgtttgtttggatcttctttaatgtctctcagcaatgttaagtagttttcagtatagaagtcttgcatatctttgttaaatttatttcaaagtactttatgtttgctgatgttgtgacaaatggaattgatttctaagttcattttctaaatgtttgctgccagtacataaacatacaattgattttttgccgggtgcagtggctcacgcctgtaatcccaacactttgggaggccgaggttggcatatcacttcaggccaggagtttgagaccagcctagcaacatggcaaaaccccgtctctactaaaaatacaaaaattagccaggtatgatggtgcacacctgtaaatccagctactcaggaggctgaggcacaagaattgcttgaacccaggaggcagaggttacagtgagctgagattgtgccactgcactccagcctgggtgatagagtgagattctgtctcaaaacaacaacaacaacaacaacaacaacaaattgatttttaaaattagctttctacttgtgaacttgcttgatggatttgttagtttcagcagctgctttatagattgcttaggatgttatacacaaaaagtcatgtctttcacatctatttaggatggaatcttggtctgtagttatctgttttttggataatgtcttcatcagggtttgtatattaggattgtgctggcctattaaatgatcttgaaaatattccctccttctctattttccgaacaagtttatataagacaggtgttatcacttccttaaatgtatgatagaattcacctgtgaaggtatcgtggcctggaattttttatgcggaaagatttttcataagaagatcttttttcccctaaatataggaaagttcagtcttttctgtttttatgtccatacaggtgagttgtagttttcagagaatttgtccatttcatttaggctatcaaattttttggcaaaagtggatcataatatcctctcatcatccttttaatgtctgtagactttgtagtgtaaggccaggtgtcgtggctcacgcctgtaatcccagctctttgggaggccgaggttaggagtttgagactcagcctgaccaacatggtgaaacaccgtctctgctaaaaatacaaaaattagctgggtgtagcggcgtgccgctataatcccagctactcaagaggctgaggcaggagaatcactttaacctgggaggaagaggttgcagtgagctgagattgcaccattgcactccagcctgggcgacagagtgagacttcatctcaaaaaaaaaaaaaagaatttgtagtgtaacctctctttcatttctttatttgtgtttgtgtcctctctcttttttattgttctgtctaggtgagatttatcaacttggttgatctttttggagaaccaacttgtaggctttattacttttctctattgttaatctgttttctattttgttgctttctgttcttatccttattatttcctgcatctcttttactcagcttggtttagtttgctccttttttctagcttcttaggtagaacctcaggtcattattattattttctgacaatttcattgaggaataactgacatacattaaactgcacgtatttaaagcatacagtttgatgagctttgttgtatgtacacacccatgaagccatcaccacaatcaagataatgaacatatctatcaacatatccccaagagtttccttgggtccctttgtattctttccctcctgaccctccttgccctcctttatttccaagcaatcactgattactatagaataatttccattttctcgggttttatgtaaataaaattagagagtgtatactcctttttgtgacatctttcactaagcatactaattctgagattcacccatgctgttgcatttatcagtttattttcttattgtaatagctttattgaaatataatttacgtaccatacaatgtatccatttaaagtgtaccattcaatggattttagtggttcatttccttttattggtcaatattattctagtgcattagctatcctttttatcattataaaatgttcttctttatagctggtgatactattttttcgtttttttgagacggagttttgctcttgttgcgcaggctggagtgcaatggtgccatctcagctcactgcaacctctgcctcccaggttcaagcgattctcctgcctcagcctcccgagtagctgggatttacaggcatgcgccaccatgcccagctaattttgtgtttttagtagagactgggtttctccatgttggtcagtctggtctcgaactcccgacctcaggtgatccacctgcctcagcttccaaagtgctgggattacaggtgtgactcactgcacttggctgatactctctatcttgtaatgtatttgatttgatagtaatatagccattccagccttcttatgcttgtttgcatgatgtatcttttcccatccacttactttcaatctgtgtctattgaaggtatattttttatggagagtgtataattggcttttcattttttaatcaattcatatctgcctcttatttggaatgtttagtccactaacagctaatgtaattattgatatggttggattcaggtctaccattttaacatctgttttttttgttttatttttattttcttttatataggtattttagattatttgaacgatttttaaaagccattttatttatccattggttttttagttaaatctcttggcatttttaagtggttgtcctggggattactatatacatctttaactacacagtctacttagcctaatatggtaccaattcatgtgaaacataggaacttttgaaactggaagtccatttaccaccttcccttttatcctttatgttgcagttctcatacgttataaatcccataatacggttactgtttttgccttaaatgcatgtgttttaaagaaattaagagaaaatttaatctactatgtacccaagtatttgccattgaatcttgagcactgaagatcggtgagaaggcagcatacacgcttgttctgtccttcactctgtctctggctaatcctgtgcctttgggcaaatcccctaaggacttggcctcagctgtctccctctgtagcaggtcagtaggtgtctttgcctacagactacagacagaaccagatacacacacacacacacacacccaactctaggttctctaattcttgagaaattgcattgttaatgtggattttagacactgaaacagttcccagaggatacagctgtttttcccaggaaacttttacaatagctgccatatacgtgatggtgtagtcactgtgccattgcccctgatgtggacactaacgaagctctcagctgtgtttctaggacttctactggcagtttttgtgcgtcctgcccatccttctcttctgagatagacctcacctgcagcatcaaaaggagtagttttatctcttgagggagctccagggcccaagactgtgggaaccactgctgcttggaggcacaagatgaatcgccccaggcagggagggtcaggttagacagctgggccagtctaaactgttacctggacagaaccaaaactttggcaaaaagtatttaaattcctgctttcagacatgaatttcagctatgttttgctggcacattttcagcataatagtaccagaatctgccaaattgaaaagctaggagagaggacatcaaacttctctttgtttaaagtgagaataggtcccatggctgcatttgctgccacctgtgcccatctcccctccatcagccaggccaccccagaaagttaaatccctccttaatgtcctcctgcagctagcctgctatcacaaaatgccactcacagtccattcctaacggactcaggaaaagttccagtggtagtctagtaagtggcgctcagcgtgggcttgggtggcatttttatcgtgtctggaaggaaaaaactgctcatgtcacatgagatacatatactttaaaaaaattataaatgctgcttaattcatccattttgttgcccctttttagggtacaggagtgttaatactcactttgtgccttgatttcttttttttttttttttttttgaggcggagttttgcccttgttgcccaggctggagtgcagtggtgcagtctcggctcaccgcaacctccgcctcccaggttcaagcgattctcctgcctccacctcctgcgtagctgggattacaggcatgtgccaccacgcctggctaattttgtatttttagtagagatgggatttctccatgtgccttcatttctagtggagcattcccaggccaaattaggtgaagggtctcatttcctaggatttcttcacaggtggcatccgtcctcagatgggctacctaggactagggatggctgcaggtttcaaggagcgagtagcttgaatgtgtgattcaaggttatttagtatcaaatttgagaatgccccaaacttaccttttaactgctcgaccgcatggcaccaccttttgggaaatactgtctttgggcacttctgaactagttcgctgagagccagagctttatctcttgttctcagtcacatcccagtgcctagaaaattgcctagcacatagtatatgctcaacaaacacctgctgaatgaataatttcattgtgacagcactgtgtttgtcccttattagacagtaaatcctatgaatgcagggactgggacctaaccacctttgcctcacaggcccaataaatatttcttgagttgaattagaagttgaggttctaattagagatgcccttttttctcctgggggtaattgtttacaaaatgtaaacaaagttctaatgaacagcattttcagaaccttaggacacacagtgataaaactgttttacattcctctcgttattactaatttttccctgtgctgtcccctcgcctctgcactagctctcaagggacctgatttactaagctctgggcctgaggatcaattctatcttatgctaatcaagtgcaaatgaaggcctggtgtcattaagtagtttaatgactctctgttgagtgctagtgtaacaggggtggggaaatgttggatctctctcattctcttattctctggaccataatctaggaggcatgtgggtttacacagaaaagtgccatccgtcactgacaattctttaagaacaagaaactttaaacaaaatgaaatttctgtccctgtttatatgtaagtgtctgtcactgagcagcaaggggacacgggctggaggactgacagcataaaagtgaggagacaagtgtgctgcttgtgttagccgctcagcagagcaccccacatatgctcaacattgagcttcagaggaaaggaaactaaaatcaatcctgaaagagcaagcaatataaatgtcattgaatccagattctcaacaaacagaatacacctatgaaagagaaggcaaagagaaccagcatgatctgggccccattaggctaggctcgtgcttctcaaaggatggcaccggacctgcagcttcagcctcacctgggagcttgttaaacatgcagattcgtagtctcccacccaaacctgctgaaacaagtgatgggtgcagaacccagcaatgtggcttaacaagccttccaggtgattctgatataaagaccggcttaaaagccacgggctaatattgtctcatttgatcctcttagatcctaaaaagtagatgtgatgcttagttttaggtgtcaacttgactagcttaaaaaagatacccagaaaaagggtctatgcatcagatcctttaaaacagtaaaaccttgtttatgggaaggtgtttcccaaagagactggcatttgaatcagtggactgaatttgaatcagaggacaggaagatctgcactcaccaatgtgggcaggcaccagccaataagccaagggcttggatagaataaaaaggcagtggaagtgcaaatttgcccttgcttcttaagctgggacgttcatcatctccttcccctgacatcggtgctcccggctctcaggctttcagacttcgggacttatgctactgccttccctggttctcagacttgcagacatcgtatcatgggactcctcagccaccataatcatgtgagccaatttatataataaactcagctcgcttgctcgctctctccctctctctctacacacacacacacacacacacacacacacacacacacaccccctgttggttctttgtctagagaatgctaatatagcaggtgttggtcgccatttaccaatgacgaaactgagacttagtaaagctctgtaagttccccaggtttatacaactagaaatgtaggtactggccgggcacggcggctcatgcctgtaatcccagtactttgggaggctgaggcgggtggatcatgagctcaagagatcgagaccatcctggccaacatggtgaaaccctgtctctactaaaaatacaaaaatcagctgggtgtggtgctacacacctgtagtcccagctactcgggaggctgaggcaggagaatcgcttgaacccaggaggcagaggttgcagtgaactgagatcgcgccaccgcactccagcctggcgacagagcaagactccatctaaaaaaaaaaaaaaaaaaaaaaaaaaaagggcatgtaccaaagatcttttctcaaaacctatggtcttttcactttattggtgtttctcaaactgtagtgtgtaattgaatcacctggagattaaatggcaaaatgtagattccaattcagtagtcagagagcttgcgagtcagtagttctaacaagcttcaggtgttgccaatgccgccggtacactgagcacaccttaaatacaaaggcttaatgtgttaatggggtgggccccagaactaaagtctcagcctcacctgagaactcttagatccaaatgcttggccccacccagacctactgagtcagcaactctggggatggggcctatcagttggttttaacaagcccttcaggtgattttgattcatgcataagtttgaaaactacaaatatatcatctttccatactagaaaactcagtattggccaagttatgaagtgtggtggttcttacattgtagatatttgaaagacattagagagaaactagacaagagaaaaaagataaaacatttaagcctgaatagtagcttgcattaagtgtttttctgtgagataaggacacataaatgattatcactgggctaaacaatgacagtacttctctgtaaaggctcttgcaaatatgtgtagaatgtagagccagtgggcacaagtactgggagctaagagaagttatgaccaagggacagtataatatctgaagatgtagacctggcattgcacaggaaaatgatgcttaaaatttttcaaagaaaatatatctaacagcagaagaagataaatctctgcttgtctggcatgcagaaaatgatctgggggaaaaaaacagcttgggatttttctttttaatcttgtgtaatcctagaaattcatatgcagtttcatctatatcaaaccaatgcatgttgctttgatataaataacattttaaattaccattaagataaaaggggagagatgctgttgcacttagtctgttagactcataaaatgtactgaagtggtatgataccaagtatcagaatcagcacccatgtatatttcttttctgtcttggtgctacagcatttggagaacttggaatacatgaaaacaaatggcaacagcttgtgggtggctttgagagctatgtaaaggcagtcactgaggacaggggcccagagtgttgcaagaggtgttttgttccggtgtttaggagctgcttgggtgcggattttgagaagtgaatcttcaagtggtttttgaaaatagaaaagatctttgatctatgcatcagatccttttaatttcaagaaaatactcatcaaagttttttgagtaaagatgatcaaagacgttctgtactataccactcacactgtcatttcattacatgtaaatgaagggagggtctcaaatgactcagttcctgcgatcacatctctttatccagcattcagactccaattcatcaaagcagtcttgtcacaaacatgaaagcattcagttctgtcgtgaagttgcagatcaagaatgttcagtcttaaaagtgcttaataagtcaacgtttaaagctacagtgattatttaagtgaatagtacttttgttcatcttaaccaggttttttacccctttccataacattcaggggaatggaggatgagacaaaaacaaaacaatataattctgagtttgaaaaagtggatcaaaaatttcttccatcaaaacctgcattcttctatataaaatcaagaaacatttaaaaatcacttcctgtttcattgcaaatgtgtgtaagaatatgaacaatctttttgtttttaaaataacatctaccatttgtaccattccattgaatacaacaagaaaagtaacagactctgtcagaagctcaaggaaccaagttagggacaaaggtgcatttagatatttggcctccatttctcaccttcacaacaactctttgcctgtcagatttggcactatctgagcccatggatgtattttaaatggacatttctctcagcattttaccgtgaaacactgtaaattagtatttttagagacataactattaagtaaaatatataatggccaaattattaataacagtgttttcaccagagctatgaggcaaacagcctggtcaatctcaatctcttatggattcattttatattagcttttatacgccaggtactgtgttagcactgggtatacaaaggtaatcaagtgagacataacccctgcctacacagaacttatagatagacattattcaaataagtactgatttatgaactgttataaatacaataaggggaaagtccattgatagcatgtaacagaagggcttgaccttataagggagtaggatgggcaggaaatatccgggaagggttcccttggaaatcgtgtttgagctaagatctggaagacaaataggcagaggaaagactgtggactgggaagcttcccaagcagtggagctgcaagtacaaagactcggaggtgggaaagggcatgggagaacaagagggatggaaaggaagccaggatggcctgcaagctgagagctcagggcagagtggtggggatcagaggtgcacctggagagctggcagggaccaggccatgcagcagagcctcatagccagctcgctgcctggaattgaccctaagaccaacgggatgtgggagttttaaacaggagaatgacaggattaaatacatagtttgcaagcttacactggctgatgagaatagactgggttgggcaggtattgccaagctcagatgaaagctgatggtacctgcgttctggtagtagagagacgcaagtgactttacaggattggatgatggactggctctggggaggagagagaaggaagcagcaaggatgacccctggcttgcatactgatatatctggtgatttaattgtgagttctgatgcctttgactttcagtaatgactcagacatttctaccaaatgctgtctaccttcccacggtgattctgaaatgggtgttgaaggaggcatccagtatttatttccttacttgtttgttattgtactgatcctggccttgactcattttagttgctaaaaagtctcatgattttttattttttgtttttgtttttttttaaataaaaggttgacatgaacacatcatactaagagggatgttttcatattgtttttagggttttctcctacaagagataggtttatgtcgcaaatgaatttaaattctataatttaaggtcatgggagaacttgggagcaggggaaggaggctagttcataaaatctatccatcataaattatataaatttaataaaaatcaatgttttaaatagttacctaagtaggtcttacacttggtagattgacagctgttatacacaattccctagttatggtttgaagcagtgtattatcttatgcccaggctcatagtagggtgtcccagggactgtgacatgacattaacctcactcctctgtttcaggctgttctgatttcgtcttgtttattttcataggttttgaaactacagttcagacttccaattttcagccatcaatccgtatactcagttgaacatacaattttcccaatactttattatgaaaatctttaaccatatagagttagaaggactgtaagtgaatacacatgtactcagtacctacattctgtaattagcatgttgcttgatcatataaccatctgtgtctccctgtagacatccagcagcccatctaatttctgacagatttccaactatcaaaaaaaaaagttgcatatatcagtatgtttcaccccttgtaacttcagcatgcacattattaactagagtttaacatttgttttcatctattctaaggtagaagttacatacagcaaaatacgtacatcttaggcatagccttccgtgaggtttttaacttttttttaattatacttcaagttctggggtacatgtgcagaatgtgcagatttgttacataagtatacatgtgccatggtggtttcctgcacccatcaacccttcacattaggtatttctcctaatgctgtccctcccctaacccccaccccaccctccgacaggccccagtgtgtgatgtgtgatgttcccctcactgtgtccatgtgttctcattgttcaactcccacttatgagtgagaacatgtggtgtttggttgtctgttcttgtgttagtttgccaataatgatggtttccagcttcatgttcctgcagaggacatgaactcatcctttttttatggctgcatagtattccatggttcacatgtgtgccacattttctttatccagtctatcagtgatgggcatttgggttggttccaagtctttgctattgtgaacagtgccacaataaacatacgtatgcatgtgtctttatagcagcatgatttataatcctttgggtatatacccagtaatgggatggctgggtcaaatgatatttctggttctagatccttgaggaatcgccacactgtcttccacaatggttgaactagtttacagtcccaccaacagtgtaaaagtgttcctatttctccacatcctctccagcatctgttgtttcctgactttttgatgatggccactctaactggcatgagatgatatctcattgtggtttttatttgcatttctctaatgaccagtgatgatgagctttctttcatatgtttgttggctgcataaatgtcttcttttgagaagtgtctgttcatatccttcgcccacttgttgatggggttgtttgtttttttcttgtaaatttgtttaagttttgtagattctggatattagccctttgtcagatggatagattacaaaaattttctcccattctgtaggttgcctgttcactctgatggtttcttttgctgtgcagaagctctttaattagatcccatttgtcacttttggcttttgttgccattgtttttgactaaatggcttcactttcgactagtctgacttcatgattaaaacataccaagtgttttagtcatgaagtctttgcccatgcctatgtcatgaatggtattgcctaggttttcttccagggtttttatgcttctaggtcttacatttaagtctttaatccatcttgagttaatttttgtataaagtgtaaggaaggggtccagtttcagttttctgcatatggctagccagttttcccgacctcatttattaaataggaaatcttctccccattgcttgtttttgtcaggtttgtcaaagatcagatggttgtagatatgtagtgttatttatgaggcttctgttctgttccattggtctatatatctgttttggtaccagtatcatgctgttttggttactgtagccttgtagtatagtttgaagtcaggtagcatgatgcctccagctttgttatttttgtttaggattgtcttggctatgcgggctcttttttggttccatttgaaatttaaagtagtgttttttccaattctatgaagaaagtcaatggtagcttgatgggaatagcattgaatctctaaattactatgggcagtatggccatttttcatgatattgattcttcctatccatgagtatggaatgtttttccatttgtttgtgtcctctcttatttccttgagcagtggtttgtagctctccttgaaaaggtccttcacatcccttgtaagttgtatttctaggtattttattctctttgtagcaatcgtgaatgggagttcactcatgatttggctctttctgttattggtgtataggaatgcttgtgatttttgcacattgattttgtatcctgagactttgctgaggttgcttatcagcttaaggagatttggggctgagacgatgggttttctaaatatacaatcatgtcatctgcagagaaaatttgacttcctcttttcctatttgaatacctttatttctttctcttgcctgattgcccttgccagaacttccaataccatgttgaataggcgtggtgagagagggcatccttgtcttgtgctggttttcaaagggaatgctttcagtttttgcccattcagtatgatattggctgtgggtttgtcataaatagctgttactattttgagatacgttcaatcaatacctagtttattgagagtttttagtgtgaaggcctgttgaattttgttgaaggccttttctgcatctattgaggtaatcatgtggtttttgtcattgtttctgtttatgtgatgggtcacagttattaatttgcgtatgtctaaccagccatgcatcccagggatgaagccaacctgatcgtggtggataagctttatgatgtgctgctggatttggcttgccagtattttattgaggattttcgcatcgctgttcatcagggatattggcctgaaattttctttttttgttgagtctctaccaggttttggtattgggatgatgctggcctcataaaatgagttagggaggagtccctctttttgtattgtttggaatagttttagaatgaatggtaccagctcctctttgtacctttggtagaatttgactgtgaatccttctgatcctggacttcttttggttggtaggctagtaattactgcctcaatttcaggacttgttattggtctattcagggattcaacttcttcctggtttagacttgggagggtgtatgtgtccaggaatttatctgtttcttctagattttctggtttatttgcgtagaggtatttataatattctctgatggtagtttgtatttctgtgggatccatggtgatacccctttatgattttttattgcatctatttgattcttctctcttttcttctttattagtctggctagtggtctattttgatcttttcaaaaatccagctcctggattcattgattttttttttttctttttaagggtttttcgtgtttctatcttcttcaattctgctctgatcttagttattccttgtcttctgctagcttttgaatttgtttgctcttctctagttcttttaattgtgatgttagggtgtctattttagatctttcctactttctcttgtgggcatttagtggtataaatttccctcaaacactgctttaaatgtgtcccagagattctggtacattgtgtctttgttctcattggtttaaaagaacatctttacttctgccttcatttcattatttacccagtagtcattcaggagcaggttgttcagttttcatgtagttgtgcggttttgagtgagtgaggttttttttttttttttttttgagatggaatcttgcactgtcgcagtgcaatggcacgatctcagctcactgcaacctccgcctctcaggttcaagtgattctcctgcctcagcctcctgaggagctgggattacaggtgtgcatcaccatgcctggtcaatttttgtatttttagtagagacggggtttcactatgttggccaggcttgtctcaaactcctgaccttgttatccacctgccttggcatcccaaagggctgggattacaggcatgagccaccaagcctggccttgagtgagtttcttaatcctgagttctaatttcattgcactgtggtctgagagactgtttgttttgatttccattcttttgcatttgctgaggaatgttttacttccaattatgtggtcaattttggaataagtgtgatgtggtgctgagaggaatgtatattctgttgatttggggtggagagttctgtagatgtctattaggttcacttggtccagagctgagttcaagtcctgcatatccttgttaattttctgtcttgttgatctgtgtaatattgacagtggggcgttaaagtctcccactattattgtgtgggagtctaagtctctttgtaggtctctaagaacttgctttatgaatctgggtgctctgttgttgggtgtatatataattaggatagttagctcttcctgttgcattgatccctttaccattatgtaatggccttctttttctcttttgatctttgttggtttaaagtctgttttatcagagactaggattgcaacccctggtttttttgctttccatttgcttggtaaatatttctctatccctttattttgagcctatgtgtgtctttgcacatgagatgagtctcctgaatacagtatactgatgggtcttgactcttcatccaatttgccagtctgtgtcttttaattggggcatttggcccatttacatttaaaaaaggttaatattgttatgtgtgaatttgatcctgtcattatgatgctagctggttattttgcctgttagttgatgtagtttctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggccgatgtagtttctttatagtgtcgatggtctttacaatttggtatgtttttgcagtggctggtactggtttttcctttccatgtttagtgcttctttcaggagctcttgtaaggcaggcctggtgttgagaaaatctctcggtatttgcttgtctgtaaaggattttatttctccttcacttatgaagcttagtttggctggacatgaaattctgggttgaaaattcttttctttaagaatgttgaatattggtccccactctcttctagcttatagggtttctgcagagatatctgccgttactctaatgggcttccctttgtgggtaacccgacctttctcactggctgcccttaacattttttccttcatttcaaccttggtgaattcaccaattacatgtcttggggtgtcttggggttgctcttctcgaggagtatctttgtggtgttctctgtaattcctgaatttgaatgttggcctgtcttgctaggttggggaagttctcctggataatatcctgaagagtgttttccaacttggttccattctccccatcactttcaggtacaccagtcaaatgtaggtttggtcttttcacatagtcccatatttcttggaggccttgttcattccttttcattcttttttctctaatcttgtcttctagctttatttctttagttgatcttcaatctctgatatccttttttctgcttgatcaattcggctattgatacttgtgtatgcttcatgaagttctcgtgctgtgtttttcagctacatcaggtcatttatgttcttctctaaactggttattctagatagcaattcatctaaccttttttcaaggttcttagtttccttgcattgggttagaacatgctcctttagctcggaggagtttgttattacccaccttcggaagcctacttctgtcaattcgtcaaactcattctctgtccagttttgttcccttgctggcaaggagttgtgatcctttggaggagaagaggtgttctggtttttggaattttcagcctttttgcgctggtgtctccccatcttcatgtatttatctacctttggtctttcatgttggtgaccttcagatggagtctctgagtagacgtcctttttgttgatgttgatgctattcctgtctgttagttttccttctaacaggcccctctgctacaggtctcctggagtttgctggagatccactcccgacactgtttgcctgggtatcaccagtggaggctgcagaacagcaaagattgctccctgatccttcctctggaagcttcagcccaaaggggcaccagccagatgccagccagagctctcctgtatgaggtgtctgtcggcccctactgggaggtgtctcccagtcaggatacatgggggtcagggacacacttgaggaggcagtctgaccttagcagagcttgcacgctgtgctgggagatccgctgctctcctcagagctgtcaggccgggatgtttaagtctgctgaagctgtgcccacagctgccccttccccaacatgctctgtcccagggagatgggggttttatctataagtccctgactgggaatgctgcctttttttcagagatggcctgcccagagaggaggaatctagagaggcagtctggccacagcggccttactgagctgcggtgggctccacccagttcgaacttcctggtggctttgtttacactatgagggtaaaaccacctactcaagtttcagcaatggcagatacccctccccacgccaagctcaagcatcccaagttgaccttagactactgtgccggcagcgagaatttcaggccagtggatctgagctttctgggctctgtggaggtgggacccgctgagccagaccacttggctccctggcttcagtctcctttccaggagagtgagtggttctttcactggtgttccaggcagcactagggtatgaaaaaaaaatcctgcatctagcttggtgtctgtccaaacggccgcccagttttgtgcttgaaacccagggtcctggtggcataggcaccagagggaatcccctggtctgcggattgcaaagactgtgggaagagtgctgtatctgggccggaatgtaccattcctcagggcacagtccctcatggcttcccttggataggggagggaattctccgaccacttgtgtttcccaggtgaggcaatgccccaccctgctttggctcaccctccgtgggctgcacccactgcccaaccagtcccaatgagatgaaccccgggtacctcagttggaaatacagaattcacctgccttctgcggcgatctctctggaagctgcagacgggagctgttcctatttggccctcttgtctgcaatcccttccttgagttttgacaaagcatataatactggaaccttatccccatcacgatattaaaccttgccgtcccaaaagtcccttcatgccccttcacagtctatctctgtccacccatcctgctcgcccccagaggtgaccacttttctgaattacttaaccatagattagagtttgagtgtatactgtcacggttggcttctctcactcataatgtttttgaggttcatcttcactgtatcattttttttcctttttattactgaatattcctttgcatcagtctatcgcagtgtggagaatctacttctgctgatggactccagggctgtttccagcttttggctgctttgaacattcttggacaagttttcttgtgaatatatgcttctgtttgccttgagtaaacacttaggagtgggactgttgggctgcgtagtaggtggatggctaattttaaaagaaactggcaggccttttttccaaagtggttgtacaattttatactccctccaactatgtatgagagttccagttgttccatagccttgacaaaacttctttttaattttagacattctggtgggtgtgtagataaataggatttttaaatgattaagagacaaatgaccctgaaatcatgcacacatacacacaaatacctaactcagaattaatagtgctttttagaaccaagcaaaatcagatgtttgtaaacaaagcatttagcacaaggacagcaaaatttgtggcaacttataatattttgaagtaattaagggtttgaaattatttttctccctgaaacaagctgtaagcctccaaggacttgctgaggaatcccagcttcgagctctggcaaagagcttcacaggccaaggagagcagtattcacattgcacaaactaagcactaaagccttcggtttccccagtaacacacaaaatcaaacttcccagtcactgctgcaaatgagaatattctacattttatgcttttacaagaggagaaacacaccacactacagagagactgactggcatggggcattgatgccattgaatccccgtccctttgctttgagttagtttgcacatgacaaaaccttttgataagagatactcacacgtccccccaaatttcaaggaaaactgtgtttcagagagatgtcccgcactaatgcagggggtgtttccttgaccccagtttaacaagcccggtcctggcacatcccttctggggcttcactgtaaacagcagcttgacagagcaaatggttttagagccaaagggacacatttgaaattggctctgcatactacctgtgtggcttgggcaagtttcttaacctcttaaacctcagcttccttgcctgttccaagcaatgaggatacctccccttgtgcaagagtgccatcatgattagactgcagatgtcatgctgccagcatgtgggaatacacgtaagagatggctgtggagcaaagttcatccccttggctgcctaccggagagaatgccaaaccacagacccactcattctgtatctattctcccaatgagctcaactaagtattaaggaaataattttagaataatttctactgaaatgactggtaagtgtagggtccacaagaaaattctgattctaggagaattttcatccaagtgaatcattagttgtacagtggggtatctggaagaggtacgtggataatcagagtcagcttcagtgaaaacccagcaccgctggggtgtgacaggggaaggtctgctggcactgctctcggcacagagcatcattaagtcggtcccacaatagggttcctgacggcagatgctgctgcagccaggaagagtctctgcttgtagagcaaggagttatctccatgctgggttgctagccataggcatgcagagagcccagcaaaggcaggtgagccagtctgggggtgtgttcagctcaaaatgccaaattatacttgaagaagaatggcccagagccacctcagcagatggaattggtacctgtcatccctgcttctccctgtacctagtggctggcatacatttccatccccaaagcaggatgtgcatgtgcacctgctggccttgggctttatctggctccactctagacagaacacaaaacccatgttgacatcgcaggagctccacgagccaatcggctggcccgaggggcagaggatacgcaagaaaggctttttgttgtgttttgtttgttttttgttttgtttttaaataacatagggagccatgggacacagcttctaaaggagggaggcgttttgattcagaaagaaaagctaagcacttaaaaatcacttgtttttgtgttaaagctatttgaaagaacaatttgcaaggcaaaagttttattcatttggtatcatataaaaaattcacactatatcagtaagtagctgtatagcaaatggtctttatccctgaagaaaacatgaaacatgggaaataaaaatgtcccataattatgggataaatgagtcacagcccttagtcacattttgacaaggatatcacacaggttggtcatgtaattgtttccataattatgtggaatggactgagcagaagagttggtagaaaatcctattttcacgcttcagttttatgtgatgatttttcagtggttcagtcaagctgaaaccttttacctgtatctgtcatacagggtgttctgcagcggacaggcctatgcagacctaccccccaaagtctgaggaagctgagaggccaaagaaagagactgacaactctagttgtcagaaaggaacattaataagaacttaagaacagaagccctgtctgtgtctctggcagcagtgagacaagatggtagatctgtgcaccattacccccagacccagggcttatataccatacagaaagggtgattcagagggatgtgtaggacaactgaagtatgataacatcaaggttgtttgacctaatggcagtatttacagtaggtatgtgcttttacccaaggaacaatagataatttgggaatctttgaggccttctcagaactgaggttattcagaagacagcatggcagattagcatccaagatggagttgctttggcctccacactccagcctcccaaaaccagctcttaaaatctcatgcactcttcctcttctatgatggtctcttagcctgtagggagggtggctatagctttagtagcagtacattggcaatggaaaacagctcaggcccagtgggattccaaatgagggaggttcacaggctgttggaatcatctctagtcttaggaataccatgacttcagttttctcagaagaagtaagacaatgagagatacttaacattaataatttgaatagtagaaatataatgacacttgaaagagaattcgtatgccagaacaacaacaacaaaaaaagcctattagccaactagaagaacattaaaacttggttcttctttagagacttgtagccaggaagtaattcaggtttagcccaaattgtaggcaaataataaaaactcaagaacagtatttcaggtccagttacagtggctcacgcctgtaatcccagcactttgggaggctgaagagggcagattgcttcagctcaggagttggagactagcttggccaacatgggaaaaccctgtctctactaaaaatacaaaaattagctgggtgtggtggcacatgcctgtaatcccagctactcgggtggctgaggcctgagaatagtttggacccgggaggcagaagttgcagtgagccaagtttgcacccactgctctccagcctggacgacagagtgagactgtctccaaaaaaaaaaaaagaaagaaagaaaaagaaaaagagtggttaggactagaatctaagtttttctctctccagtttccccatttctaccaaggataaattatagtaccttgctatttcaggaataatgaaaaataaaaaataaaaaaattacaggaccaatttatttgctttagttgcaaaataaattttagtctcactatacttggcctaattatttgcttaaagtgtagcaagaatagttattagtcatataggcttcttttcaattggctttgctggaactttataaggaattttggatttgacattttaaaagccttgagactaaggattccccattagactatgcttgtaatacctatacataggtactatacctgtagaaattcctctcttctttagttcccaaaatatcttggttcctgggcctgtcagaaagtgatattctttacttaccagaggccgggaaccttgtaaggaaccatttagacaacgtaccaagttagtctttccaaaggactttttatcggctctataaagtcaatgtcaattcctcaaagcagtctggttatatctgaaaatacatgattctagtcaaagccttggtgaaataaccagtgtttccaattgtgtcctgttacaaaacaaaacagattcttactgaatttatgcaaacaactacattgccataaagtaagaatactcatgaaaagtttccaaattctggagaactcaggtagagggaagaagtaaattttgctcacaaaagtatcctttacaatcagagtagcagtcttccaaacaggatgttgcccgttcatcatggaacggccatccacaaaccaagcagctcttagtcaggtgagggagctgtttgtcaggcactgtagaatccagcagctcctcacacagtttcagagtcagtcctagggaaaaaagaggctctctgctcatgagtatctcctcctcgcactcttcaggtagcaagatcctatataaaccatttccattttatcatgggactctttttgggcactgtgatccccatcagagtgtttctctgacattacccccatatgccctagtaaatgattcactaagggctgtcaagtgaagaatttatccctacaagcactctggcatgctacattctgtgggctcaggcagtcttattcccatttagcatatccaattaatattgctcaaagggcagatttgcatgccttctcttctgtagtactaggtaggaaaaatgtttcagcagtcagatataatatccattttcataaaacatttaaggaaaagagatataactatttcacataaagactatttaaacatttcaactttcataattccatcagcccttacatttttatgttctgcttccaggaacttctcttttgcacccctagaccattttaccctcttgtcaaaaaggctttggctttgcagcaggggattgagccaagggacctgggcactttggtcaatgtgtcttgattaattacctcaacattgccccaggcaattgttgatcacctttctcattttaatctttaccttttgatttttcaaaaaaatattttccaatctagggtaaatacagaaaactggtttgggttcctgtaatgttgggggaaaagcaggggctcaccatggtccatccagcttttggtagtgttgtattaagaactttgtttgaaccctatcaatttccaattcattcaatttcttttttgagacagagtctcactctgtcacccaggctggagtgcagtggcgcgatctcggcacactgcaagctccgcctcccgggttcacgccattctcctgcctcagcctcccaagtagctgggactacaggcacccgccaccacacccggctactttttgtatttttagtagagagggggtttcactgtgttagccaggatggtctcaatctcctgacctcatgatccgcccgcctcagcctcccaaagtgctgggattataggcgtgagccaccgcgcccgaccttcagtttcttaataaccaagatttccaccctgctgggacaaattccatgactctccctttctgtttttcttagtttcaaccctttcaatttttaaaaatttaccttttaaaataacttttaaaattttcacctcgctaggataagtcctttgactctccgttttgccattccctatgctcttgttaattagcctaatgtttttattagcatctgtaagacccatgaggggaagttgagacagcaaatttgaggcttcctgaacttttaatttttcatcagtaacgaagtgcccacgcaaaagtccctcctaccccacccccaccccctcaccagacacacacatgcttaaccacagcatttaccatgacctgggtaataggcatattgatggggtggctatccctgtcataaagccagttccacatggcttatagacaaagcatatcagctgcttcatctggggtgctccacgtagcattggggccgaccccattctcagggtaaacagatctgacagaggcttttatccagtccaccaggctggctgttccctcaggaataacctcccatgtgtctggatcacatatagccatctgtgattgttcagtagtgagctggggatcgtgcatcaacccaaacatgttttaccactctgcagcatttaaaaccaaagacactgctccaaattagctactttcacaattcaacaacaggttttatccagggagctgatgatgcctatctacaaaagggaacaattccttcacacagtaccctctggtttcagcagttacttgggttttgcccttcccccacattgactaccttcttggcaaccacaggtctcagaggtactttctgttgccctgtcattattttcccctttgtagatagctttgaggctaatgatctgagctcagacagacccacatttgagcttggtgcagcctcaaggcccaatctggcactcttattttagcttttatagaaaataaccaaggtactgaatatttcacttttccttattggtttgcatttacttatgtatccagtgaacaactccttaggagttggatttttctctaaattccactggtaactcttaccttttagtaactgagcacagcacagctacagctccataccataggtgaccacgtggccgcccaggaatcaatcaaaagttcctcattctctatccttttatcctttccctttctatccatctagttttatctgtatcatttttcattcattttaaaacaacctttaaatagcctctaaactatgtggttactcttcctttaggcaaaaacctcatcttcatgtttttaataaacttctttatcaaaacacatctttctttcttcactttcatgtagaattgtttctcttatatttagtagttttaattacatatattaactactactttaactcgtagtaaccctaatttccatggaaaaacctaggattacttaatttaacataacagattttaagatttcaaattactgaaaagaactttgaaactagttttatttgaaagattactaaagttaggtgaactaaaaggcatttgagttggtttctatatttccgataagaaattttttttttttttttttttttttgaggcagagtgtcactgtgttacccaggctggagtacagtggcatgatctcggctcactgtaacctctgcctcctgggttcaagcagttctgtctcagcctcccgagtagcggggactacaggtgcacaccaccctgcctggctaatttttgtatttttggtagagacagggtttcaccatatttgttaggctggtctcgaactcctgacctcaggtgattcacctgacttggcctcccaaagtgctgggattacaggagtgagccactgtgcccagccagaacttactttttctttaagccaaattagagctctgtcatatattttggtaatgatgtatcacatatataacatactaaatatatatagacatacacacaaacagaagcagctcttatagacttataagattcttcatttgccagttctcaaatagcttctctcccacctttacacaacccacccaaagacatgactcagatgaaacaaggtggagaagatctacatctctaaggcacagaacttagacctaaacagcattatctggaaacaagattgccaggaaaaatgtcttctcttcaacttagcttgtttcttacattactggcttcaaggtgtcagtatattcttatattactggctttaaggaacagggccaagaaagcatggaagttttagggcctaaaccacacaattcttatccaaacatgccaagaaatgagtagcccttatagtagtaaccacttgctttaacaactgctgtcggccacctctaacaatatagctgttgcccgtgactgctagccattaggtacaaggtcagcaactctcacagtaaaaagtaatctctgtaccccaccccccgcctccccacacactaaccagagatgagataacacaatacaaaagagtgcagttttagacctgagtagaatctgtctgcttactacccttgggtttcatgaggaaaaagagattcttccctaaaagaggagtctttgatgccgtctgttttccccaagggatcccaggctgttggaaattcctttttttagatccctcgtgtggcaagaagtagtaggaacagacagaagtaaatggagaaacagaatttggtcagaagttttacagagagtgcagaggccttaatacatatgtaaacatatacagcccaaatttcagttttaactaagtttacttttgactgtagggcccttaaaaaaaaaaaacctttttcctaattgtaattcctaatcaagctgttttactttttttttttttttttttttgaaatggagtctcactctgttgcccaggctggagtgcagtggcacaatctctgctcactgcaacctctgcctcctggattcaagcaattctcctgcctcagcctcctgagtaagctgggactacaggcgcccgccaccccacccagctaatattatatttttagtagagagggggtttcaccatgttggctaggctggtcttgaactcctgacctgaagtgatcacccgctttggcctcccaaagtgctgggattacaggagtgagccacggcgcccgaccggctgttttacttttgtgtctgctgctggctggctcccgctaagacacagtcatcttaccgcactggctgcctgctgcccttccgggccacagtgtgatggttggcactcagttcaccgtcactctaaacccgctggcatttggggtcatccccacactcacggggtggtccacaatcatctgaagtgtgagccacaccattccacatagaagtggctgcccaccacaagatttcctccattttttggtctctcagctcctggcctggcttaccacacgtcagagtgggcaggcctgtgcacacctaccccaaagtccgaggaagctgagaggccaaagaaagaggctgatgaatcccgttcctcggaatgaaacatctaataggaacttatgaacagaagccacgtctgtgccttggatggtggcaagacaagataacggatccctgttccattacccacagacccagcacttacataccagaggaaaggaatgtgtaggacacttgcagagaaaggcaagaatgctatgtgaatctgcctaagggcaggatttatggtcaaggttgttttgatgtaagggcaggatttacggtaagtacatgctcttcttacacaaggaacagtagataaaatagtaatattggaggccatcccggaactggggttaatcagaagtcaacatggtggattagcatccaacatggagttgctttggcctccgcagacagggtttctggctattacagttgatgttgctaagccatattaatctgcctctgcagatgtcctacacactcatctgtcttatttttcaagttaacctaccccattcattgagtggctacaaagatttaatggtctgagcacttgaaagtaggttgatttagcagtgaagccgcatgattataagtttaatagaactaaatgtgccccactaacagtgttggggtcagttataaaacaagaaatgcaggatcccaaagaaagcacacttattatttctagtgctaatgacttccttttgtcatttgacagacatttattgagcattagcacaaaaccattaacaacaaaaaaaattgataatgagaaagaataggtggaaaactgcatctaaagttcagatctcatcgtgagaaaacattttataaattgtctataattgagcatttgaagagctttgtaggaaatgtttttaactcctaggcttaaattcagattattctgtagcacagaaaaattttataacgtatctgaaacaaacaggttatatgttagccttataaataacttaaatttagttatatcttttatctttctgcatttctgtaggctgtcaaaatgagacagtagctgactggagaagtagatgtcctgtctagagagtatgtgccttgggtaccttcctgctctcaggctcagccattctataagtgtctgaaagtaacagagcctttggattagtaccacttggtgtatgtctttcatctgttcatattatatgtgcagcttcttgctttcttcaagtcttcagagctttttaactaaattgtttgatgagaaatatagcaaatggcatatttaaaatctttctcttgttttatcaaacttttgaacgactttagattcacaagattcatcgtgattcaggagacaattctcagacaggtgagaatacttcaattgaactctaacatacttaggaggcagctgtgggttcaaatgtatacatttctctgaagaagtctaagttgacatctactaccccagaatgtggagtgctaaaatccacgtgctcatatcacaaggttggcaagccagaagaaaagcagaaatcccttaaaatgtccttgaatcttcctttatggcaaccttatcatactgaacgccctccccatcttgtttttcttttcttggctagataccatgtaggacagataaacccaagagagtgggccgaaagtctaggggagacactggttgaatatgacacaggtgacaatatggtagttgctcaaccgtgtccagtctcccttttctttgcactaattggtgactgtacagttggaaaatgtggctaggtcctggcctgggaggcagaagcaccaagttcctatttcagtttcctactcgctcatttcatatgttgggcaagactctgcttggttcttggcttcctccataaaaagaggagctggacctgatgacttctacaagtggaaaggtctggaattctctgaccattagagggaaaaaaaatcagtctgctaccaagaagttaagatttttgtgcctgcaagaattgcaacattctttgccctgttggtggctttcccagccactaatgcatgatgtcagaccctaggctaagtgtttagtctctcttcttggtgaggtggatcatatctagcatacttagaaagatgtcatttgctctttctaagcttcaaattttttcatttgtaaaatgaattaacaaaagcccatctcattgttaatgaggattaaagaaggaaatgtataatgcttagcagtaactggcatttaacttgtaccttccttccccctttctgaaaactttctagacatgaacaggctgggataacataatgacacttcacacacaggtgcattttctctctctccctcactcacacacatacattttagttaatttcttgtaacacctgagcaggggtattattttaactaacttgggagcttctgggtgccacaaattgttccaagcatttttgtgtcctttgcagtgcccagcattgccttgtacataatagacactttgcaaatactcagcaaatattggtaaattgaaaccattccatcttggaagtacagtttccaccatttattctctttttgatcttgggctacctacaaaatctctccatgcttaaatttcttatcagtaaaatggggatagccctatgtagttttgagaattgttgtaatgattgaatgagacaattatttaaagtacatagcacaatgcctgtcacaaagtaggcactcagtaagtggagctatttttttttttcaattggtggcacatattcctttttgccacagagtacagctgtttaaatgtcctttatcctttctctggcttaagtttctaattcatgtaaacatctgttgaaagaatgacaatgaattctttaattatgtggccttactttagcctttattgaagaataatttctctaaacttttaatcacttctattgctatagattctcttaattttaactgagataaaatgaggaagaataaacatcatccatctttgaataatttctaatgaacgacttagaattcaaccagctagcctgggccacagccttgaagctaacctctcttttagttttgtttagaaactacattttgaggaattcttggttcttgaatcttgaatttaatcttaaatttttaagttagatttaacttattacttggtacacaaataaatgctaggactgtatatgattatgaggtccctgaataggctaaaccaagtgtctcacaagtgagcagtattagtttcgtttctcagggattcagaaatgccatgatcccaacaatatcacttaaagtactattatttatagataattgtaaaaatatatatatatagaaacttatatgcaaggataggtaaactactaaggtagaatttggaagataaaaattaggaaaagagatagtataataaatattttaagttagattatttaagataaggtgctatagctatggtgttcagattaactttataatagttccgctttcacttcatgttgtataaaaataattcagttttaatttttgatttaataatttttttagttgaatcaggtttttaggacactaaagtaaatggttaagaaggtggtctagaaaagtgtctaagacattataaagtgaaaacagtaagtagtagaacaatgtaacatgatcacatgtgtctaaagacatatatgcaaatgaacggatgtaattaatagcccccatatactacatgctcactatgtggcagacactgttctaaatgctatgcatatattaactcacttatttctcaaaacagcctataaatgagatgctatcattacccccacttcatagacaaggataatgagacccagagaagttaagtaacatttccaagattacacagctgctgagtggcacagtagaaatttgaatcttgacgatttggctctggacctggtttccttaactactaggcttcttgcacctgctgtcactaggcaattcttaaagaagtgttattgcatcttttttttattcttggaatatgatcacttattggcatctgagaagcgcattcttcctgctgaaatttgcatgtctgcctcctctcttagcctagtgaggagtaatctgtgttatggttaaatttctctactcgcttatgagttactctcacagaagcaaatgcgctgaaaatgtgtgtttctgaagccaacactgctgccttgtcattttttatatctcggcgctcactggtggcatatgctttttgttagtttttacattaacatgaccgtgcgttttcagtgttaaattcaagtctgcaaagatttaggccaaaattctttaaatgtttgcctgcccccaccaccctggaaaatagggacaagggtgaaggtttagttattgaaatgttgggggaatctaaaactgttttcttcctttcctgtgatcagcagtatgcatcatttgatgaaatccatccttaaagagaatctagaagcccatctagaggtctgacttttcagaggtgccaaaattcgtctgaattaatctcgtaatttaaatctctataagtttcattagtattatatttcctcaaatatccccatttaaaagccttccctatccagttgaatatattgtctttcaagtaaagatttaaagtactattatttatagataattttaaaaatatatattgaaacttttatgcatgataggaaaattactaaggaagataaaaattaggaaaagagatagtataataaatattttaagctagattatttaagataaggtgctatagctatggtgttcagattaactttataatagttccacctttactagttcaatagttcccccgagaatgtccctcaagttttaatgtttattttcttaaattctttttttttttggagacagagtttcactctttttgcccaggctggagtgcaatggcacaatctcagctcactgcaacctctgcctcccaggttcaagcgatcctcctgcctcagcctcccaagtagctggaattacaggcatgcaccaccatgcctggctaattttttgttggtttttttgagacagtctcgctctgtcacccaggctggagtgcagtggcacgatcttggctcattgcatgcaacctctgcgtgctgggttcaagcgagtctcctgcctcagcctcctgggtagctgggattacaggcatgctcaaccatgcccggctaatttttgtatttttagtagagatggggtttcaccatgttggtcagggtggtctcgaactcctgacttcgtgatctgcccgtctcagcctcccaaagtgctggacttataggcatgagccactgtgcccagcctaattttatgtatttttttagtagagacagggtttctccatgttggtcaggctggtctcgaaacctgacctcaggtgatccacccgcctgcctcagcctcccaaagtgctgggattacaggtgtgaggccctgcgcccggcctaatgtttattttcaaaattacattcatgtaactaaataacccttgatactaagctatattactatgatataacatggcattatcttaaaaaaccatcatttaactaatatgactataatttttgtctttcatgatttgaaaagaaagtggttgactgtttcttaaaattattttatagtgcttaaaaagtaaccttgttttctttagagaataaagaaaaaacatgtttgaatctcttctgtgaatacacggaaaactaatcaccttccctttctaatctgaaatccttagagcctcattcattcagatataagaacaggaggaaagagtccattgacgtgaaatcgatatcatctcgaggcagtgatggtaagatgtttttcagattcctctgacctttttaaaatgtagaaaatgatggaagaatatgttaaaaaattcatcagcgtataaactccaaagagtaagagttcaacaacaccgacttatttttcaataagctcaaaggttttaggggttttaattattttaattatttttaaaaatcttatgctgtagtctttgtcgtctctttggagggactccatgcttgttccttgatggcttgaagcatgttgagccataaccacccaagcaactcagagttttagtagctgaacaaggtcactcttgggtgctagaggcagagaggcagccagtcctggcttcccaactcccaacacaaacctagttttcagtgtaccagctatatgcactcacttcttaataaaatgtcacagagaaatcgtgaggcagaatttagcaaaatgtttctgccctgcaaggcaggatttagcaaaacattttttgagttccatcagccaggcctaagtaaacaactggatttgcagggagatggaaaagtcaaagacgattctgacatttcattcctcggtgtctgggaaattttaagtcatatatacagaaatggaaacgtctccaggttttgctaggttgggggttaaggagaagatgatgaatcttattttaatggagatggctaggaagctaacctgcaaccctggtactcggggctatagatgtggagttggcagtcctagtggtgacaggtgaagccaggagcagaagaacatctctaaggggtgtgtgatgtgcatgtagtgaaaggacagagggtccaagcctgagcctgaaggcatagtctcagccagggggtgggcagtggaaatagggccagtaaagaggacagaagagctgggggtgaccatgagagtgcagtgtcacatgaaccaagaacaagaggggattgagaaaggcggtggccagcagtgttagatgctgtggatatcagaactcgagagcggacaacagactagtagatttcactcgctcatttgatttttatttggcaaatgggaggacacgttctggggtgtgaggaggggatggttagtgcctgtgatagaaaagagagatgaggctggtaacttaagagagtcaacagaaaggacaagggagggactttccagtccttctgtacacagtaggaagactgagtatgaaagtggctgacataggccaggtgcgatggctcatgcctgtgatcccagcagtttgggaggctgaggcaggcggatcacctgaggtcaggagttcgaggccagcctgatcaacatggtgaaaccccctctctactaaaaatacaaaattagctgggtgtgatgacgcatgccttaatcccagctactcaggaggctgaggcatgggattcgcttgaacccaggaggcggaggttgtggtgagctagatcgtgcctccagcctgggcaacaagagcgaaactccatctcaaaataaaaataaaaataaaaaaaatttaaaaagtggctgacatagcaagaaccaaagatgctagagacaagatgataattcacagggcatgtgagggacagtaaccaataatataaagagaatatgaatcgagagatttttgagatggattgagcggatagatagaatattttagtctgagaggataagggatgagggaatttgaactggattcactgtttttggagcagaacttgaaggggactgtcttctttccagtacgggcacagtggaggctgaagagcatgcaggtctgcaatggctgctgcactagcagcggggggaccccagaggtggctgagcaggaggcaggctctgatgtggggtgggttcagtgatcccatccatgaaatgggactccccctcctgcctgcctcagagggggtggtaggaagatctgatgagaacagtgcttttcaagtcaagcttctacccttggcatcttaaaccaagtataaacattaactatgtagaaaaataaaagattttttaaaaaatgaaagcttctgtagatttgaactagaacttccatgggtttctgggagttaagagcctaaaggcatgggcaggcggagtgactggccctaattcagactgagaatgggctcaatcctccgccctgaccctaaccatgaactgcctcccctctcaagctggctgcacagtcatctggttacacggccagcagcttaggactgaaagtcatggaactgcaaaagttgggtttgggtgacttgggggaaagtgagccgtgtgggggtcattaagctgttggaatgaggcctttttggacctcatcaaccttctctgaaattccccttgtggacttggggctcagcaagccctcctgcctccaaagttccaggccagatcgcctttccagactcaggcaagtagcagttgggctaccagccttggcagaagagatgggtgaattcatggctttttaggtgggagggtggccctgtgagaagcgggccctggtccatgaagggactcctttgctgcacttagccacactgagccaccggaactggacacagctttcttgccttctctccagcaccaagcctgcagaatcgtcgctatccgtccatggcgaggatccactccatgaccatcgaggctcccatcacaaaggtgagtggcggctgctgcctgcactctgcagtcaggggccctcacacagggccgtgctctgaaaatacatcacactgacatcatggagctcagtctagtggaagaagcaaataacaggcaaataaacacatagcaaataaacacctcatcctaagtcacaatcagggcagtgaaggaaaacaagcgggttctgtgagagaaaattagagtagggcccttaagtaggttggaagagagggtggtcagggaaactctcagtcatgtttgaagcaagtcttgaagcataagatgttactcaggagaagaaggaagagaagactccgggtagcaggaacagccagggaaaaagcattgcaatgggcgaagagggactggaacatttaaggagctgaaagaaagtcggagtggccggagcttggtaagcaggtgagagaggaggaggatgtaggttgtacagggctcagctcattctggacagcagggacatagttaggagtttgtatcttagtttatgtgcactggaaaccactgaagagtttcaggtgtggggtgggtgatgtgaccagatatgtttgttgaaaagaacacccagcttctgtgcagagaatcgattggaggtggcaagagaacaggtcagttagggggctattctagaagtagctgagctagaattatagctgtggaggtggagagaaatgaatagatcaagaaatattttgaggcagaccaataggacttggtgatgaattatattgccagggtagggagaggaatgaggaaaagtattatgtcaggcatggccctcccaggtttttggtgtgagcatgaagtgctttcttgatagaaaatgacatgagatagaagtgctttcttttgcagtgtagaaaccacagaaggtgaacagcttttgtctttgatttttttgttgtgtgtgtttatgtgatttctatggagagaggggaacaagactgcagtttagtgttagacctgtgagatattccagtaggtatgtcaggtagggaattgaatgtacaagcctggaggtcaaaggaagttgagggctgggaggtatatcgaaagtccctagctataggtgtccaaagtcgtggagacaaaatatcatttctggaagcgagagagtgagagaggggcccagaacagatctctgagcaactccaatctgtagaggagggccaggggaggtgaatctgcaagggagcctgaggaagcctactcactgagacaggagaacattcaccaggagcccgcagggagaaaagcatgcttcaggaagaagggcggtgccgtgaaagcactggtcattttgaataagagatggttacccactgatttcttttggattctgggcatatatatgacttttgggaagtagaaccctattatcctcagatgtattctttcttcactccgttaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgtgagtgatgaggcaaaacctgaaaagcaagagaggtatccggggcctctagagtgcagctgatgtggaaactgttacctgtggttgcagaagtacctgttatatagactaacgttagcataaccagaagcaactgcgtcagaatttatgtataacatgtgcagtggtatttgagtgactcttgcatttgtctttccatgaggctggcctaccatagccatggggacagtgtttcagaattcctatgactgcagggagtcattgggcaactgatggagggctcaatgtgcaagatggggctttgcaggctcttgattattcctgctttcccttgatctggtatagtattggatttcatttccatggacctcagattcctcatgtaatgaaagggtttattgttagactatagcatttaatcttaactatagaatcctttatttaaagtttgtatagaagttccatttataaggtaaaagcagactggggctgttctggctcagggaggggaaggggagaaggaacctctcactgccacattccaaaaagaaccatttacaccaccaagagtagctggtttctagggactcaacctattctggtgttttgctgtgatctatttggctttcataattatctatcagcaagtaaagaaaaggaaaaaaattcaaattgtttatttgagttccccatcagagtctgaagctggaattctttagaaaaaaagtccagaagtcatgtatgagtttgactttgaaggtttctgtccagccctgcagccaaatgctgaatgttgactgcctttcccctccattctccacctggaacttgagggccttcttgtttctttcttgcccctgggctggcctgttaactccatctaatgcagtgcagacctcagcttctaggcagcactgccaagggctctgcaagaaggtggccaccgcagagctgcagtgggaggggtctggttctgggagcaagccatgttccctccctcccctgctgctgatgcaggacaggcaagtccccaaactggggctcagcccgggagggttcttggcctcgcccaggaaataattcaagggcaagctggtggtgttaaacagcaacttctattgaagcagcagttgtactgcagtggcagagggactgctgcttgcagagcggggctaccccatgggcagtgtgcccctggtagcagctcagaggcagcactgcactcatctttatacctacttttcattacatgcaaatgaaggggcagtttttgcagatatttctagaatgagggtggtaacttctgggttgttaccatggaaagggtggaaaggtctggatgttgtcatggcaacggtaaactgccgtggcatgctggtgggcatagcttatggggaggtgcttctgccctgttctacctagtcctcaatttggccccatgtccgagtcccttctcctacctcactgccataccatcgtgggtttcctctccagagaatgctgtgaggaaccagtgagtgattccacctcaattttatgtggttttggggaagcggagcgagagaagagcaagtaaaaccaagaatctcttgccatacacacgttacaggcaggacaattgtggctgttgttacttctgtatttactcagtttttaaaattaagctcttggcctaaagatccaacatgtaacttcaggggagtccttcattaattaatactactttaaaccttagcacacatcgtctgggaatgacaaataagcatttctttttttttaaatttaattttattattattatactttaagttttagggtacatgtgcacaacgtgcaggtttgttacatatgtatacatgtgccatgttggtgtgcatttctaaatgacttttaagcaaagatctagatgattgaggtactcagagatcaaaggtggagggaaggaaactgagattcaggaacacttggggactagttcaagagccaggatatggccaagcattggaatttcgtccactctcttaacgctgcatctccaaggacctcaagcccagaaactcttctttaaaaggcaagcagcaatgctcatgtttcaaaacataaaatacagttggggaaaaattagttgggatattagtcaaaaaatagctcaatctttttaaaactttatattagaaggtaatcccctaaatatggctgatggcttcaactcttcaaaatgtaagtcaaaaacacaattaacacagtccctctgagggtgagggggatcccgtcaagatctgaagcaaggtcactcctgtgatttcacctgtgtagcttgaaaatgccaggagaggaagatggcctcagaacagagccaacccacagctcactgtgagtcctgacacagtcacatccactctatcccagttctccacgttctggggctaatagttacagaagggagagtatcatctgtcttataactgttgtgatttaattttgagctttgcttcaacttagacttccagattggttgggttattcaggattcaaatctctttcactaataataaaaaaaaaaagagaatgataatagatataaagcatgcttctaacaggctcttcctttattccaggacggcttgagaagactgtcaggaaacgagtatgtgtttactaagagtaagttttcatctatttacttgttagtgtaacctgtctccagcctgtgctgtccccgctgttgcgattattgttctgggaggtgttacttccagctagtcccatttgagtttaagcatcaatatggtctacatttaaaactagtctcctaattaaaattacttctctgagcacagttagagtaagaattgcaaatctctatacatttaaacagagttaaagtgaattatttttctatttgagggtcttgaagttcaataacagaaaaatcaggtacaagactttttttctagtagtaactatgaagatgatgacagacacccgggcactcaagattccacaattaaccagcctcccccatcccatctgtttgctcagatgtgcaccagagtcacagtcaccttgcaatgccaataaccatcaatgatgttcccccttgtatctctcaattacttgataatgaggagagttgggacttcaacatctttgaattggaagccattacgcataaaaggtatgtgacttctctggctgaaggcagagcaggattgatggccatgctcaaactctcacatttggaaactttgagggagacatgtttttgctgtgagagacctcacgggttctggctctcatgccatgttagagtagtgttgaatgagcagagagactatggcccctgagtgagatcctttgtggagagtattagtaagatgtgggatctgcctgggtatccacagctccctcctttgtgctagtgagccaagagttctaagaatcctcaaacttgtcgaagctctaccctacagaatggaattgagagcactatagattttttttttttttctgatccatcctgtaggcagaggaaagattagataactgaaaggtctttttctatactaggagaaggctgtttcttcccagaggtgttggtctgttggatatgaaagattctcacctgtaacgtaaataagtaacaggactctaaatgataggactttgggaccatccaagctgtttttttttgtccttaggcttagtcacttccttagggaacataaataaagtgcaaggttaatgtggaagtggggatggagagggactgccaggctcatttctaggttgtcagagccactgaggggcctatgatttagagttcatctagaaataatttggatgtactaccatgaagcatctagttccaaagaggtgactggtgagaaggagagatcctacctcctaatttttagaggagatgcttttaaacccctgtgtgtgtgaagctatcatcagaagaaaaatgcttccatgccccactatcatcaaagaaaacagtttctgggccagtgaatacaatgagccagggtgggttttcctatttttcaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaaggtaggattttgatatcatgacctagttacctgcctggattggagatccaagaacttaatcttagtaaatacattaggcaaacagctattttgcaaccaagttgacagcttttttaaaaaaaaattttgttaccaaattgactagtcactttggtgttgtaaagacatggacctttctgccagccctcccctcctccaaatacttaaaataattatatcaccatagagactcctttatatgcatggcagatcatgaacccattttccaaatgttagctaggagctgtgttacggggttgcaggacagaacttaattattacagcaaatggttactagatctataggttaaattttagtatcaggatttggccattggtagattacagtccagatattaataatagccattccgcattctacactgttttacatatatttatgtttgtgttttgtgtaggtatgaacgtgcctatctttatattaatgacttttgcataattctgaaagagttccatatcccttagtcttacagttcaatactgtcatgtaccactgctgatttgtagggcagccctaggaaccccttgccctttacataagggcagccctatttaaagctggcaagagatccccatctctcctcctccccagctaccatcacttgcacaccaaagcttatacattcttttgctacaactagaactaaaacttaaattttaaatacccctgggagaagtgccatatggggattgaaattcacatctatctgtaaatgcctgacattagatcattttcttagaaccaggtattgagggattaaggtcctaggtacttaagagctatagtgagacaggtagaagcagaaatggcaggaaaacagtaagggggtatgtgggtaaggttttcttctcagttttgccaacagcatcctgatatttattcactttcatcagcaaggaaacaatgtggcccaagaatgatgcttttgaataattttgtcttctacttttagaaaactaatagtgatatcaacctatgtttctataacacctttctttgaggagcaaaaacaccctggattcctactacaggttcatgctcctcttttttaaaatttttttatttttttgagatggagtcttgcactgttgcccaggctggagtgcagtggcacgatctcagctcactgcaaactccacctcccaggttccaacagttctcctgcctcagcctcctgagtagctgggactacaggcgtaggccaccatgcccagccgattttttttttttttttgtatttttagtagagacagggtttcaccatgttggccaggatggtctcaatctcctgacctcgtgatccacccgcctcaacctcccaaagtgctgagattacaggtgtgagccactgcgcccggcctatgctcctttcttttataccacatgatgtttcacagctgaagccacatgctaccagttgagaacagcacccaattcattaatgccaagaccaaggtgatcaatagcctctgcagtcttgagttagaggtgaacctcactcaagcggaaccactctaggaaaacattgattaaatttttgataaattagggaatgcttagtaacttgatcatatcttactatcctcctccaaaatatatttctttaaattgtgagttctgctagtgtatttggagtctgattagatttctcaaatgacagcaatagaaacaagtttaagattggacagaatatgtttacaattcaaaaaacattttctcatgctggcagcccctgccagagaaccagaaaacttagagctgcgaggaagcttggagaactgagctggaaggggtttctgggctcagaggtttggttacctgcctgtgatcactggtgggtccatcatgaggtgcttccagaaagatttactcctgaggcctcttctaccagatctgctggcactgacaaagagggtcaggaagtattttcttacttctcttgtgtcatctgtcacccctaatttctttgtgataagctaaaattttttttttttttttttttttttgagatgaagtctcactctgtcacccaggttggagtgcaatggcatgatcttggctcactgcaacctctgcctcccaggttcaagcgattctcctgcctcagcctcccgagtagctgggattgcaggcacatgccaccaagcccaggctaatttttgtatgtttagtagagatggggtttcaccatgttggtcaggctcatctcgaactcctgacctcagataatccacccacctcgacctcccaaactgctgggattacaggtgtgagccactgcttccagccaggctaaaattcttaatgtcactatgacaaagcatgcccaacccagctgtagagctagcatgcccagagctaacagccccttcagttggtgacagaccccatcctctccccatgttacccaattccagggaactagtgcaagtggagaagccaggataacaagcattcctttattagtatctgagcatacatgaatatttatcctgaataagaaactatttgaaagacagatctagaatgaaaccctttcctcagtgtgatccagatctactcctactggttaaagagggaaaaaactatgcagaggtaactgcacctccacgggactggaatttcgccagttgcgggtttggtggggttttcttccatggacatttcctcctcgacgtagggccttgctactctcctctgctagtgagctagcctgtcttccttccctacctcccagccatttctggtctgacaaggccttgttggtgcccacctaaactgcaggacccattattggtatctttgtaagtcactgagggcatggtttaaatcagtgttagctggaaggaaaggcatgtttcatctagtgctatttatgttttctaccccagttacttgaatctatttcattgaagaattaaaaaataaacaggcctgagactccaagcaggattgaacataccacagtggcactagctggaggcccagagtttgggccccgtgggttctcactgctcaggtacagtcagtgaaggtggagcccaggttggggctgtcctgggtcctgagcttggagatcgctgaacgtgcctgcaggtgaccgtggcctctcctgaccagcagtgaaatgggccaaatgatgcttgcttgccctgggcactgcagaatcaatctctgagaacagctgagaagagtaacttctgctgtccctattcaggaagcctagttgtgttgattggggtcaccccagggttgctcaccagctccatggggtcagcgttgggaatggaaatgactcccttctggtggagacagagctttcagggaagcctgctaaaccagcacaagcaagtgcagccccttggccatcagggtgccgttgcaggacagggctgagctacaggttcaccttcctcacctgagtagcagctcttcctcctgcaggcctaggagagcaaattctgggaataccaaaaatgatgacctccccacccccaacatcttggggaccactttccctctcactatcccttcagccacagtgatgtcgcttacgtttcctgaacagaccttttttgtttgacttcaggaacgtcatgcaggctgttctttctgcctggaattgccctcttgctgcttgttgcctggacaattcctgcttctccttcaggctcagcagaaaaatcacttccttggaagtgaccaccctcgaaatccatgttatccgatatggtagccatcagcctcgcatggctactaaataaaatttaaaatgcagttcgtcagttgcactggctacctttcaagtgtccagtagctgcatgcaactaggagttactttatcagatagcacaaatagaacgcattcctgtcatggcaaaaaatacattggacagtgctgccctaaactagaccaggtcccatggttatactcccaaagcatctgtactttccttcttagcacgtctcacagcaagttacttccgtttgtgtttttaaatgtatttgtctctctccctctacattacaaactccattgtgcagactgtgccagtgtaaatcatcatggcagctctggcactatgcagtgataattggtacctggtaggcactcaataaataataaattcctagcacaacatctcttatataacagtagcccatctgataactcctaaagctgcaggctcagaaaacacttgtatccccggatgctctggtttgtttctttaattacataatgagagctttcgaattagggtttccctttttgcctttgctgcctgctagcccagagctgaattttgttcttatttgcaagaacccctttagccttaattttcctggcaaagttattctttcccttggtcttcttttactgcttggtcctcttttacctggtactcttttactcttctacagctctagtcatttcaccattgtatgaatagttttgttgtatctgagccatttgctaccagcacactcaaaatcttttcagagctaggcaaattggtaatagttgtgatcacaggccactttctgctgtggcagaaataccatacagtgggcaattcaaaaggcttgtttggcctcttcctgcagctgatggcccctggagaatgaattaagcgtctgctgtaactgtggctcaggttgccctccagataacagacagcacagtaaagcgatgctgcatgtccgaggccgcctctccacatctaggtcagaaggctcagctggctaaaaacgttctgaaaatctcaaatcccctgacccgaccctccgcacagacaaggatggatgtgggtctccaagatccagtgggtaatgctcaaccttgcctccccatatcccagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggtttgttgtgctggggctcctgtgctcaagtttgtgaagtttaagtggttttcccaaatacttagcttcctcttaggggaaagggaaaatattagctgtcccactgtaccagatgataaaataaccttgcccttaacttaatttgacttttcagactgcctttatgttttgaaatctcatttggtcttcagtgagttcataaaaatgttttatacactgcagaacactacataaatattgattgtactattactaagtacaccagatatttttaccctcctacgaggacatcctgtcttttgtgtaactcgaggaaaatgtatccacccccatttttccctagctcaatttccggccgcttaaaatactccctcatgagtaggtcccacagagcgggagcacgaagggtggggcaggttaccccagccccgcattctctgatgagagtgggttagatgtgagcaggtcctcttgcctcccagcaccttgcagtcaggcttgtgggtatttcccacacagcaccagccaggctggtgcacagatgcctgggaagggggcagtgtacagagaacatggagctcactcgggcctcaggaatgctggtctatgtgaacctattggtttggtctccagaaaactgggaaaacatggagatgagttattccagctttggcttcagcttcatcagtatcgaggatgggtttttaaacttttgcagaaaaaattctttccagtagccaattttattcaagagccattctggctcttgaagttagaaaacgacgacagaattggatggttaatttggggcagggttgttgcttcattcattacaatttctatctgctgcagtctagagaattacttattaacaggaaagtcttccaatgccatcattgaaagaggctgtggccatcctgtgcaatgggaatccctgtgtttgcacagagtgcagtgggccagcttatgtggctgccgtgccagcctgccatttcctgccaccttactgttttgatgttctcaagggaagggagaggggaatcaccttgtcagataaacgtccaccatgtgacaggtaccttctctcttttttaaaatactcataaatcacataagggtcagctatcactggggaaaatggaatagcatctgcaagtcttgcttactgggaggacgagctcttcttgtgatctgcacacatttcttaactctgtgccccagcttcctcctaggttgtgaggagtgtagtgaaatggtggcagaatagttataatttgagacacgctgtgaacaagcccctttgtcttgtggttattttaggaaccattatcgaacgctgcgccaggctattattgacatggttttggcaacagagatgacaaaacactttgaacatgtgaataagtttgtgaacagcatcaacaagccaatggcagctgaggtgagtactgctttccatgccataaggcacatccaagtacatttccataagagcctgctctggccctgaagcattttctctcccactcaaatgtaaggtggttatttacttggagttgataaagggctgaaaggactggccacttgttttccttggggatgaaaataaactgtgtccacagcaactctgagctccttgaaagaaaggccctgagaaaaagccagtactgaccagaaaagcttggcccaaagaatatggaaggagacgcagacgaacagagactggcataaatggtggtattttagagaatccaaagcctttacttctctgttcactgagctcttggaaaacctcaaagttggaaggtgttttaaaaaacaaagaatgttcctgattcacattaaaagcataccagtacctgaagactatcataaaactgggagtgactggaaagcagaagcatttattgtgttttccttttttaaaacctactcatgtaccttggacctgccttaaggtccttaccaatttggcttttaggaacatgaaacagaaggttcacacctaataagatccactgttctctgaagccatgaagctgttcataaccccataaaggtagaaaagctttccgctcattcctgttgagcggcagaggttggcaaactggatggatgtgaatgatcatcatgagtaacttgctcagtaaggagatgaactgtgtaggacccatcccatgaccagtctggatggagtgacagtgtctacctcacctatttaagctccttcccccagggattccacagcacaacaccagagccctctccttccacagaagacttacaggagcaaggatctggggatttagagaaggaaaagtatagagattcatagaactaggaaggtcatccactcatgtaagcccccacctctgcactgcaacttactattaactgcagtatttatagtaaacagtattactttgataagtaatcaaaaacctccagaacatattctgcccattgatagtctaataaataggtccagtcttaaaccccccaaatgtcatgcagccttttggcttggcagagctctggagacctaattgtttttacacaatcaatttgatggtgtctttaaaagtggagaataacaatctttcaggttctatgtaaatggcctgtgatgtgtgtaccaactcgtgtcctggccacatggctcaggacactgacatcaccactaggtgtggaccagtctttctaaacatggctgaacacacctgctcctgactacttcctactccaaggaccccacgcctacctggctcacttaccagccagtcagaagaacagccaagaaaacatgagtggacacatgccttaggagaaccaaagtgcgagagagttgggtgagttgggggtgggacaggtcataggagggagggagatggtaggcataagtagtagaaatcaagaaataattgaagggttacatgtatgtgccactgccctacctgaaatgcattaaagtagctaaaagctctgcttttacacatttttttaaaaaaactgggagaaatttcctctaagattacatatcaaattgctcaaaataaaaacaaaactgctgtagcagttacctctagggaagaaaatggatgtgaggggtagacaggtggtgacagggactttcaactttcaaactctgtgtgtgtgtgtattgctgagtgtcttttaagactgtatcagtatattctttttttaaagaatgtgtcagtatattatatatggaatttaaaaaaggaaaagctgccttcgccgagtcccagtcctacctgtgtgctcggtgatcaccatcgaatgcctggcgaattaacccttgtgggcttcaccgtcatcttgaaccaagcctgatctgaccatctgttttccagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacaggtgcgccatctttccagggaagctccacttcccctctgggaatgggaactaggtcatggaactcctgggggattctccagctgagtaactttttaccaattagttaaccactcctccctggaagaaagcagcttacccccacctggggtaggcttctggttccttcaggagctgactgatggggctgatcactaaccagagtctcttgagaagggggataaactgagcctttggaagtaacttttcatcttcagtttgctggatccagaacttgcacaaaaaccgagaaatcttccattcattcactaggttattcctgggtgtctacatggcgcgttatgggaacacaggcattagtgaagacatcgcggccacggggagttccagtccaataggggagagatgtagataggtccacatgttagtaaaaaatgaagtgtatctcaaggaagtttatgttaagtgctacagacgttcagagagacttttttctagataaaaggggggctacagaaatggaataggaaaagactttctggaagaacaaagcattctgagcaaaattaacaaagggaggggaaatagaatttttataaaaagggaagagcaatatgtagttcactttaattgtagcagtgtagagagttaaaggagagaaatctagaaagcagtagactgtaaatggacatgtgaaaacagccctacttccagagaagagactctaagcactgatgggtgtgtgggtgacaaacaagcagccacaagtagtgaattttgtggggtctgcatggctgaaatgtactgtggaggcaggataaataagggcaggataaagaatagatgatgcctaggaagactgggaaggggagtgaccagcagaggagcccagtatgtttaagatttgggggtacatgtgcaggtttgttaaaagggtatattgctgatgctgaggtttgagcttctaatgatccatggctcaagtagtaaacatagtacccaataagtagtttttcaacccttgcccccttccctccttttgaagtctccagtgtctactgttccagtttctgccactgtgtgtacccaatgtttagctaccacttctaagaaagaacatgtagtatctggttttgtttctattattacttcactttaggataatggcctccagctctagccatgttgctgcaaatgacatgatttcattcttttttatggctgcatagtattccatggtgtatatgcaccacattttcttcatccagtccaccaatgatgggcacctgggttgattccatgtctttgctaccatgaattgtgctgtcataaacatgcaagtacaggtgtctcttcagtagaatgatttattttcctttgggtatatacccagtaatgggacggctgggttgaatagcaatttctatttttagttctttgagaaatctccgaactgctttccacaggggctagctgatctaatttatttctcaccaacagtgtataagcattcttttctccacaaccttgccaacatctgttattttctgactttttaatagccattctgactagtttgagatggtatctcattgtggttttgatttgcatgtctgattagtgatgctggacttttgttttgtttagtttttttttttttttttttttttttttgagacagtcttgctctgttgcccaggctggagtgcagtggcatgacctcagctcactgcaaccctcacctcccaggcttgagcaattctgcctcagcctcccaagtagctgggactacaggtgcacactgccatgcccggctaattttttgtattttagtagagatggggtttccctgtgttgcccaggctggtctcgaattcctgagctcaggcaatccgcctgccttggcctcccaaagtgctaggattacaggcgtgagccaccgcacccagcctggacatttttttttttatgtttattggctgcttgtgtgtcgtcttttgagaagtgtctgttcatgaaatccagtaagtagactgcagctttctgggaagagagcctctgaattgaagaaaagtaggacaggtagttctgagctttccagagagaagaacaggaagggagtgaggatcaaatgactccttgaacaccagtggatattttaaggctgcttgatcgactgacctgaaatgagcaagccaagccaaaagctgctcatcaatgggcttccccggacccacagagagaggacctgacgtactactcctagttgttctcagtgtgaatggaggatgagaaaaatgtgcttttaagttttttgataaaagcttcctatttaggtgtccttttcccaaaaagcaatgtactaatgttcataagccagggtgacctaaaaatgaaagttacaaatgaagcctttgagctggccttctggcttaatacaccaccaggaaatgcggatcctaatactcagctcaatgaatgatgatggccttagtttaatgtgcagaatactcagatttccacacacctcaaaagctgcaaggctaatacccaagtttgaacaatcatagtttgacagtcattctttccagtgaaaataatggtccatggataaaaacagctggttcagctcaattcaagtgcataagtgctttccacaagacaaccagcagattttggtatgcagttcaagtgtacgtgtactcccatttcatcacattcatcatccagaatattacagagacatgtacttcgaaggtcaagatttaatacaattaataactcttactgcttcaaagaggtaattctcaagtgaaactggttctgtttttttgttttttgttttttgtttttaatgtgagacaagatctcactctgtaacccaaactggagtgcagtggcagtcctggctcaatgcagactcaaaactccaggccccaagcgaacctcctgccttgacctcccatatcactgggattacaggcatgagccattgggcttggcctgaaactttttttaagtgcaaacatgtggcagcaaataatataatgactatggctattaatacagtttggtgctagttcattgagtcatgctaaggtgttagcagttttacccactattgcttcttctcagtgtaaatgtcagtagttttggtatgagaatttgtgtttgtatgacattgaacagagctttgactttgcaatgataaaagcagatcccagaaaaggggctaagtaccctgagatcaatgtgtcaggagatgctatggtatcacatagaaagaggcttggggccaggcacagtggctcgtgcctataatcccagcactttgggaggccaagggaggcagatcatctgaggtcaggagttcaagactggcttggccaatatggtgaaaccccttctctactaaaaattagctggacgtggtgacaggtgcctgtattcccagctactcaggaggctgaggcagaagaattgcttgaacctgggaggcggaggttgcagtgaaccgagactgcaccactgtactacagcttgggcaacagagtgagacactgtctcaaaaacaaaaaaagaggcttgagagtgggaaggtctgagtgtagtcagtgtagctcagctgacttacgtaagtctgaggaccttgctgagcctatttcttcattgagaaaactggataatgacccattttcacagggttgttctgagaaacaggatattactgtgaaagtgtctcgcatgtcctccagccctatgtggtggttttttcttacagactgatgaagagaagagacagggactacctgtggtgatgccagtgtttgaccggaatacctgtagcatccccaagtctcagatctctttcattgactacttcataacagacatgtttgatgcttgggatggtaagacagttactgttttgtcacccaaagaaaattgttatactttacgaatattatctttagtgacacagggtgagcctaaaggtaaacaaaatatatttttaaaaatgtggctgtcagctttttgtggccaagtggggtggggtgcattctttgcatccccagcagctggcacagaagcttgtgtgcagaagacttgatggatttttgatagctggataaacgagtctctgcctcttcaaaggacacgctgccaaagcttactgcagtgtttttctgtcgttggaggaaaactctagaaagaatgcaaaatgtatttagtttactctgaatcacaggttcttctgataatgtcactgataagcagcttttcaaaaaggacctgtttgcatttcagaaactagtgtttaatgacttgtcctcatgcttcgcccagggtgtgcctcctctaattctgatcccaaacttgtcccagacacccccaggcttataaatgctcctggggtctaagttcaccggtttcttttgattcttttctgtctttgcagcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatttttcactcccaacagctgtttttattttacctctttggcctaaagttttcataatttcaaatttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggagggccgtattaggaaaatgcaacactctctaataatttccgtgactagtaagagaaggaagccagttataaaacactgctggaccagaatgaccctataatttcctaagatcattctttatttctaatttaagatttttaaatttacttgccctccatgtcaggactggttagcattctgggcaaaaaaaaaacaagcctgtcagttcactcagaacctactcagctttagagagagaaacagaagggatgatcttgtgcccttgcgctatgtgaatatagccagagactgaggtaataaatatattttaaaataaaaatgacaagggatttgtacactgtaacactatgtagtgttacttctgctgttgcaagtatcttaactgttgaaagctaaactcaggaaatggagaaaatgtacataatatacattgacccattattttattctaaattgaaagtccaacttttagcagcagtctacctgcaactactgaacaccatcaggtttgagtccctaccagaatctcccatcatactgttatcccccatctctgtgaccttagggcatgcatgaaaacaaaagcaatctagtccctagggttggagactgccctctagacagtttttcatggcagaaaattagaatacaagtatacctcattttattgcattctgcttcattgtgcttcaaagatactgccttttctacaaattgagggcttgtggccaccctgcatagagcaagtctatcggggcattttcccagcatgggctcactttgtgtaagtgtcacattttggtaactcttagagtatttcaaatgtttttattcttgtatctgtcatggtggtctgtgatcagtgatctttgttactactgtaattgttttagggtactgcaaaccatgcccgtataagacagtgaacttaattgataaatcttgtgtatattctaactgttccaccaactagcggtttccagtctctccctcttcttagacctccctattccctgagacacaacaatatcgaaattaagccaattaataacctacagtagcctgtaaatgtgcaagtaaaagagtcacatgtctctcactttaaatcaaaagctacagataataaagcttagtgaagaaggcatgttgaaagcccaggcaggtgaaagccatgcctcttacaccagttagccaagttatgcaaaggaagagttcttgaaagtgttaactccagtgaacatgcaaacaagaaagtgaaacagccttactgctgagatggagaaagtctgagtggtctatatagattaaacaagccacaacattcccttaagccaaagcctaattaattcttcaattctttcttcgaagactgagaggtgaggatgctacagaagaaaagctggaagcaagcagaggttggttcatgaaactatccccattaacgtcagagtgcaagggacaacaacagcaggaagttgtccagatgatctagctaagatcactgaaggcgactacactaaacaactgagtttgtgaagatgaaatggtcttctattagaagagatgtcatctaggacttcatagctggggagaagaagttcaatgccagcgagtgtagttggtgcctttaagttgaagtcagagtttatttaccagtccaaaaatcttaaggcccttaagaattatgttaaatctactctgcctatgctctagaagtggaataacaaagcctagatgacagcatatctgtttatagcatggtttattgaatatttaagcctatggttgagacctgctcaaatttctttccaaatattactgcccattacaatgttacctggtcacctaagagttctgatggagatgtacaaggaggttcatgttgtcttcgtgccagctaccacaacatctatgctgcagtccatgggtcaaggagtcactttgacttttaagtcttatttatttaagaaatacatttaataaggctgtagctgccctaactagtgattcctctgaagagtctgggcaaagtcaattgaaaaccttctgggaagcatttagcattctagatgccactaagaacattctgattcatgggaggcggtcaaaattccagcattaaaaggagtctggaagaagtggagcctgaagatgtgaatgaattgctgtaatctcatgatcaaactttaatagatgagaagttgcttaagaatgtgtatagaaagtggtttctggagacagtcatttccacagtgaagatgctgtaaacatagttgaaatgacaacaaaggatttagaatattctataaacttagttcataaaggagcatcaggatttgagatgacagactctaaattttgaaagaagttctactgtgggtaaaatgctattaaatagtattacatgttacagagatctcatttgtgaaaggaagtcaattgatttggaaaacttcatcgctatcttattttaaggaactgccacagccaccccaaccttcagtaaccaccttagtcaacagccagcagtatcaagaccctccaccagcaaaaagattatgactcgctgaaggctcagatgattgttagcattttttagcaataaagtattcttaaggtatgtacattttttagaaatttaagactgtagtataaacacaagttttataggcactgggaaaccaaaaactagatgtgactcactctatttgcaatagttgcttttttgatgtggtctgaaacctaacctgtagtatctctgaggtacgcctgtataatgaccagaaggaatttgctgtggtacttacggtaccatttgcttccaaaattcatgtgatttctaccactccatttgaatagattactatcacaaaatactagcctagaacaggctaggaagtaaaacagttaagtctatggctcccttgtgtcatacaacttcagaaaacaactttacaaatgtatgggccaatgcagaatttctaaaggaaaaagcacgtgaataatgggagaaagtcttctgtaattgaggtagcttaagttttaatatttctccatagaacttttcatgactcaatgttgtttggatttaaagtagtcatataagccttttctcattcagtcttcagttcctgtttttagagctgcttggtgatactgggcactacagatttaattgcaaggccttactgcactgggcctcagtttcctcatttgtaacattatgccactggtctactcagatgaccttaactcttccagtctttgtaggtagttgtggaagcaactgtcaaagctaaaactagtaaaagaacttatggagattccctttagggtatatttgtagtatatttgtataatgaacaaataaatctgtaggttttctgtaagaagggtcagtctgctaacatctgtcacgttgccctttcttcatcagtagtttaagaatttcaatctttaatgtgtagactactttctaatattttcattttttagcaccaaaaggagaaaacatattgttacaaggctggttatagtgtctcaatggacactgcaaagaactacataaaagaagtctgtctcaagcagttcgtatttgagtcagtggtcagatggggcagttgcgctcagctgcagtccctgactccggaaacactgtgcctctcaaatgatctagagctcatccttggcgtacatgaggggcagttgttgttctagtacccatttagcccatggctcttcaagccaattcacactgggaaaaacacaccctcacaagatgcctatccatttgagttcatacaggttttagtagctagaactaaaaaacatttttaaaattatctaaacaaattggtaccaaagaaaacttgccatacttaaacagtatatatgttcccttttttggctgagagattcaagtttgtgctatatagaacactaacagttactaaagactaggaaaatttgcaggagaaaggctatttttaaacttcacaataattctaaaggaagccaaataataaaacttctaataaatgccataacttaactattacctctatttgtacctttcacaaggatctaggttcaaaataagctcaaaacacagcactcaccacttcaacagcagctcaaagtcaaatggaaaaacttgtggtatattctttggaggatatactaggacctgagaagcaacatgttcctggttggtaggtccacaaaaaatttaaacatgtagaattttatggactgacaaaaaaaattaccaatttaagtgatcaatatattaatggttttcagagtagtacccgatatttgatgttcaaggttcatgcatgtgtatttttaattccttaaactagacagcaaggtataagtcaccattctcctctaatttttgaaataatcttaaactgcgcaatccagattctcgctctccatttttccacaaaataatgagatgatcagcggagcacgtcactagtccatgatcttcaaagtatagaaacatctgtaaagaaaattaaaactgattatagggaccccgaaaagcagagaagtgtctaataccacattaacacatgtgcgtgtgagatatgtgccttaaagactcctttggatctgggtgtagaacttcatttcatttttcagtattggtaagtcacatacaaataatatctaatattttaatcagaattttgttaatattgttcaactacagaatagctatttttgtaaagtacatgaattctcatagttcttccagattttttcatcatctgatttttcaagtattggttttacttaaccattacttatactgtataatggctatggaaaaaatgtctgaattctaaatttcccaagataaacactggcttcagctctctataaaagtagatatactcaatccataggtgttaagtgtcagcactacgtttatggtccctaccctcaagaagattctgaaaagcaaatcataattgaaacaataaaggtaccaatgagagattatgtaatcaggtactaaataatgcagtatagactatgacatgtcacagaaattcagaaaaagcttcaaagggagaaaatgccccaagtaaggggaaggggcttgcccagtgaaggaataggctggaagctaagaataggaaaacagagtgttgacaaaaggcagcatgaatactatggggtgaagagttgtatcagaaaagtgaatcaatgaaaaggatgaggtcctcgaaggaaagggtgaaataaaagagaaacagggccgggcgtggtggctcacacctgtaatctcagcacttcgggaggctgaggtgggtggactgcctgaggtcaggagtttaaggccagcctggccaaacatggtgaaaccctgtctatactaaaaattagctgggtatctgtaatcccagctactcgggaggccgaggaaagagaatcgcttgaacccaggaggtagaggttgcagtgagtggagattgcgccattgtactccaacctgggcaacaagagcaaaactccctctcgggaaaaaaaacaagagttttctctgaaatgacatatacatttctgaagaccacaggataagactcagctgaggatgcaggagtgaagggaggaaacatgggagcagaattccttcggaaactggaaaacacaaaattcagtacacaggtagaggggttgcgccagtagagcaaggatgaaaatagaaatgaggaccagcctggccaacatggtgacaccccatctctactaaaagtacaaaaattagctgggcgtggtggcgggcacctgtaatcccagctacttgggagactgaggcaggagaattgcttaaacctgggaggcggagagtacagtgacccaagactgcactccagcctgggcaacagagtgagatgctgtctcaaagaaaaaaaaagaaatgaggaaattcaggtgacactgcaaagatagcctagattttatcaacgaagctggagatgctttttaaaagtgttcaggtctcaacactttcactcaggaaaattcctaagaagctgacactgttttatagaatgagaaatgtgccacattcaaacacattttgaatgtcttttacatggggttttccctaccatctaaaaacctttttaatgagttcctactatttaaaaaataaagtccaaactcctcagccttacattcaaggacatccataatctgaccccaaaccacgttcccaggctttatcccctactagtgtctgttcacaggaacccagcgctccggcctagccaaggtgctccttgccaccacgtaaatgctatctttgcccttctgcctaccacagtccatgctcacctcccaaccataaacacaaagttaaaaactgagctacttgttagaggaaagcaaagataactatgacactgtaccccaacatcaaggagcttatgatgacaaggctatatactcatcctactaaacttcaaggttcagctcaagtgtcaagtcctatatcctctaaccatttacaagattcagcaagaaatgtttcttctgagtcactgctgcttacttgggtccatcaaatgcagcctagggtaacagcctattaggtctataccccttctctccactcaagggtaagatccatgagggcaaggactgttttcatctctctctgtaaactccagcagccagtgtttagcacagtgcctgaaatacaggaaatgctcactaacaaggatgctgccgctgctcctcctaagcatgaatgccctttcaaatgaaaagaaattttttgttctttggctatgaaacagggaagaacaatttaagaaattccttagggccctgattacactgttattagttctcacagctaatctgttacctcaactgatcttattccttcactacaggcaatgatgcctgcagcaaatattaatgtatctggatttctacatgttaaaagcttacgcatttcataattttcaactaaaactttcatatttgcacaatgaaaatcaaggcataggtttcattaaagctaacaaactattatccttcaaaggcaggagaaacaggactctgttcatgaatttgataaaggcccctggaattcgattctgttaaggctttaactgtatacacatataaccacaacccttcatgcatcctctgtttactgttgtcatatagtcaacattattcacactgcccttactgtcagctatctccagctcctaaataatggtgattaagaccattcttaaaagcaatgcattccttgtttcctcaaatcatatatccggaaagggagaccctaactgcacatactatagcctatcccattccatgttcagatctgacaaacacctacagatataagaaaaagtatatgcctttatgagatcaactgaaagaaaagagcaatgaaatgcaaaagcaggagttgcttggacattctgtggctaaacagcaatacctccacagatgatgagtgtccaatcaaatctccaataagctccagtgaacatgaagtagcattttcttgctgctttttaacaggttggctggcttgtttgctgactcttccaaatccccacatgttaaaaaaacctagaaaaagaatcatttccaaaattactgtgctctgtacttacaataacatgagatcagaaaaacaaaatttaaatgtgaagaggttccagacttattttagtcaagggctaagtggacagtacctgagcaccgtgctagggttttgtgaatatgttatttcatctttcttagctaaccaggtctgttcttcatctctttttattgcccctagtcacccactggtgcaggtatattaacaaaaagacacttggaataaaacaggacagaaacaaagcttgaatggcagtgtctaactgtcaagggaaaaaagggcaaaactcagatcaacaaacaaggcataggggaaaagctgtatatgtatgtgcaaaagcaacaccccaggacttcaggaagtcaaaaggaccagaaacaactaggtaccagcatctgatttcttgtgcaaaggttggtaactaatttattcaacccttcagagttttgtttttcaaactaaacacctggaagtcaagagctcataaaattatgatataagcacacaaggaaaagtatgttttcccataaattaagttcaacatcaagggtaaagaacactttggtttgacatctgacggtacaaattttgtgtatcagtcagaattatagacaatataaatgaatacttcattaggccatttggtcattcagattaccagaaagtaagttttccctcaaaacaagaaaatctctatcttacttgaaatgaagtggcagttctacattagggcagtattaagctgtaaatcctagatctcaattaccatatgctttctataaacatctgatgcctatttggagcatttctatattattttagtggtttcacataattgtccttctcctgcctttcacgtgagaaaaaaggagagaaaaagactacctttttgagagaagacacacacctgttggtacaggctcagctgcaagctgctgtttttctcttaactcccaaatgcgtacactgccatcttctgagcatgagattaactgcctgtcagaacagaaaatcagtaatacaaaaagagcgcaccactgagggccaatgctaaatttgcagtgaaagaaatcagtggagccctcaactgcttttattcagctcttagcaggaactgacaaaaatcacaatttagcatgacgttacaacgcaaactaaaagcaccctttaggaaagccacatgttactcgttacattagctcaaatgctataaattgattctctccatttaaaaaaatgcccttgggaaaacagtgtgaattatacttcacaatgtcctaagcagcccccttccctcctcttgctacctctcttctctgggtgcttcactataaaaatatcctgcatagaaaataatgatagtccctgtccatatgttcgtccctagaagctcagcagcaaatctaccctgacaggaaaccactcacttagtagcctcacacaacaaggagaccagcaaccatttgattctggccataaacaaaaagaaggtaggtttatgagaaatataaaaattggtacaatgtaagtggccccaaagtcgtttatgttgttaaataccaaattttaaatcatctcttcttaacaatgaaattcaatgtaattcatttgcaccttgcttcttgtaaattctgtaatatactgccacatacccttctgttagagacagccctcaggcattctccatttccaaaagaacacagcaggtcaagccatgaagccaggtaacttggccacttgagaaattacactggtagccctgggaactgtgacttgctttcatctattgcagaacagatgggaacttgtacctgtttggaagtctggcaacgtgcaggacattggagtcatgtgcagttttctggcaggcaatcacacgcttcatttgaaggctatacacgtataaaccccttccaactgcagcaaatacattctaggggaagaagttcagaaatgggcataaaactagcactcacccttcctagtgtaatggatttccagccctcatgtgacatcagaaagccaccattacctttcccattcctagcctttagcccaaattacagtactaatctctgaaaccccaaaatgtcaaagcactaaagaaagctctgagcatttagaaggtaggacacaaccactaatgcagagaaaggtaggtctgcatagtatatcccttagcgccacttcttcctcactgaaatatatctagagaaaagctatagctagcagcctggccctgcagtggaagctgttgagggataacctgagttttcatttaaataacactatatccttgggaaaattacctagcttcttctgcctgaaaaatgcaagcaaaattacttgcattccacatcttaagcaatcaggagacctacaagtgatacaaaaaagcacggctacagtggcattatcatcatgcaatcctctgaaggtttcaaaaaacatttttccaaatgtactattagaaataaatacctttttactaaaacaactttaatcttttgaaagcattttcactaatacttatctcacttcagcctcacaacatcgtgttaagaaaggcaagcatcattgccattttccagataaggaatttaaaattaaagagattaaagtcacacaagaaatgaaacatggagtcaatattagaatcaaggtcatgttactccagtcccttgctcattcctcacgtgactcacatgcagtagtagcctttgaaatttttgcaagcacctgtcctagaatcatccattcttactcaatagatatccccatgaggcagacctttcaaatatccctacatattgccttcttgttttcaccagagattctgggctctccaacctttctcacacagcctccaagactacaaactcaactcagacctatagtaactgaaccaaagcatgcccccaaggcttgctggaatcttaaatcttgaatgatccccttgactctcaggattagtactctgcaatcagcaatgcagccgaggcccaatgccagggcattaatgaacactgctagccaatgtactaaaatggaaagccctgtggattgtattcaatgccaaaatcccccgaaactcattctatagaccaggaaatctgggcacagtttaagtaatttatccaaggtcaggaagaaaattataaacacaactagagaattcatgagctttggaggcagcatttactcaatggggatgctatccccgctatcaataactaacggtcccttatagaaggaaagaactcacaacaaaagaagaaaaattagggaaaactatacaatgctttatcaagcatatatagtagaaaataaacatcaattaaaaaatttaagattaaaatacaaaacttttaaatattaattttcacaaaagtgagaaaaaacatgtaacatttaaaatagataatttgtagggctacaactcttagtgatctagtctctatcttttctgaaaccatactgtctttatcatgtatatttaacttttttcaaaataaagttgggatacaaagaaacaatctttgaatatattagtgtttctaagtcctgttcctatcctaatcttttgttttgtttttaaagagtggtacaaagaaaaatggatcatattctccccccactacataacactactactgaaatttttaataaaaataacgtgcatgccgttagaaaaattaaacagtatagaaagtcacaaaatagagaaaagcctccccaactccttctcctcgaagggtacaattcataaacatttcttgtgattacatttagaaaagttaattgccctttaaaaacattttctgagcccctgatgctaagagatttgttttttcagatcagagataagattcagtagtccattggtactaatctctcacagcaaaacagatctaaagtgcttcaagagcatcactcccaagtcctataagatggaatccaacaattctcactcaatttatcttgccccaagatgccagcagactgagaaacactcctaaaatttttaattttctttgcctcactaggaaatgtgtcagatcttcaaaagaactctttttcacagtgtttcttaaaacaattttaagcattaacctcaaatccaatgggattatttaatccaacccaaaatttcaataatttttaaatctgtggccatttaatcatttccttgcctcgagattagaagcaaagattaaaatgcttaacacaaatcatccaattttagaaaaagaccattttaaagcacaacctgaaaccatgaatgataccttttttatgtccaacatgggattaaatttttaaaatcagaaattgggttatatatgtcaaaggcaagtttatagatagtgtatacattttttacctcttcatcacatgtgaaatgatgaatagaaatgtcatttgatttttgacagagttttatttcttgttgggtgtccagttgtggagatgggtcccagaagttgcgttcataggcctgcatggtccagtccagggcatcccagatgatcagctctccgacgtgggagccggtgacaaaactcaaatctaggcaaagttcacatatgcctcattatcgatcattttatctatgtaaagatataactgaatggaatgtctagtagtaatgccgtataaaaccacagtaattagaacagtgaggtacctaggcaagccaacagaaagattaatgtaacagaataagaaggccagaaatagactcaaattatcttagtaatttagtatgtaataatgattgcatttcatttcagtaaagaaatacctcatgctggaatatctggttacatttaaggggaataaaagtaaaagaaccttatcttgtaccatacaccaaaataagtttcaaatagattaaaacatgaaagttagttaaaggatggaagaagataaaggtgaatacttttaggaatgtggagtggtaaagggctctaacggaagcagagtggggtgccaggggaagagatcctagtaagtagctgcttggcaaaacaaaaacaaggaccgggcgaggtaatcccagcactttgggaagccgaggcaggtggatcacctgaggtcaggagttcgagaccagcctgaccaatatggtgaaaccccatctctactaaaaatacaaaaattagccgggcatggtggtgtgcaccttagtcccagctacttgggaggttgagacaggagaactgcttgaacctgggacgcagaggtcgcagtgagctgagatcgcgccactgcactccagcctgggcaatagagcgagactcagtctaaaacacacacacacacacacaaatacactgaaatgacaaaaagctgggaaaaatttgcaacttggatgacaaaacaggtttattatacttgatacataaggagttcttggaaattattaagaacaagataaatacagcagaaaaaaaaatgggaaaaggacctgaaaaggcaaaacaaatacaaatggtcagtaaacgtgaaaagatgttcaactcctttaataatcaaagaaatctaaaaacaaggagataccatttattgacttgtgaatcaggaaatataaaacaggaaaatacccaacacagtactggcaaaagcataagaaatcagcacattcctgtattgcctaatgccctactatacattagtatttttttcaaagattaatttgctaatatgtatcaaaaccttgaaaaatgtaaatctcgatccaacaattccacttctaggaatttatcctgaaggaaatacataaatgtacaaggttgttacatacatatatgtacaaatacacaatcttaaaaatctgaagataactacacatcgaattgagaattgaataagacatcaacaaaatgaaatagtaatgctgttattaaaaattaagttataaaagtatgcttaacaatataaacttagatatggaaatatatttatgacatattgttacaaaacagtaaaccatattaatacacatgtacacacatacataggcccagaaaatcacctagaaagatgtggactggtgtttaatactggatagtggaaagattttaatattaacttttatatttttaatgtttttcactattttcatatttttctactatgactatgtataacttttacaagtttttaaaacctttaaaaaaagccgggtgcggtggctcacacctgtaatcccagcactttgggaggccgaggcaggtggatcacgaggtctggagatcgagaccatcctggctaaaacggtgaaaccctgtctccactaaaaatacaaaaaattaggtgggcgtggtggtgggcgcctgtagtcccagctactcgggaggctgaggcaggagaatgacgtgaacccgggaggcggagcttgcagtaagccgagatcgcgccactgccctccagcctgggcgacagagcgagactctgtctccccaaaaaaaaaaaaaaaaaaaggatttttttccattttacatattatttattttacacactatatatttaatagaaaatgtacaactgctagtcttatttcaaataaatgtaatttatttaaattattacatatttagggtaagacagaagactataatgcacttagtctagaaacccaagttctgattttggctctgcctgttgctagacaggtggtctttaggaagtagtttaacctttatcttggattcttcatgcattaaatgagtgactaaaaatcaaattgaataataaacgtgtagccattttaaaaagacatcaaatattatctttgcgcccctggtagtattttgagcccctggtattattccacattaatcgtattaaaacatcctgttacttgttaatttaggaatatacagatgagtaattatgatttaattatttcatttatcaaataaaccagcacgacagaaatctctaatgaccacatgaacaatctcttaagagatacagaattaccagcaatcctacatgtaaatattatttgtcttgactccaaggccataataggtagattattaatatctaatttctatagtttattaacagactctatagaacttgctctgtggagaaatcacttctcatctgtggagcaaaacgggcttctagttttagtagtgggaaagttaaggcagtactcatcttcccaggaccttctttcccacacctttccctcctttttcctatttcattcaaactacaaaagaaccagagaagctaaggagtgaagattccccttgactctcactctgcatctgtagtcacaacacagaattaacctactgagaccatgcagctgcttgctctgacttaatcctccaagtgtctgtgatacctccatgcagtagaaacaaaatattaatgaccagttggaattttccctaaaaataaaatacggcattcagctcaatcagcacttttttttttttttttttttttttgaaatgaagtctcactctgtcacccaggctggagtacagtaacacaatcttggctccctgtaacctccacctcccaagttcaagcaattcctgtctcagcctcctgtgtagctgggactacaggcatgtgacaccacacctggctaatttttgtatttttagtagtgacgggtttcgccatgttggccaggctggtctcaaactcctgacctcaggtgatccacccacctcaagctcccaaagtgctgggattacaggcgtgagtcactgcacctggccaatcagcacatatttttaagcagtttacacatggcaaactaattcccaaacaggtcattcaaaatgtttcatgacaaacaacctcaattatatattattagtggatggattttcatcctgtgtcaaaagccacttagtatgaaaatctcacctggtatctgtctatccatccctcacaagtactagtacttcatgattaccaaaagatgctggcaacataatacaagaaaaggaataaaataaaggagcacccagagccttctgcctggagagattatcagttattttttgtctgtcttagaaaaccttctgcctgggcattccaatctttttagcaaatctggtattcattatccacacttgttggtattctctcatacaattctaaggttgccctggggccacccctctgaaaacagatttgccctgtgatgtacaatcccaagcaactggccatatctttcattggtaatgggtgaggagaaaggagcagagctcctgcaagtgaagcagggaactgtacaacataaacatttcaggatcactgacatccacatcatggctaacgtgcctatgtactgcaagatgagactgtcagcagatcattttcaaattttaacagactacttggtcatgtttgattcctaaatacgcctttggcttatttattatctgtagtataattttatagtcatagagtttataaagtaaaaagtactaatccaaaagctagaagaagacaagaaataactaagatcagagaagaattgaaggagacagagacaagaaaaactctccaaaaaaatcaatgaatccagaagctggttttttgaaaaaattaaaatagaccactagctagacttataaagacgaaaagagagaagaatcaaatagacacaataaaagatgataaaggggacagcaccactgatcccacagaaatacaaactaccatcagataatactataaacacctctacacaaactagaaaatctagaagaaatgaataaattcctggacacatacaccctcccaagactaaaccagtaagaagtcgaatccctgaatagaccaataacaagttctgaaattgaggcagtaattaatagcctaccaaccaaaaaaagcccaggaccagatggattcacagctgaattctaccagaggtacaaagaggagctggtaccattccttgtgaaactattccgaacaactgaaagagggacttcctaattcattttatgaagccagcatcatcctgacaccaaaaccaggaagagacacaacaaaaaaaagaaaacttcaggccaatatcccttatgaacatcgatgcgaaaatcctcaataaaatactggcaaaccaaatccagcagcacatcaaaaagcttatccaccatgatcaagtgggcttcatccctgggatgcaaggctgattcaacatatgcaaatcaataaacgtaatccatcacacaaacagaaccaatgacaaaaaccacatgattatcttaatagatgcagaaaaggccttcgataaaatttaacatcctttcatattaaaaattctcaataaactaggtattgatagaacatatctcaaaataataagagctatttataagaaacccacagccaatatcatatgaatgggcaaaagctggaagcattccctttgaaacctggtacagaacaaggatgccctctctcaccactcctattcaacatagtgttggaagttctgtccagggcaatcaggaaagagaaagaaataaagggtattcaaataggaagagaggaagtcaaattgtctctgtttgcagatgacatgattgtatatttagaaaaccccatcatctcagcccaaaaaactccttaaactgataagcaacttcaataaagtctcaggatacaaagtcaatgtacaaaaatcacaagaattcctttacaccaacaatagacaagcagagagcaaaatcatgaatgaactcccattcacaatcgctacaaagagaataaagtacctaggaatacagctaacaagggatgtgaaggacctcttcaaagagaactacaaaccactgctcaaggaaatgggaggacacatataaatggaaaaacatttcatcctcatagataggaagaatcaatatcatgaaaatggccatattgcctaaagtaatttacagattcaatgctattcccatcaaactactattgacatccttcaaagaattagaaaaaaaactattttaaatttcatatagaatcaaagaagaccccgtatagccaagacaatcctaagcaaaaagaacaaagctggagacatcacattacctgactgcaaactatattacaaggctacagtaaccaaaacaacatggaattggtaccaaaacagacatatagaccaatggagcagaatagacacctcagaaataacaccacacatctacagccatctgatcttcaacaaacctgacaaaaacaagcaatggggaaaggatctcctattcagtaaatggtgctaagaaaactggctagccatatgcagaaaacagacactggaccccttccttacaccttatacaaaaattaactcaagatgaattaaagacttaataagacctaaaaccataaaaaccctagaagaaaacctaggcaataccattcagaacacaggcatgggcaaagacttcatgacaaagatgccaaaagcaactgcaacaaaagccaaagctgacaaatgggaactaatgaaactaaagagcttctgcacagcaaaagaaactaccatcagagtgaaaaggcaacctacaaaatgggagaaaatttttgcaatctacccatctgacaaaggtcggtctaatatccagaatttacaaggaacttaaatttacaagaaaaaaacaaccccatcaaaaagtgggcaaaatatgaacaggcacttctcaagacatttatgtggccaaaaaacatatgaaaaaaagctcaacatcactgatcattagagaaatgcaaatcagaatcacaatgagataccatctcacaccagtcagaatggcaattattaaaaagtcaggaaaccatagatgctgacaaggctgtggagaatgggaagaacatttttacactgttggtgggagtgtaaattagttcaaccattgtggaagacagtatggcgattcctcaaggatctagaaccagaaataccatttgacccagcaatcccattactttgggaatacacccaaaggatatcaatcattctactacaaagacacatgcacatgtatgtttactacatcactatttacaagaacaaagatatggaaccaatccaaatgcccatcaacgatagattggataaagaaaatgtggcacatatacaccatggaatactatgcagccataaaaaggaatgagatcatgtcctttgcagggacatagtcatgaagctggaagccatcattctcagcaaactaacacaggaacagaaaatcaaatgccgcatattctcactctaactggaaactgaacaatgagaacatatggacacagagaggggaacaacacacaccagcacctgttgtggggaaggggaggaaactgagaggacaggttgataggtgcagcaaaccatcatggcacacgtatacctatgtaacaaacctgcacattctgcacatgtatcccatttttttagaagaaattttttaaaaagatagtaaaaaacagtaaaaagtgcatgaggctttctgtaactttcataaacaacttttttctttagttttcccttttttccccttacgaatttggcaaatgaatactcgaagaaagctttcagaaactgctgtaagttcctctgcatatcacatggtaaaagacatgccatgaagttcaggctatcttgtatcatcctatcatcttcatttaagtaaccatgctggctcagtggtgccagtgcttcactgctaaaacaaaataactaagcatgaccggtgtaatgggccgaatactgctgggcttttctcagcagccctgggaacttgagacttaagactcagtgtcaccaatgaggcttcagagggcttcccaaataagaacttgccttctgtgctgtctccatccatggctagagaaaaagagcccccagagaaaattaaagggacaccagcaaccattgttatttctatcaacacagacaatctagtccttagaaagacctgcagctgagttttacaataagatggctatttgggaggaagattttggagctgggagggacactcttactggtgtatctgaacatgtgactgaatggacacaaatggagactagacttggtactctctgtgtccctcgctcccctttgtctcacattcacgcaaaatactgcttaaaaacaaagccggccgggcttggtggctcatgcctgtaatctcagcactgtgggaggctgaggcaggtggatcatgaggtcaggagttcgagaccagcctggccaatatggagaaaccccgtctctactaaaaatacaaaaattagctgggcatggtgatatgcgcctgtagttccagctatttgggaggctgaggcagaagaatcgcttgaacccggggggcagaggttgcagtgagtcgagaccatgccactgaactccagcctgggcaacacagggagactccatctcaaaacaaacaaacaaacaaacaaacacaaacaaaaaaaacaaagccaagccaggcctcagggagatatgttgctggggtgctgtctagccctcccactacatcatactcccaagcagccttacaggatcgtcctgcaggctccaccagactatcaaactgaagccaccaaaagccctctcatgtgacttcatacacagatcacccagcacagttctgatgatataagctgtcacttatctgcaagtgaactgaatgtcaagatcagtggtttgtgatcttgccatctgatgtcagatttagctcacaggagatactcattaaaatcatttaggaagccaaataggatgtacagcaggtcaaaacccccaccacgaggaaggaagggaagacatgacccattttctgcagacttttactttagtttggtattattctttgagagtcttcaaccaggattacaactggcttgaatcctgctcattctagtgtaagtgtgtaacttgctatgtgatattgtatggtgtggacagcaagacaaaagggcatatttccaatctctctacaaaagaggaactagccagaaacagctgccaaaaatgctgaaacagcctgtgacagtcatcccacagctaccaagcagtgcctgagatcattatgttctcctctattttctctgccttacactattttccttgtccctaaatcttagacctagcaatctaggaaacttgctcagctccaccggctaaaacttcagagtaaaagagaatgacaatcccattattttagtgacttattctagaatcccagaactaagcaaggctcgtgttcagagcaggttgtgttaacaagcacaaaactgtacataataaatgtacacaatgagcttaccattgacattaatcaatgagagaatattatcctggtgatcaaggaggcgcttaacttcaagaatatcccattctagtgatccttctgtgggtgctaccaacctgaaaattactaaatgaaaaagacagataaaattttattacaatgctctaagaggataaaatactactcctgctctaaaaacaagcatttcattaagtgaaaaatacctaccatactgaaaaacccatctccaaaaaaaagccttattcatactactttaaactatttctttcaaatgcttgagatgtttgagatgatctactaaaacccatactgaatgtgtcctgaagaactctcttcctttactgacttttccaaacagtgaagctcccattctctctagggtttcaacggatgtcttgttatctcaactcactccctccctaatcagtgactagcccacatccctcaatcacctccaacatcagctttctctactcatgtctcttactcatgtaagcattgcgacagaataagctgcaaatccaagtttaacttcaactcagtgaagacataagcaacttcttttttaaaaagcttctgattcctaggcatataccattaaattataaattctctgagtatgtcttataatgtttatatatcatacagttcttctgactatagtaatgttcaatgtgttgctttactcattatctgactttaacaaatacagttttatttaaactagtataaatcctaactttaatcaatacagaaaacccataataaaatccacagacgtgattctatcatcatttactaaacatttatgttccaggaactctacgtaccaaatgtgaataaggcccagtcacaaatgctcagtctagagtgggagagagacttgtttataaacaggcttaccgtcaatgtactgagtgttttaaaaatacaccactggaccaggtgctgtggatgctcaaagattagcatcactaacatctgagaagtgacaagtctctgagatcatgtccttttcaaattacgaaagtatcttttctttctcacatttctctctagaagataggtcatgccatgcttctttctgtgtctctgacaatattttaccaaactacaaatctctatccaggttatttaatcctgacagctactcatattcaaactgtggttgtcaaaagaaggtttttcagtcaatagaaaagagaactctttctgatacacattgaacttatgggaaattctactttagttggaatattatgaagtgatcttgagactggaattttggaataacaagcaataaactgtttaaccaagctaacatactgattaaaacactgataagaaaaagaaacctggcctaacatcctgaaaatgtcttagtctctgtatcacttcaacaatcccaagaagccaagagtggggcacacgcaatgtcccttaaataaaaaattactttagtccttccagcatgtgtatacaattctcgttcaaaatacacaaaaagaaaaaaattcatactcactcagttctttgccaactgctgccacaacacagttcttaggtatttcaaccaaagcactaatacctccaaaaacatataaaacaaagttcaaattatttttctcacagattatatcaaaaacaaaaacattctcagttttatgtcagtcgttttccataaagaagataaagcacacagaactagctccacacacacttccttgcttgcttactaatggaaaatgattgttaaatgtaggtttctgagacttttggaagacattattgatttattaagagcagaatatggggttgggtttttttgtacttttttttactattgtgataaagtggtagattcagcaattcacacttatttaccagggatcccttaagataatcaccatcacccatttacaagatggctagctcaaaagtgatgtaaaattggggttttccttcatgtaaactttagaagcctgagcaggctccctggcattgaatgaactagccaacagtcagcagctaagaaagcagccttcaaatagcatgtttgtgatccactaatacatgtaaaatttttcttctattaatgaaagaatcagattcaacattctaacacacttcacttatttaagtaaagaggttaatgattttagcgtaactataacttctacaaggcatgttacaattttgcttctgtcagtatgaataaaagagttgataaattagaaccaccacgtgttggcaaaaaaaaaaacctgtttaatttttccattatgatatatatgtaatttataatatatatgcaagtgtagaaaacggtctagtcatttgcttatccttcccatccatcaaaggactgactgttgtgatttggatagtatttctggccaagatttttctccacataggcatattttaacagtaggttttgtattttcccatgtacaagaaggaggaaatggtgctgcaaggaaggcaaaggaatggtacagagaaggcagaggacatgggagaacagcagggtggatagcaagagaagaattctaaatgcagaaaacagcttgtttaaaaatctttcactaaattatatgtgaaaatactagaagcccaacaatccagatgtagcaacctaatactcagaatcacaaaacatattactggaaaggacacggatgccctgtgttttagtccagggctccttccattgtatcacattgactaagattgtctttgcttatttccaaacacagaataactgcttgtaaaagctccaccagtccataaatcaagcagggcttatgaaaggacatcatgacataaggatctaataacactattaacaatctggcctccagtaatttggaaaacccaaatgatgaacagctcaccaatagtaacccatggccttctcaaggctttcccatagataccctcaaagccttctgttaactcttgagacactgataaatggcagtattgtaatgatttaatatatagtacttaaacataacttgcaaaacaaagggagactgcaataagaggtggctatttccaggaacacacagaagattcttttcagccccaatttcaacattttacaatataactttaccaaaataaaattcatgaaaaccacaggctagtgaaagagagagaaaaatgaacataaagacacataattcatgataatagtaaacagggaaatatattctagatttgagcaagactattagtaatcaaatgttgaactgagtggttaaattgtaaaccctagcaatgtatggatttagttttcctaagtcattatgtttctgatactttaaaatatctacgtggagctaagctagctcctattagtaactaaattcaattcacagggctcctgctaccactgaaatatcaacaacatgcacaacaatgttccttctaggatacccaggctcatttgattatttttagaaataacaatagttagtgtgacttcaaggttgttattaaaatctactcatttaaatattttactctaaaaatagattttattttttaagatccttggtatcaaaaagtcaaaactgatttgattattttttttctgttgaaaccaaaatcgtatgtacacagaattgtgagaaaatgaaactttatcagtaagcttgcacatgtatgatctttttggtaaggacaattgtaaaaagaggtcatccttaggcatttattcaaagttaatgaccccacaaatgctactgtaaagtcgtaagggtctgcttctaggtatcagcgtgctcaccaaacacagttcaggaaaacagcccaagagcattggaaaaggttgttcctgagtggagtcttctcctcctgattcaggataaaaatatattttacacaaccccgatctgaattgaatatggctacctgttatcttcagaactgaaaaagaaaaatcccctatattgacctttctacttatggaaagtctctctgaagatctgctgtgtcttctagtctgtcaatcatagttcaaaattaccttgatgttttttacctgtatcagaaaggtggctagtcttacacaggagatctaattttcggttccacacacacaggtcattcccaccagaaagccaaacatctagtctctgaagaacagttaaacactgcaaaatttatttgaaatgtatatcaggttagaaacttaagcagtcattgttcagtggtttaaaaatatatccacaagttctttaaccccttccttcactaggtggagcttatttctccttagtagatcatgtgggcactactaagtgactagcttctaccaaacagattctggcaagaggaatggtgtgtgacttacaagactaagtcataaaagatactgtggcctcctccttgttctctcttggatcacgtgctctaaggtgaagacactaaagcagtcacatggagaaaggtccatgtagcaaagagctgaggcttctgggcaacaaacagcactaacttgccaagcacgtaggtgagcctcctgggaggcagctcctccaccgcagtcaggccttcagatagcaggagcctcaggagaggccctgagccagaaccacccagataagatgctctctagtcctaatcacaaacactgtgagatgacaaatgtttattgttttaagccactaagttttgaggtaatttgttactcagtaataaattactaatacacaattgcttaaacccctttttaaatcaaattgaaactatgaccttagtttctctgtatctttagaataaataatgcccaagtcttctcaattctatacatttggtagtcaggaaagtgagtgtttcaagtaccatataagccctttacctttaatagtactctcctcgcccactgactctgagtcagacaagggcaagagcgagagagaagaacagaaaataaaaggcagaggttctggtaatcttgcctaggctgcttttaaaactgttggattaaaaagagttgaaaataaccaatgcagtttatatttctagtggtcctaccctgtctaatctctgaatttttaatgccagtgtttcatttctttttattgccaaatagtattccactgtgtggatatacattgtgtttattcatcagctgatggacatatagattgtttccatttttgactattattaataatgttgctatgaacaatcatgtacacatttttatatgaacttacattttcatatctcttggggatataccaaggagtaagactgctgggtcaaatgataattctgtttaaactgttttccaaggtggctgtattgtatcattctagatcccaccagcaatgtatgaaggttacaattgctccacattcttaccaacacttgtcttttagatattagccactctagtatgtaggaaatagtatttcactgtggttttgacttgcatttctctaatgactaatgatgttgaacctctttttcatgtgcttatttgctatttgtttatcttctttggagaaatttctttctttcaaatcttgtctatttttaattggagtatttgcttttttattgaattcttcatatattgtagacacaagtcccttatcagatatacaatttgaaaatattttctccaattctgtatgttgtcttttcactttgaagcacaaaaacttttcattctgatgaggtccaatttatctttttttgttgtttgttgatatgcttttgatatcatatttaagacacctagcccaaggtcacagagatgtacgcctatatttcttccaagatttttgtagtttcagctcttacatttgggtctttgacccattttgagttaacttttggatatgatatgtggtagggataaaatttcattattttgtatgtggatgtccaattgacacagcatcattttttgaagagactattctttctcccattaaaggttcttggcgctcttgtcaaaaaatcagttggctatgtgagactttacttctgggcctttaattcggttccattgatctgcatgtctgtcattatgccaatatcacactgtcttgactactgtagcttcatattaagttttgaaattgggaagtgtgtcttggaactttgtttttccattttaagattgtttcggctattctgggtcccttgcactcccatatgaattttaggatcagcttgtaaatttctcaaaaaaaaaacaacaaaaaaacaagccagctacaattttgataaagattgggttcaatctgtagatcaatgtgggtagtggtggaatcataacaatagtaaatctgatccatgcactcaggatgtctttccatttatatagatctttaatatctttcaacaatgttttgtagtttttggtatataagtctcatactacttcaaatttcttttaatagtgatggggtattgctatgttggccaggttagtcgtgaactcctgacctcaagcaatcctcccaccttggcctcccaaagtgctaggattataggcataagccaccccgcccagactaaatctatttctgagtattttattcttttggatgcaactgtaaatggaattgtttcttaatttttggaatgttcattgctagtgaatagaaatacaattgatttctgtgtgttgatattatatcctgaaaccttgctaaatccatttactagcctcaatagtttggttgtggacttaggattttctatatacacaagatcatgttatttgggaatagagacagttttatgtcttcctttccaatatggatgtcatttatcttttttattgtccaactgccctggctagaacctccagtacaatgttaaacagatgtgctgacagcagacatccttatcttgtgcctgatctttgggggaaattatttgtctttcaccatttttaaaaatttttattttattattttttttgagacagggtcttgctctatcgcccaggctagagtgcagtggcacaattacaactcactgcagcctcgaactcctggactcaagtgatccttccacctcagcctcccaaataactgggattacagacatgtgccaccagacctggctaattcttctttctttttttttgtagagaagtttcaccatgttgctcaggctggtcttgaactcctgagctcaagcaatccacccaccttggtctcccaaagcgctgggattgcaggcatgaactaccacacccagcctagcctttcaccattaatacgaaattagccttgagattttcacagaagccctttattaggttgaggaaattctcatctattcctagtttgttgagtatttttatcatgaaagggtgttggagtttgtcaaatgccttctctgtttctgttgagatgatcctgtggtttttgtcctttattcttactatggtgtatttcactgatgaattttcagatgttaaactaagcttattccagggataaatctcacttagtcatggtgtataattctttttagatgttgctgaatttggtttgataatattttgttgaggataatatatgtttttgttacttaacattttaccactagcattttcctcttttaatattcttctgaaatataaattttagtatatatatctaccataatgtattttcttataagacatttagggcacttccaatcatccatttataaaaatgtatttgtagtacacatttctgttcataaatttctgccctattttctgatcatttcctttaaagagttttctagaatgatcactggattaatgcatataataatttatttagattcattcataatgccaaactaccttccgggaagatcatatcaatttatagtctcaatatgcaataaaatgccaatttcactatctccttgctaacatcaacccttataaaaaattttgttagttcaaaaaataaatgatagtatttctcatattagggatataaatttcttggataaactatctattcaagaacaactgaaccactgaactaaatgagtgcaatgctattttttaacaatttttatgtgaaacaggatcacagcaggagaaaacagacacaaatatctagctgattcacattacagtaaaaccccttttaaaactactttcactatattggaataagatacttttttagtgaccagttcctataaccagttcataacacagtttaccaaaaggaatttcccccaaatacattaaatttttttctctttgttccttcaagccacatattttcattggaaacttaacgaccttagtttttcaggtagcaagaatatttttaaaggaatgtaaaaggcacatcatttcaggtcacataaagtatagagattttaatcaaatcaatactttttaatgccttcttaaaaaatccactgttaagttagatagaagtatatatagtacatggcactttcttcccctgaaacttgactaagttgatattttgaacagcacagtgccatgagatggctaccagagattctgcctttttgggaaaagatcaactattctacctattggcacacagcaattctttttacattaagaaaaaaaagaaaagagctccaatatggagatcagttatccttaaagtaaatgagggaacatctactgctactactatcttttccaaaacttgcttacattactaaaaaacagtggcactttctctgaacacttaatttctgtaggaatcacaagcaaccaagtcttatctatgtttgtttctctaaaacgtagcagagcttctgtcatatcattagccccaattaataattgtttgtaaaaggaataaacctaacagtaacagcaaattagccaggtaagatttttagttttgaaactaagtaactgacatgtcttgcctttgtgaccttagagaaggcaaaggtcatgggacaaatagctctatattttaaattcaaagtataaagaaaacagaccagctactattatggtcattctacaagtaatatctcttcctggaactacctacaaaaaacataccaggtactaccttttttccttatcttgctattgggattatcccttgctctaatttcaaattgaaacattctaacacttaatacatgtgctctcaaaaatctgatcttacacgaagcaaatgactacaagtgtgtggaaagaaataattcataagacccacaaaagtaatttcgtctaactctttaaaccatgtcttctgagacaaaaatagattgtcataaaaactcatatttacttaagattttacctttacagtagactggaagcatgatattctctgaacttgtctggtagtatcaccatcccacacctaaatttatgttaagaaataatttctaaacagaattttaaaatcttaattataacttttctaattaacaattaagccacaaatgttaagcagttagaaaatctttaaatcaaacataaaatatttagtgtttataccaccacaaaaatgaattcatatagtgagtcatcaacttagcaaagcaggcttataatctaaaataagtttgaggtaaattttactatcaaattatttgaaaatgccaacataatgaatggtctgaagtactgaatctttacaagcactaaatattccaactgtttaaagtttattctccagaatagcccaccataatctaataagcataaagtacttataccaaaaactatcatgtccattaatatttactgaaagctccctataatatggatagcatgatttactactgttatcttgattcgagaagacactaacagtgtattactattacctgtatgtgcatttaatataatcagagggcctctcataaaacatccaagttcagtttgacttaagcacagtgattttcaaacttttacaccatttcctatagtaagaaatacattttacaccatgtctgaaaacacatttacatacatgtatgtactacgtatacaaatgtatatgcatgtattaaaaattgaaactaatttcacaaactagttaaccttatcatggccaatgccttttgttatatttttattatacagatgtgccttgacttaaagtagttatgtcccacaataaacccattctaagtggaaaatatcctaagtcaaaatgcatttaacacatctatcaaacatcatagcttagcctggcctaacttatatgtgctcagaacacttacataagcctatagttgggcaaaaaaaaaagtcatctggcaacacagtacactgtagagtaaggctgtttacccttgtgatcttatagctgactaggaaggagctgcagctccaggctgctgctgcccagcactgggaaagactatcatcccatgcatcactagtgtgagaaaatatcagacttcaaaattcaaagtacagtttctacttaatgcacctccctttcacaccatcataaagttgaaaaactgtaagtcaaaccaccctaggttggggaccatctatattctatgtcatgctttagatggagctagattatcatgagaattacattttatgtatataacacactaaaactgctagcatacaaaaaatgctcccagtaattaggaaatgttttctggccttatatttaccagaattctagtagtatctcacagccttttcacttatttcactattcacaagcagaacatttaatattcagtaacctgagctcctaaggctatcgctttaaaaaattatctaccttcagtatttaattaaggaagttagtttttacaggttgggtatcccttatccaaaatgcttaagaccagaagtgtttctgattttttttggattttggaatatgtgcatatacctaatgagctatcttggggactgaacccaagtctaaacacaaaattcatttatttttcatatacaccttatacatatagcctgaaggtagttttatacaatatttttggtaattttgtgcgttaaacaaaattttgactgcaacctgtcacatgatgtcaggtataagattttccacttgtggcatcacgtcagtgcttaaaaggtcttggattttggagcatttcagattttggattttcagattagggatgctcaacctgtagtaaaaacccaagcagagtaaatttagaattcatttgggtaagagagactgccaaataagcggcctagaatttttttctaacaacaaaaatcactcagcaaaggaaatgagtccatactatcatttacaggtaaaattcatagtgacactgtaccagctactaacttctgtatgtaattttaatcactgcctcaaaatattgctatagtgtcttaggagtggtctaatagagtattttaaattctatttttgcaaagattacactgatactgaaaaagagagctttatcccatatttgcctctacagagtagtaataaagcaactctgacctaaccatctgagagaattttatgcccttgtttacattgtatcataatcacacacaaacatacatatatgtgtgtatgtatatatgtatgtatgtatagagagtttatccccatttaaaccttttcttgacattttttcagctatgaacaatctgtctagaaagcacttcagttgatgaactcatttaaagcatgttcaagtctgtatcttggttctgtaagagcctaagaaacacctatacttttgggcttactccaaaacttcaccaatgcttgaaagtgtttacacagaactttcagataagcatatacttttaaaaattaatatgaccggaaacagtggctcatgccagtaatcccagcactttgggatgccaaggcgggcagatcacgaagtcaggagttcgaggccagcctggccaatatggtgaaaccccgtctctactaaaaatacaaaaaaattagccggacgtggtggcaggcgcctgtagtcccagctacttgggtggctgaggcagaagaatcacttgaacctgggaggtggaggctgcagtgagccgagattgtgctactgcactccagcttgggcaacagtgagattctgtctaaaaaaaaaaaaaaattaatctgacaacctcttttaaaaaaataaaagtaatgaaagacaacagttatccatagcacttgactctggacttcaccaagccaattcctcatacagatattaaagggctgagtttgtttacagaaaacattttatgaagtgcagtggttcggggctctgactctgcagtcagacttgccagttctgccctacactggctgtgtgccttgggaaagttacttagcctctgtgtgactctatttttttcatctgtaaataagaataattaaaaataaggccgggcgcagtggctcatgcctataatcccagcattgtgggaggccagggtgggtggatcacctaaggtcaggagttcgagaccagcctgaccaacagagtgaaaccccatctctactaaaaatacaaaattagctgggcgtggtggcacaggcctgtaatcccagctactcgggagtctgaagcaggagaatcgcttgaacccaggaggcagaggttgcagtgagtaaagatcacgccattgcactccagcctgggcaataagagtgaaactccgtctcaaaaaaaaaaaaaaaaaagaattaaaaatacctatgtcaaagggctaattttaaagattaaatgagttaatatatgtaaaacaattagaacaatgcctgttacacataagcactttactactgctatcccatcttaactttttacctaaaagtatgggtaaagaaaaagtaattttacttttataaaattgtttttaattattaaatattacacactgaacaaacagtaattcacttttctatcagactcagatgctccaaagatttttatgggttgggaccatttggtttcttctgctgtatagtggggaaaaaaaatgtaaattattctccagtccaactcatcgttgtttccctaaattgaaaagcaaactgagatagtaaaataaattatttttaagtccacattttcccatttcatcaattttatacaacctgatagagtaactctggaaagaacagcaatagtcacggagtttccatcaataacaagccttaacctcctatttccagtctaatacttttcagatacctaataaatggtatcttataagtaacagaacaaaaatcatttttgctataacaagaatatacagacaagaccctatcagctaaagactaatagtgtatgtagtggctccttaggccactacagcttgttcatttcttccagattaaaggatacaataactgttctatcagcagaggctgtcaagatgagttgatttttctcttcacaagattccaaggaaggaaatgtaataatagctgttatcttttgagtgtgtccattcagttctaaaagtttttcccctgtctgaaataccaataaaaatgttaataggcttagctttcacaatttagataatcataaatgactacattaagtacaactaccatatagaagatacatatacattccatttaaaattacttattcagaatttaacttaagcaatcacacagaatctaaacaagcactgaaagtacagccataactatagttttattttctaaaacaaaatgctaatttttagtatatttttatagaaaattttgagtatttttttctataaatttaaaaatataattgtgtaaattaagcataaaaacatcagtaacttagtttgcaggaaaaaaatatggagtcctcattgtccaagtatttgttatttaagtctccacagttataaggtcatagaagaaaataaaagtcaccataacaactgtatatgtacctacacacaaataagtatatatatccactcatttattaaccacttagaaagtcagtctccactccatcgttatttaacaccaacatctattcctacccatccagtgtcttcatccatcagtctctgactaatttaccaagtagtaaacatgcaaaaatacaatgtaaatggcaaatctttccaagattgcaggacttcgtgaatgtggtgaaaataatgttaaagaactgattttatcacaggcaaagccattgaaaaataaagatctgacacagtcagactagataacaatccaaaattaaggtgagaggaagatacttcaaaaaagaataatttgagtaacaaatgatcaggaagggaggctctgaagaaactggtgaagccttaagtatttatttaaaaaaaaaaggcttttgtaatattaagtcaaacatgagaaaaatgttacattatgctattacgcaatgttgaaagaaaacttgtgtgtctcacaaaaatcaacacaattcatttattcattttggaagtcagggcatagctagtgataacctaaattttgttaaataagattaaaattttgtattttttgaattttcatactttggcatttgtttcttaggaaaaaactttttttttttttttttttttttgagacagtcttgctgtgtcacccaggctggagtgcagtggcatgttctcggctcactgcaacctcagtctcccgagtaactgggattacaggcatgtgccactatgcccagctgatttctagtatttttagtagagacggggtcttgctatgttggccaagctgttctcaaactcctggccccaagttatccgttcgccttggcctcccaaagtcctgggattacaggcacgagccaccacacccagctggaaaaaaaatctcaatttaaaaaaactttccctcttcattatgaaatactggtccccactgtatatggatttatcctaattagctcttttcaaatattaatgtgtcaattaacagtgatatgtaaatgtatccccagatagtatttatatgaatacatactcaactacatcatcatatctttatcacacaatccacacataatcaatacacacctgggcattccacacaactacaattccatcatcaccagcagatgcaaatctggttagggagaaagggtcaagaaaaaaaaatcactggtgacatttaattactaagattaagaactatcaaaccttattagtggtattttgactaatattaacgaagatcaagttatttcagctaatttaaaaaatatttatgaaacacattccagcttctgtaccaggtatggaagatcaaaagataaataagacatttataagtttacaaagaataaactgctagaaatgtaaaaataatctttaaagtccttctttgctttaaaattctatgattttaagaaatccctgacttaagtgaaatgaaaccaagctgacaagtgccttcagtgacaggaagtgatattctaggaagtgattacgatgttaaataaattcattacttctattattctctctgtaaataattattatttaaagtcaagatctctcttttgctcagctcaactccttagtctttccacataaatgctttgttcttggtttggaagatttgaggattttttagggtttttttgttgctttttagtgaagatgcttgaaatgcacaggtaaagcttgtcttatggcatgaaaaatgagctgtgatagtctgctatagcttctctctcctttttatatcccattcaccatatcacagggacaatcaccaaattctgtagagtagaagatattctgaacataaacactatcaaaaggaataacctgtcatacaggattattcatcaccatattatactaaaattcaccatcttattatactaacgcaacaaagtagtataaataatcacatcataagcatgtcaaataatttactgttaatgtcatccacaagtttgtaaataatttttaatgactcagaatcaatttaaagttgtccccataatattgctttcactcaaattcaggctttttttttttttcagtatgagagaaagaagtggtgttaaagagagccagctatgaatgacatataactggccccttataattaacagatgctatgtgagcatctgttctaatggattttttacccctttatgagataacaaaatcccactatttcagtcatgaaatactttccttaacactccaaactgagtttcatgttcaaatttcttatcttcagtttcaaagttcagtgccttcactggctcagacaattccaatactcagttcttatttcaaaatcctttgagtacatctactactggtagaaccaagattattcaggagacatgaaattgatcaaatacagtctgacagtcttttaataatttttaaatacagaactacctatctttttaacagaatggacctgttaaatttaggtaactagctaaaaatcacaaagagttatttttaaatccatgcctatcatttattcttattttaaaatgtaacatataaaagatccggagattaaaaagaaaatgatcatttttaaaataaaaatagatttcctatgcttaattatctacattttctcaatcagattagtaaatagtaccttgaatatcaaaaatagttgctggaaataaatctttagcagcttatgtttctgggcctattgatttctttttatttgtatagtgatggtggggagggcaggactcaaggtcttaagtgttctttggtataaaacatcaatttctattgattctttaaacttaaaattgcatttagaagacagcaagtttaaaatacatactttttttctaaccctaatttttaacttcttatgattgttttatcatgtttgactttcatgagttcacaatgagagatgactgagaacagctgagagtttagaaatgggatatagagcatttaacctcaaactttaattcaatcagtagggaacaaaagttaaatctaaataaggctcaatagtaatgcatgaaatcacagtcaattttttattgctgcaaggtcaattacctggttggtagattattcaggccttctattcttatatatattctattgctaccattttttttttttttttgccatttcagtatttattactacctcccctaaagaggaaacattaagctttaaaatacaaaccagtataactttgacacatattagtacctgtcataaaaaaactaataaagggttgagatatcattcacaaattacaattacccatcctattatgatggataacaaaaaactagctatactttatcagtttatcttaaactaaatcctagtcagtcaagcatacacttcaaccatctccaaatcagaaatggaaatacaacccaagaattcctaattgtaaggtatagtgtaactgctgaaaagaagtaatgaactataaaataaaaaaaggattaaaatgtcaataaagtttaagctattctatccaatggaagaatagtaatattgccagataacattttacatactaatttttaaaaacattctaaagtaacagaaagcaaaaacttaagcctaaagataagattttgagagaaatgtttctttaccgattagcaaaaaatgtattcagtgtgattccgtgctaggagttagggaaatgtgaagacaccttacatgtggttcttgctttgagatcttaaaactttatgattgtttagaaatgtaccgtatttcatcaaatctaagacatcaattgtaagacactcttattttatttaccattaaggaaaacatactgccaattacaattgaaacacacaattatatgatgtgtccaaattttagagatgtcaaaatagaaaaaaatatgcttcttagaatcatgaactctaagaattaccatatttattgatctttatctttataacatggcacttgccagtctaatgaatctctgattatctctggcaggttttaagtgctaaagaaatgcttgttgaatgaataagtgaatgcataagcaaacatttaagtgttcaagggctctgtgaaatagattgattaatgatggcaatgtaaccccatattttccttttatcataattaatgtaaatatactaccacaaaaaatagaaacttaaaaatttaaaacccagaatccctaccacacaaaaataaatttctatattttttcatattcctgtccaattcttatccatatacttcaggttttttctttaacttaaaaccaagtccaagatcacaccactctccagcctggacaacagagcaagactccatctcaaaaaaaacacaaaaaacaaaaaaaacccaagttgttaaaaatactccttgagactacacaattaaatgactaagcaaaacttacattcatgaaaaacaagttcaacaaggtgaaacatggtttaacaaagacctatggcagacctcctagaatgtttcatcctctcatcccctaattatgagaactaaatttattatgatagtccataagtcactcggtaattcaatacttactaagcactaactatatagatgcttaaacctaagaataaagatcaagagattgttcttgccattcaagaactcacagtccaacattaccatgtgatgctatagggtctagatcatgagtccttagagaattctcacttacaaccatcttaatgtataaaaataattccctctaaacatcttctctttgaacatctctgagaaagtattctctcgttccttccaacagtgggctgaaaactacagcaaagcttaataaagatttgtaaaaaataaattgttttcacaataattcttatgtccaatagctaaatgctcatttaatagttcttactcatgtgaaggcctttcaactaagtgaaggtcccaaaaattcaaatgttaccttaaaggacataaaaagtatagtccataaacctgaaccataaatcttcctgtattcaatgtctacataaggcactgaaaaaataaaaatcttaatacgacattattatggcagtacaggcaccccagtggttaactttccacctaacctgcaagtactttctaatgcatgataaaactaaaatactatacagtttccatgatcatctcatcattttttttgtacagtaagacgcaggatctaaataaggtctatatagcacaactgcttgatatatctctaaagtctcttttttctatggttttgttctccatctttttcttccttgcaatctttttgttgaaaaaagttgtctctcttcaacccaaatgtctatcaatgatagactggattaagaaaatgtggcacatatacaccatggaatactatgcagccataaaaagggatgagttcacgtcctttgtagggacatggatgaaactggaaaccatcattctcagcaaactatcgccaaggacaaaaaaccaaacaccacatgttctcactcataggtgggaactgaagaatgagaacacttggacacaggaaggggaacatcacacaccagggcctgtcgtggggtgggggtaggggggagggatagcattaggagacatacctaatgtaaatgatgagttaatcggtgcagcacaccaacacggcacatgtatacatatgtaacaaacctgcatgttgtgcacatgtaccctagttgtctctcctgtataattctcacagcccagattttgctgactactttcctctgttgtcatctaacatgcacctctgtattctgtatttttagaaaactgatccttaaatctacagacttaatccaattcaaatctgactctttggtaagaccatttcataagcagtttgtatactccattaggaaacaaatttctggcagtcatttttgcgtgtgtgtgatgttaacacccatcaataatcactgcctgaagtcattattacatttacaataaaataacattgaaaaaatgctaagggtatcagtgatggaagatcaaatgaatgaaatgaagtgagaagagaaatttagagaaaaaaaggataaaaagaaacaaagcctccaagaaatatgggactatgtgaaaagaccaaatctacgtctgattggtgtaactgaaagtgacagggagaatggaaccaagttggaaaacactctgcaggatattatacaggagaacttctccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacgaagggaagcccatcagactaacagcagatctcttggcagaaactctacaagccagaagataatgggggccaatattcaacattcttaaagaaaagaattttcaacccagaatttcatatccagccaaactaagcttcataagtgaaggagaaataaaatactttacagacaagcaaatgctgagagattttgtcaccaccaggcctgtcttaaaagagctcctgaaggaagcactaaacatggaaaggaacaaccgataccagccactgcaaaaacatgccaaattgtaaagaccatcgaggctaggaagaaactgcatcaactaacaagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcatgcacggagacacacataggctcaaaataaagggatagaggaagatctaccaagcaaatggaaaacaaaaaaaggcaggggttgcaatcctactctctgataaaacagactttaaaccaacaaagatcaaaagagacaaagaaggccattacatcatggtaaagggatcaattcacaagaagagctaactatcctaaatatatatgcacccaatacaggagcacccagatgaataaagcaagtccttagagacctagaaagagacttagactcccacacaataataatgggagactttaacaccctactgtcaacattagacagatcaacaagacaaagttaacaaggatatccaggaattgaacttagctctgcaccaagcagacctaatagacatctacagaactctccaccccaaatcaacagaatatacattcttctcagcatcacaccacacttatttcaatattgaccacatagttggaagtaaagcactcctcagcaaatgtaaaagaacagaaattataacaaaatgtctctcagaccacagtgcaatcaaactagaactcaggattaagaaactcactcaaaaccgttcaactacatggaaactgaacaacctgctcctgaatgactactgggtacataacaaagtgaaggcagaaataaagatgttctttgaaaccaacaagaacaaagacacaacataccagaatctctaggacacattcaaagcagtgtgtagagggaaatttatagcactaaatgcccacaagagaaagcaggaaagatctaaaattgacaccctaacatcacaattaaaagaactagaaaagcaagagcaaacacattcgaaagccagcagaaggcaagaaataactaagatcagagcagaactgaaggaaatagagacacaaaaaacccttcaaaaaattaatgaatcccggaaccggttttttgaaaagatcaacaaaattgatagaacgctagtaagactaataaagaagaaaagagagaagaatcaaatagacgcaataaaaaatgataaaggggatatcaccaccaatcccacagaaatacaaactaccatcagagaatactaaaaacacctctatgcaaataaactagaaaatctagaagaaatggataagttccttgacacatacaccctcccaagactaaaccaggaagaagctgaatctctgaatagaccaataacaggatctgaaattgacgcaataattaatagcttaccaaccaaaaaaaaatccaggaccagatggattcacagccgaattctaccagaggtacaaggagaagctggtaccattccttctgaaactactccaatcaacagaaaaagagggaatcctccttaactcatgaggccagcatcatcctgataccaaagccgggcagagacataaccaaaaaagagaattttagaccaataaccctgatgaacattgatgcagaaatcctcagtaaaatactggcaaaccgaatccagcagcacatcaaaaagcttatccaccatgatcaagtgggcttcatcactgggatgcaaggctggttcaatatacgcaaatcaataaacataattcagcatataaacagaaccaaagacaaaaaccatatgattatctcaacagatgcagaaaaggcctttgacaaaattcaacaactcttcatgctaaaaactctcaataaattaggtatggatgggacatatctcaaactaataagagctatctgtgacaaacccacagccaatatcatactgaatgggcaaaaactggaagcattccctttgaaaactggcacaagacagggatgccctctctcaccactcctattcaacatagtgttggaagttctggccagggcaattaggcaggggaaggaaataaagggtattcaattaggaaaagaggaagtcaaattgtccctgtttgcagatgacatgattgtatatctagaaaaccccattgtctcagcccaaaacctccttaagctgataggcaacttcagcaaagtctcaggatacaaaatcaatgtgcaaaaatcacaagcattcttttacaccaataacagacagagagccaaatcatgagtgaactcccattcacaattgcttcaaagagaataaaatacctaggaatccaacttacaagggatgggaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttcacgttcatatggaaccaaaaaacagcccgcattgccaagtcagtcctaagccaaaagaaccaagctggaggtatcaggctacctgacttcaaattatactacaaggctacagtaaccaaaacagcatgatactggtaccaaaacagcatgatactggtaccaaaaacagagatatagaccaatggaatagaacagagccctcagaaataacgccgcatatctacaaccatctgatctttgacaaacctgacaaaaacaagaaatggggaaaggattccctatttaataaatggtgctgggaaaactggctagtcatatgcagaaagctgaaactggatcccttccttacaccttctacaaaaattaattcaagatgggttaaacacttaaatgttagacctaaaaccataaaaaccctagaagaaaacctaggcaataccattcaggacataggcatgagcaaggacttcatgtctaaaacaccaaaagcaatggctacaaaagccaaaattgacaaatgggatctaattaaactaaagagcttctgcaaagcaaaagaaactaccatcagagtgaacaggcaacctacagaatgggagaaaatttttgtaatctactcatctgacaaagggctaatatccagaatctacaatgaacaccaacaaatttacaagaaaaaaataaacaaccctatcaacaagtgggtaaaggatatgaacagacacttctcaaaagaagatatttatgcagccaaaagacacatgagaaaatgcgcatcatcactggccatcagagaaatgcaaatcaaaaccacaatgatataccatctcacaccagttagaatggcgatcattaaaaagtcaggaaacaacagatgctggagaggatgtggagaaacaggaacacttttacactgttggtgggacttcaaccattgtggaagtcagtgtggcgattcctcagggatctagaactagaaataccatttgacccagcaatcccattactgggtatatacccaaaggattataaatcatgctgctataaagacacatgcacacgtgtgtttattgcggcactgttcacaatagcaaagacttggaaccaacccaaatgtccaacaatgatagactggattaagaaaatgtggcacatatacaccatggaatactatgcagccataaaacatgatgagttcatgtcctttgtagggacatggatgaagctggaaaccatcattctcagcaaactatggcaaggacaaaaaaccaaacaccgcatgttctcactcataggtgggaactgaacaatgagaacacatggacccaggaaggagaacatcacacaccagggcctgttgtggggtggggggagtggggagggatagcatttggagatataactaatgttaaaatgatgagttactgggtgcagcacaccaacatggcacatgtacacatatgtaactaacctgcacattgtgcacatgtaccctaaaacttaaagtataacaacaaaaaaaatcacaattttcatttaaagtatatgtttgtatgctagaactacttgaagaaaattagagaagcatccagatagggacttgtaaaggagttgaaggaaacgtcaaagcattttcaggagccatagatgctgacgcaaccaattccttaattagatctacttcaacaatttcttttccttaaaaaagaatgtattatattaacatgactctaacatctaaaagtctaaggtccttttttagctcacaaacaaagattgcatagttcccatggttatttgcaaaggtaaaacatttggtaagttcttcccttcccaaatcacagatagaaagctaaactacacatcaagattacagtaggaggaggagccaagatggcccaataggaacagctccggtctacagctcccagcgtgagcgacgcagaagacgggtgatttctgcatttccatctgaggtaccgggttcgtctcactagggagtgccagacagtgggcgcaggtcagtgggtgcgtgcaccgtgcgcgagccgaagcagggcgacgcattgcctcactcgggaagctcaaggggtcagggagttccctttcctagtcaaagaaaggggtgacagacggcacctggaaaatcgggtcactcccaccctaatactgcgcttttccgacgggcttaaaaaacggcgcaccaggagattatatcctgcacctcacttggagggtcctacgcccacagagtctcgctaattgctagcacagcagtctgagatcaaactgcaaggcagcagccaggctgggggaggggcgcccgccattgcccagacttgcttaggtaaacacagcagccagaaagctccaactgggtggagcccaccacagctcaaggaggcctgcctgcctgcctctgtaggctccacctctgggggcagggcacagacaaacaaaaagacagcagtaacctctgcagacttaaatgtccctgtctgatagctttgaagagagcagtggttctcccagcacgcagctggagatctgacaacgggcagactgcctcctcaagtgggtccctgacccctgacccccgagcagcctaactgggaggcaccccccagaagggagagactgacacctcacacggccgggtactccaacagacctgcagctgagggtcctgtctgttagaaggaaaactaacaaacacaaaggacatccacaccaaaaacccatctgtacatcaccatcatcaaagaccaaaactagacaaaaccacaaagatggggaaaaaacagagcagaaaaactggaaactctaaaaagcagagcgcctctcctcctccaaaggaacgcagttcctcaccagcaacggaacaaagctggatggagaatgactttgacaagctgagagaagaaggcttcagacgatgaaattactatgagctacgggaggacattcaaaccaaaggcaaagaagttgaaaactttgaaaaaaaatttagaagaatgtataactagaataaccaatacagagaagtgcttaaaggagctgatggagctgaaaaccaaggctccagaactacatgaagaatgcagaagcctcagaagccgatgcgatcaactggaagaaagggtatcagcgatggaagatgaaatgaatgaaatgaagcgagaagggaagtttagagaaaaaaagaataaaaagaaatgaccaaagcctccaagaaatatgggactatgtgaaaagaccaaatctacgtctgactggtgtaactgaaagtgacaggaagaatggaaccaaactggaaaacactctgcaggatattatacaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactcacagcggatctcctggcagaaactctacaagccagaagacagtgggggccaatattcaacattcttaaagaaaagaattttcaacccagaatttcatatccagccaaactaagcttcataagtgaaggagaaataaaatactttacagacaagcaaatgctgagagattctgtcaccaccaggcctgctctaaaagagctcctgaaggaagtgctaaacatggaaaggaacaaccagtaccagctgctgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaatccatctcacgtgcagagacacacataggctcaaaataaaaagatggaggaagatctaccaagcaaatggaaaacaaaaaaaggcaggggttgcaatcctactctctgataaaacagactttaaaccaacaaagatcaaaagagataaagaaggccattacatcatggtaaagggatcaattcaacaagaagagctaactatcctaaatatatatgcacccaatacaggagcacccagatgaataaagcaagtcctgagtgacctacaaagagacttagactcccacacaataataatgggagactttaacaccccactgtcaacattagacagatcaacgagacagaaagccaacaaggatacccaggaattgaaatcagctctgcaccaagcagacctaatagacatctacagaactctccaccccaaatcaacagaatatacattgttttcagcaccacaccacacctattccaaaattgaccacatagttggaagtaaagctctcctcaggaaatgtagaagaatagaaattataacaaactatctctcagaccacagtgcaatcaaactagaactcaggattaagaatcccactcaaaaccgctcaactacatggaaactgaacaacctgctcctgaatgactactgggtacataacgaaatgaaggcagaaataaagatgttctttgaaaccaacgagaacaaagacacaacatatcagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggacatagagacacaaaaaacccttcaaaaaattaatgaatccaggagctggttttttgaaaggatcaacaaaattgatagactgctagcaagactaataaagaaaaaaagagagaagaatcaaatagatgcaataaaaaatgataaaggggatatcaccactgatcccacagaaatacaaactaccatcagagaatattacagacacctctacgcaaataaactagaaaatctagaagaaatggataaattcctcgacacatacaccctcccaagactaaaccaggaagaagttcaatctctgaatagaccaataacaggatctgaaattgtggcaataatcaatagtttaccaaccaaaaagagtccaggaccagatggattcacagccgaattctaccagtggtacaaggaggaactggtacaattccttctgaaactattccaatcaatagtaaaagagggaatcctccctaactcattttatgaggccagcatcatcctgataccaaagccgggcagagacataaccgaaaaagagaattttagaccaatatccttgatgaacactgatgcaaaaatcctcaataaaataatggcaaaccgaatccagcagcacatcaaaaagcttatccaccatgatcaagtgggcttcatcactgggatgcaaggctggttcaatatacgcaaatcaataaatgtaatccatcatataaacagaaccaaagacaaaaaccacatgattatctcaacagatgcagaaaaggcctttgacaaaattcaacaacacttcatgctaaaaattctcaataaattaggtatggatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaactgtccctgtttgtagatgacatgattgtatatctagaaaaccccactgtctcagcccaaaatctccttaagctgataagcaacttcagcaaagtctcaggatacaaaatcaatgtgcaaaaatcacaagcattcttatacaccaacaacaaacagagagccaaatcatgagtgaactcccattcacaattgcttcaaagagaataaaatacctaggaatccaacttacaagggatgggaaggacctcttcaaggagaactacaaaccactgctcaatgaaataaaagaggatacaaacaaatggaagaacattccatgctcatgggtaggaagaatcagtaccgtgaaaatggccatactgcccaaggtaatttatagattcagtgccatccccatcaagctaccaatgactttcttcacagaattggaaaaaactactttaaagttcatatggaaccaaaaaagagcccgcatcaccaagtcaatcctaagccaaaagagcaaagctggaggcatcacactacctgacttcaaactatactacaaggctacagtaaccaaaacagcatggtactggtaccaaaacagagatatagatcaatggaaaagaacagagccctcagaaataacgccgcatatctacaactatctgatctttgacaaacctgacaaaaacaagaaatggggaaacgattccctatttaataaatggtgctgggaaaactggctagccatatggagaaagctgaaactggatcccttccttacaccttatacaaaaatcaattcaagatggattaaagacataaacgttagacctaaaaccataaaaaccctagaagaaaacctaaccattaccattcaggacataggcatgggcaaggacttcatgtctaaaacaccaaaagcaatggctacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactccaacaaatttacaagaaaaaaacaaacaaccacatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcgatcattaaaaagtcaggaaacaacaggtgctggagaggctgtggggaaatagaaacacttttacactcttggtgggactgtaaactagttcaaccattgtggaagtcagtgtggcgattcctcagggatctagaactagaaataccatttgacccagccatcccattactgggtatatacccaaaggactataaatcatgctgctataaagacacatgcatacgtatgtttattgcggcactattcacaatagcaaggacttggaaccaacccaaatgtccaacaatgatagactggattaagaaaatgtggcacatatacaccatggaatactatgcagccataaaaaatgatgagttcatgtcctttgtagggacatggatgaaattggaaaacatcatgctcagtaaactattgcaagaacaaaaaaccaaacaccacatattctcactcataggtgggaactgaacaatgagaacacatggacacaggaaggggaacatcacactctggggactgttgtagggtgcggggaggggggagggatagcactgggagatatacctaatgctagatgacgagttagtgggtgcagcgcaccagcatggcacatgtatacatatgtaactaacctgcacattgtgcacatgtaccctaaaacttaaagtataattaaaaaaaaaaaaaaagattacagtattagaataccaaaaaaatctgtgtgacttctattaggtgaacctccattcccctgcactcaagtttccatggaggactcccactactagagaaacattcttggtctctctctgccccacttgcttgagacaatgaattaggcatgctcagttcagacccttgtgggttttctgggttgtttttttttttgagacaaagtctcgccctgttgcccaggctggagtgcaatggcgtgatctcagctcactgcaacttctgcctctcaggttctaacgattctcctgcctcagctgggattacaggcacccacgaccacgcatggctgatttttgtatgtttagtagagatggagtttcaccatgttgggcaggctggtctcaaactccttaccttgtgatccacccgccttggcctcccaaagttctgggattacaggcatgagccatcatacccggccccttgtgggttttctgaagattcatctgttcacagagagggaacatactggtctgctcttatttttgaggtaagcctgtatctgaatgggaggctggcaactcttcagttgccccagggattcattgaaatagtctacttgactcagggtgaagtgttaaggaaatccactgtgggtacatattaaagccacatcctggctgggtttggtagctcacacctgtaatcccagcactttgggaggccgaggcaggcggaacacgagatcaggagttcgagaccagcctggccaatatggtgaaaccctgtctctattaaaaatacaaaaattagctcggtgtggtggcacatgcctgtagtcccagctactcgggaggctgaggcagaagaatcgcttgaacctgggaagcggtggttggagtgaaccaaggtcacaccactgcactccagcctgggcgacagagcgagactccgtctcaaaaaaaaaaaaaaaaaaaaaaaagagccatatctggtaatccagttttgtatcggttattactttatgaagctgatatgttcatgttcatctgtatgattcctacaactattctcaataaattctgttctcaaagagaaacaagggtggttctccactgaacactcagaacactagcaatatctaagaaaacattttatttcacagaggcataaataccttttaaattggcatttttatttcctctatttcaaatacagatagttaacttttcattacggagaatttaaatatatacaaaagtggagagaagggcattataataaaaagccacatgtactcattgcctgtctctagtaattatcaatttatggccactagtgtcttatctgcacccagtccaacccctctgtaaattattttgaagcaaatcctagtcactgtatttcattttgtcagtatttcagaatgcatctctaaggactcttttacatcacacctaagttaacatttacttccttaatgtcatcaaatacccagtcaatgatcaaatttagctgatcgtaattttttaaacagttagaaggatccaaataaggcttctatagtacacttggttgatttatctctaatatctcttttattctaatgatttttttctccatctgtttttccttgcaatttatttgttgaaaaaaaaattcacctgtcttgtcgagttctcacagtctgggttttttttcctgtgctgttatccaacatgcacctctgtcctctgtattttttgttaattgatagttaaatctagagactaaataagatccatatctgactttttggtaagaccaccccaaaggcagattgtatactccatccggaaatataatttctggctatcttgtgtgtgtatgtgtatatgttatgatttaggccatctaaattcattatttcatttgaaggggttcagagcacataaccccaaactatgccactctgacataatgattattttcagcttaaggcaactgagaaaatgcaggcacagaatgagctctgtcctccccacatctacctgaaaaaaaaaaaaaaaaagcacacatcacccttgggaaagtgcccccggaacctccacccccactcccataccaggagggggataacaacctttatcacagatgagatggcaccaagagtttacacaaaccaacctcactaatgagcccttctctaccagcagtttccatcatatatttgccttctcacaatttgccaccccaagaaactcaaagtccatttcctttgtcttgtcactcaacaaatttcttgttctgctaagatgctatataagctgaagttttatttttcttttttgagacagggtcttactcagtcatccaggctacagtcagtggccccgatcacagctcactgcagcctcaacctcctgagctaaggtgatcctcccacctcagcctcccaagtagcttggaccacaggtgtgcaccaccacacccagctaatttttgtattttttaatagagacatggttttgccatgttgcccacgctagcctcaaactcctgagctcaaggaatcctcccatctcagcctcccaaagtgttaggattacagggctgagtcaccgtgcccagcctaagcccaagttttaaccacccctacgagttacctgaatactcgtgtgtgtgtgtgtgtgtgtgtgtgtgtgtgtgtgtgtgtgtgtatgcaacgtatgcattgatatacttctttttcgctcattaacctgtcttttgtatgtctaagttgtagagccctgatcaatgaatctaagataggtagaagaaaagtgttttcctcctctacacattagaggttgcaaaattacaatattctaattctatcattcttcctagcttgaattcttcagagaaatttcttctcgtcaattattactgatcccaagacacagtttatataagaaaggcagtatagattttgactctgcccttttatttaccgattttcaacagaatgagttagttccccagcattctccaaaggtgagttctcttttttaagtatcattatgaacacatggatttaaacatatgtgatatgttgcaattcattgcagttacttcctgtatctatgctcaagttgccagatggatttttaaagctacatttgaaagatgttcaagaaaataattttcaaatgcctagagtaagggtattttgtagttgagagagactgattttatctagaaattagagttttactgctaagatgacaaatttgaaactgaaatactgttagacacttgctgtccttatcctaaaatttgattctatgctaatgcatgaagcagcaattaccgtttcactcactcctgtcatcctcccaaaccctgcaacatcttatccaactaaacaaaactcagctacagctccaaaacacaagctgaaaggacaaaattattagaaataaggagaaaagcagcaagggtggcacacgcatctgtgtgatgacactgccgaaattccccgcttgattcagggcacgatgcaaaacaacagaaattcaatcaacacattcaccacacatggtggattaggggcctttagaaatagaaaagctatttggttaacagattttagtaaaatttactataataaagttgtctaaagtcaacgtcacactggatataagtgctttaaaaaaatgccagatatggagtctgttattaatattgtagctgctggaatttgtgataaaaaggattctggttatacccttttttccaggcataagtacgttaatagctctaaaaatattaactttttcaagccatcaaataactattaaccaatggcatacttacagtttcttaaaaagctgcccaaagacatagccaatgagtatgttcatgcaagttaaaaataaaatagaccaacttacaactatggaagtgtggcagacgccaatacctgccttccagaccccctttcaagacaggactcactgcccagctgtgaggaatatagttatctgactgcctccagctgttgacttcaggatccatttctgccttcaagccaaagttatactagctcaatcggctcctagtcactgggatttaagcaagatagtagaagccaggtgcatgttcttcatgaaggaccctcagcaaataactaagcaaggcaatagtacaaagccctagttatttacatccagtagagaactcttaaaaagcagcctttcctccagcggtccccattgggctggcagaaactttgtcacatctgcatcagagtctgagacagctccccttatccaattctgcttcctcccttctcctttcattggctttctctcttataaacctattgcatgcttagtgtctccattttagtgtctccttcccagggaacccaggtactagaaggatctatactgactatctgtttcccagggaacccagatcctaggatctaaactatactgatttctgttctctgaaggttagtgtataagaaagaatatgtttagcttgagaatatttcctttaaaatgagcatattgttcatttttagtggattatcaagctatactgagtttatttactttcttgtgaatgtacagcttcaccaaccatcctagaggcacattttgttctccaatctggcacttcatcatgggtcatctgattcctttccagtcatgatcaccatcctacataaccttgtctgtttcctgaaggagcaaggaatggtcaaatgagcaacggagaaaactcttcttaaaatgtgttatgaactcagtttagtttaatgtgtcaaacgctagagtattacatgaaattttagcacagcccattttttggaagacttttgctgaggcttaaccttctttagtgatctctcatcaatacgaccctcacttcatgttcaaaaaatactaaagaagaaaagaaaaggcagctgtctgttaggttatacaggatttattgggtatcttcaaaaaccaatccgagaaaattttccactcactgattttagctgagccactgagaaaacaagaaaatccttctgcaaaattttcaataagatgatattatctaaagacttgaagcgtgaaacctggattataacagctgaccaaaaaaaacccagagtgtaatgtcttcaaaaactaagaaacaaaaaaaggataatgatataaaattttaaaactggaaaggtatttctctaatttgacaatgcataatgtacatatgcaatggtaaagataattctaaactattaagagtaaaaacattcggttaattctgttcataatgtttatactttgtagattttcctgtgtccttcttacgaagatgactctttcggtttttcttttttagtacactacagaattaaatttttaaaaacaacatacagactgaaagttctacaggtcagcaaatgaccgaaaaacttcatagttgattatatgtaaatttgatgacttttcaaagaattaaatgtgaatcatgaagtcatatcatcactgtattacaaaagccaaaaagcaggcttcttcatctatcttagactcactgtggtagatcacaaactggccacaaattattccccctcccaatattgccaccaccattagcaataggacttagttacttctaccatgagaggtcaagtttatttacccactcactgaatttgtgccagctcctaacttgctttggctgacgaaacagcagcaaacacgaggcaagctgagacttgaaaagtgtcttactttggggcttgcccttctgctgctattagaactccatgatcattatgtgaacaagcacctgaaaaaccacatggagggagaccacagtcatttcagctgagaccttcagctgaaatgaaccagccagcccccgccaatctaccagctgacagaggcataagtgaatctagccaagatcagttgctcctggtgcaaagacagactcacccagctgagcctagcccgaattgccatcctgcagaataatgagctaaatagatggggttgtgttaagccactaagtttggtgtgacagctgacagagcatataggtaactaacatacccacatatggctttttactctttacagaatatttactctatcattaaacaactaaagtatatgtgagcaccactgtggggaaaattaaaccaaatatatgtcagcatttgtacactaaccattattctataggctggcctcttctacagagtcctcttctaactatgggataggaatagccaagaggatatttcacagaggaaagacagcaatgaacatgatctcttaacaatttatacaaatatttaaagtccacaacctgatcacatactgtgtatttattatttaactttcctggacaaaataactttaggattccttaacacccaagtattagtgattataagaaattatcagattttctttaatctagcaacttactagggtaaaatatagcgcaagaaaactttagctgtccaaaatcttacctttccagaaataattagttccccacaaaaatgaccactttaataaatggagtgtctctcaggacatagcaacaagtaacattgccaaaaaaaaggctgcagatgattgtttaacatgccatgatttggttgacttgcatcacaacaggaaaacagtgatgacaggccagtaatatatatgagacaaatcttttcaagcaaaagttaagaagcatggtactgtttaataactttgctggactttgtctctggttcctagaagggagtctctaaatccttggaattttccaagtggtaagaatgtcttcattattcatggtgggtcccttggaccacacctaagtttatactaaaggaacaactcacagtgggccctgagataacatcaggaaaggggctggccaaggtggaaaaatgaaccacatgatttaaaggtttgggctttctgctaccagtcacggtggggagggtggggactgaagattgagttcaattatgtgaccaatgattcaaacaatcatgcctactaatgaaagctctggacacccaaagctcaagtgtgctcattcattggtgatacacactgatgttccaagagggcgaggagtcttgagacatggaagctttgcatgtgggaccccctaggccttgccctatatacatcctctcatttggccggtcctaatttgtatcttttataataaaactgtaatcctgtgtatagtgctttcctcagttctgtgagtccttctagtgaattatcagacctgagggaacagcaggaacttgtagccagcagctggaaatgcaagtggcctacaaacccatacatggcttgcagctagtgtctccagtgaggggtgctgtatagactatgcccttcatctgtggaatctgacctaagtccaggtaatgtcagaactgcactgcacatggtaaagcaactaaatatcagtaacatttaaagagcagagagaaggctgagcacggtggctgatgcctgtaatcccaacactttgggaggccaaggtgggaagacagcttgagcccaggagttgcccaccagcctgggcaacatagtgagaccctgtctctattttaaaaattaaattaaattaaaaaaaaaaaagcagagaaaagacaaggttaatagacagcagaagtggtggtcagagttaggaataattacagtaacactcatccatggagtgaaaaaaaacagcaaaggcaaaagacaaaattagagatgaaagtggaaaaactagtagagacaacagaaatgaggttgggggattaggacggcattcaatgtggatgcttagtagtctggagagtcattcattcactcagccaccatctatgaattatctgctacatgtaaggcactgtactaggtactaagaaaacatggtgaataagaaaaacatagcctcattctcatgaagcttacattttagagaggacgaaaatattgaattacaccactaattatgtaattattatggtgaaacatgctataaaagatatacagttgaatatgggcttaatatacatatatacatatcagtaatagtctacagtcctaaagcctatacaccttcacctctatttgcaaatatattaaacataattattatacatgttagcaaggaagtacagaataatgtacattttcaagtggtttcatcaataacaaaaactttggattaaacttaccttccactaaaaataaaacattcctggtaggtacctgatacttaaacacttagcatatttgtttctcaaatacaagttctccttaatatactgttataactcctacccaaattttaaagtcatacacttcttttaaactattaagaatatttctgagaatgcaaacaaacaaacataaccctcaaatcaccagacacgacaccctgactttgggcaaaaaagactctagatacatatttcatcgagatgcagaggccaatttcaatttctactaaatgttactaatgatcacagtttttaaatttttagaaaagatgtattaattttaaaggtgtttaacataaaattccctaaaacctcttcccaaacaatagtcaattagaccactatagcttcttacctgtagtcatctaactgtaccagaaatcgtacaatatcatgatgagccttcagtactagcagttcagtgtagggattctgggtttgttcttcacctattgtctgtaaaggagatttcttgtattgaaaaaaaaaaaaaagcaaaaaacaaaagacaaaaaaagagataaaatgatttgtaagaccatattggaatataactccatggtatacatctgagaacacaagattttaaaagccttaaggtatcatgttctactactaaatattatttcttcttttatcaactaaataactgccagttccacataaaacacttctcctaccacaaattcgaatcatgaattttagtattttcaaatcacaataaatttacaaaaagggtgaattttattttatgtaaattgtatcctattaaacctcactttaaaaaaagtaatgggccaatccaactcaacattttagaatgcatgtttctcagttaaaatgtggcagaaacaaaactgcaaatcaaagacataaaatagtgaaacagtgcctcatccattacaagcactcaatacatgcttgctaaatgaataaatgaaggcatgaaatcaactctggatttctcaaacttgatgctgacattttgggctagagaatttttttttttcgcaccacacgcccaactaatttttgtatttttagtagagacaggttttcaccacgttggcgagactggtcttgaattcctgacctcaagtgattcgcccgcctcggcctcccaaagtgctgggattacaggagtaagccaccgcgcccagcccagataattctttgttgttgagaactgtcctgtgcattacaggacattgagcagcatccctggtctatacacattagatgccaatagaactgcccctctgcaaggcatgacaatcaaaaatgtctccagacattgccaaatgtctcctgcggggcaaaaatcaccccagttgagaaccactgcttaaacgagaagcctggatacaaagttattgcataaattagggacaatcataggttccgataatgtacaaattcacagcagttatacaactcaattagatttatatgaagaaatatataaatttaaaacatgcataaatgttttccaaaaaaaaaaccaccaccacaaagcattgattttgtatttattctgtcttccttctagaagagattgtggtgagaaatttgaaaactatataaactgcttctcctccaatgaaaacttgccaggaatgggagacctggttaagcaaataacatgattaaccaaagaaccaggttaaaacagaattatccaaaatgtcgtatataccatatatggctattcaataatccacaatctcaaggatttaggattaatctgaaataagaaatttttaaaaacagacaataccgtcaactgcaaagacatgcggaagttaaaattgagaagactgcctactctcaacaatccaatttcttacttttaacaatctaaacaaatacttcttatgagaaataaaatgcaattcacaaattctgttcttgtcaggcctctgagcccaagctaagccatcgcatccccggtgacttgcacatatacgcccagatggcctgaaataactgaagaatcacaaaagaagtgaaaatgccctgccccgccttaactgatgacattccaccacaaaagtgaaaatggccggtcctcgccttaagtgatgacattaccttgtaaaagtccttttcctggctcatcctggctcaaaaagctcccctgagcaccttgccccactcctgcccgccagagaacaactcccctttgactgtaattttcctttacctacccaaatcctataaaacggccccacccctatctcccttcgctgactctcttttcggactcagcccgcctgcacccaggtgattaaaagcttttattgctcacacaaagcctgtttggtggtctcttcacacggacgcgcatgaaagttcttgtgtggcatacgaaataaatttgggacctcaaaatttccaagactgcaaaaattattttattcacatttcaaatgtaaatttcattacacacggtctattcaattattcgggcccatgaagaaagtgtgactatgaaaccaaaaacagcagttaattagaaaatcatgttcttgaccttgaagcagattactttttaaaaataattatatcctttttcggttgttggataagtaaattaattttatattccctgaccaagtatcagtagacgccaggaagagacaccaattcaaataaaccaaaagtggaaagctgcggtcacaactcgttcgtttctagctaaatcgtatactttttaagtggaaatgaagatagtttcggtagccagaagccctaagttgtcacaggtcccaataggactgctgaccagctgagcgtccctgagccaggatctcacgattcagctagccgtgggacggggccgggggtctgcagctccagggtgcgcctggggtcccgccgggtctgaggagctccggctcccgcgccctccgcccccaccgtcgtgagaacagcgcgtggcacgagctcagcagccagccccgcctccgcccgggtccccgcggtcggaacccaggaaggccgaaccggaacgaagccgcccctccagcaagctcgacggacgcagagcagacccacccggggtttacctcggccagtccctgcggttctcggcctcccccgatcagccatcgcaacatccgggcagcggcggcgtcttgcccggtccagccccagtcagcccaaactccgccccaggctcggcctcctccttcctccccggctgcagcgcaactgagacgctaatacttcccgccccagatcagcccacgggccgaaggaatgcagaccacagttgagggagaatttttgtccccaaagcgctcccgtacccagccacggaggcttagtttgggcagtcgcttggggtgcggcggccgacggcgggggcggctgcggcgattgcggggcgcgcgctgctccgagtgagcacgcgcgggagcgccgccgggtagcgcacggagcttaggtagctcgagcggcccctggtggacgcgcgcggagcagcaacccgaccccggcgagcaagcgcgcacgaagaataatgcccctccctgtgacatggctttagtatcctccacttcctagggtaccaggaaatctcccctgctttcccaagagcttgctgaagaaggtgtaccgcagtagacttctgcatccagacaaatccagtggctcatgtgtacagccgaataaatccggccaacatttactgtgtgctatagtacagctactgtgctaaggctttacataaatcctcatggtaaacctatatcctctattttacacatcaagaaactaaagctctgaatgattaggtaatttgtctaaagataacagctaggaagtggctacattggtagtgttcttgaccgtatgctatattaacatagaatctccctaaagaatagaaggcagttcatatacctttttttgactactacattttcttaggtagtcaaagggctgtggttatctatgctgactgcatatcagaattacctgggtagcttttgaaaatgtagattcctggcttccacctcagactcattaaaataatctttgtggttgggacgtaggaatcggggttttgggaaggctcctcaggtgattctgatgagtagcaaggtctgaaaatcactggtctaggaactacttatacatatcatgtttgcaaaagtataaatatatatatttgcatatgtattaggttcaaataatcctcctagcagtaaattgttgtagggaatctacaaatgtcccaactaatgcattaattcagcaaacatgtattggacacagatgcactagagaagcagaaaggaatcacataaaatgctgctctggagggacaaggcataatgtcccagtcaccaataagagagagccatacatcccactttaagctaagttggttgtgagcagctacacaaacttacagtccctctggaactcggatctcctataattcatctttgtattccttttgagtgcactcggcaagaacacactcccaaggatcaggagcatgttgccttctgtgtgctagccccaaattgcagtctgcatacagttgaagacagaccaaaacagagactatcccctgggaaagagggacttatctttaagtaaaacaaaactcagagacatcaggagttcagttctggaaggaatatcttcacgtgagacaatgtggttgcccaaatagcctacattttattcttctgattatccacattctttagggtttgccccatgctctttagggtttgcccaatgccacattactctgatgtaagggacattctgctgatgctttaaagcactggtccagggttgaacacttcctcccttggttcctcttaggacagctaagaaagaattttttacaagattagtatattattgggcacacaatgtataaagatgtaatttgtggcatcaatagaaagggtgggggtggagcaatataggagcagagtctttgtatgctattgaagttacgttggtataaattaaaatgagattgttataacgttaggatgttaaatgtaattctcatggtaaacacaaaaatacctgtaaaatatacataaatggaaatgatcagggaatcaaaacatttactacaaaaaataagctaaatacaaaagatggcagtaatagagaaaatgaggtacaaaaaaactataaggcatatagaaaacaaatagaaaaatagaaattcctctttatcagtaattactttaaatataaatagattaaactgtccaaagaaaaggcagattgacaaaaaaaaaccaaactctagaatccaactatatgctgtctatgaaagactgactttagatcaaagacacaaatagatcaaaagggaaagaatagaaaaagatattccatgcaaatagtaaccaaaagagaactggagtggctgtactaacagctgacaaaatagactttaaatcaaaaaagttttcaaagacagaaacattatgttatatattaataaaatagtcaatatagcaagaagataaaacaattacaaatatttacacacctaataatagaccctcaaaatttatgaagcaaaacttaacagaattgaagaaagatatagttctacaacaatggtagcagacttcatctgtccactttcaataatagatagaacaaccagacaaggtaaagaaatagaggacataaacaacacaataaactaattacatctaacatataaagaacacactacccaacaacatcagcataaacattcatctcaagcacatgtaagacattctcttagatagaccatatgttaggccacaaaataagtctcaatcaattttaaaagatagatatcacacaaagtatcttctctgaccacaacaggaatcagtgacagaagtaaaactggaaaattcacaaatgtgttgaaattaagcaaaacactcaaacaaccaatgagtcacaagaaaaagcagcacaaaagaaattataaaatacctagagacaaaaacacaacacgacaaaacttacgggatgcggtaaaagcagtacttaaagggaaatttataggtataaatgtctacattaaaaaagaagatctaaaatcaataacctgactttataccataggaacttgaagtagaagagcaaatgaaacccaaaactagtaggaggaaggaaataataagaattagagcagagataaacaaaatagagaatagaaaaaatagagcaaatcaatgaaaccaaaagttggtcttttgcaaagatgaaaaaaatttaaaaacctttagctggactgacaaagaaaaaaagagaaaatgcaaataactaaaattgaaaatgaaagtggagacattactactgactttgcagagagaaaagggactatgcgaccactatgaacaatcgaacacaaattagataacctaaaagatatgaataaattccttgaaatacacaaattatttaaattgactcagaaagaaatggaaaatattaacagacctatagcaagtaaagagattgaaacagtattcaaaaacctcccaaaaaagtgaagtcctggaccagatggctttactgatgaatctaccaaacatttaaagaagaattaacacaaatctttctcaaattcttccaaaaagtgaagaggaggaaacactttttaactccttatacaaggccagcattaccctgataccaaaaccagaaaaaaaatcacaaaaagagaaaattataggccaatatcccttatgactacagatgaaaaaaatctttgacataatattatcacattaaatccaacagcatattaacaagtattatttactatgaccaagtaagatttattccgggaatggaagagtggttcagtataagaaaatcaaccaatgtaatacatcacattaataaaacaaaggaagataaccacaagataatctcaactgatgcagaaaggcattttacaaaatccaacacccttttatcacaaaactctcagaaaaccagaaatagaggggaaattcctcaataggataaaaagtaattatgaaaaacccatggttaacatcacattcgatggtgaaagactgaaagcttctcccctaagatgagaaacaaaagaaagatgtcctctttgaccactgctcttcaacactgtattggaagttcttgccagagctagtagacaaaaagaagtaaaaagcatccaaattggaaaggaagaggtaaagctctctctatttgcagatgatatgaccctatatatagaaaatcctgaagaatccacaaaaaaggtatagagctaataaataaattcagctaagttgcagggtactagattaatacaaaaaaaattagtgttgttcctacttgccagcaatgaacaatccaaaaagaaaactaataaagcaattccatttacaatagcatctaaaataattaaatacataggaataaatctaaccctggaggtgaaagacttctatactgaaaacaacaaaacattgctgaaagaaattaaagagtacctaaataaataaaaagacgtccaagctcttggatagaaagacaacattgttaagatataaatacttcccaaagcaatctccagattcaatgcaatctctatcaaaatttcaataatcttgttcctaaaaatggaaaaataatcctcaaatttatatggaattgcaaggggtcccaaatagccaaaataatcttgaaaaagaaaataaggttggaggactcacacttcccaactgtggaacttaccacgaagttaaagtaatagtactggcacaaggacagacatgtagaccaatggaatagaacagagagcctagagataaactcttacatatatggtcaatttttttgacaagtgtactaagaccatccaatggggaaaggacagtcttttcaacaattggtactaggaaaactggatctctacacataaaagaatgaacttggatccttatcttataccatacacaaatgttaacttaaaatagtcaaatacctaaacttaaaagctaagttgtaaaactcttagaagaaaaaaaattggaggagaaaatattcatcacattaaatttggcaaaatttagtggcggtgacaccaaatgcacaggcaacaaaagaaaaaataaaccaatttgacttcatcaaaattaagaactttcatgcgtcaaaggatactaccaagaaaatgaaaacctacagaatggaagaaaatatttgcaaatcatacatctgataaggaagtgatacctgtaatatataaacatctcctacaactcaacaacaacaacaacataaaacaaccctattaaaactgggcaaaggacttgagtagacatttctccaaggaaggtatatgaatggtcattaagcacctgaaaagaagctcaacataattagtcattagaaaaatgcaaatcaaaaccacaatggcatgccatttcacacatactaggatgcctataatttttttaagctggaaaataaatgttgatagggatatggagaaattggagtccttgtgcatcgttaatagaaatgtaaaatggagcagccactgtgaaaaatcgtttagcaaccctcgaaagttaaacatacaactaccatatgacccagcaagtccacctctaggcatatatctacaggaaatgaaagcaaggactcaacagatatttgggccaatgttgacatcagcactattcacaatagccaaaagccggagacatcccaagtgtccatccacagatgaatggataaataaaatgtgatgtatgcatataatgaaatattatttagtcataaaggaattaatttttaaatatattctacaacatagatgggccttgaaaacatatgttaagtgaaataaaccaaacacagtagaataaatattgtatgattccactattatgaaatacttagaataggtaaattcatagagacagaaaatagaacagaggttaccagggatgggagagggggaaatagggagttattattgaatgagtacagagtttatgttgagaccaatgaaaaacatttgtatatagtggtgatgattatacaatattgtgaatgtacttaatgtcactgaattgtacaattacaaatggttaaaatgacaaatatgttagtatattttaccacaataaaagagataaatagatcaatgggacagaatagagtaccaaaataaagccacatatatatggataactgatttttttacagaagtgtaaaggcagtcagtgtagaaaagactattgaaaaagtctttttgttaattgtgctagacaatttgacatccatatccaaataaatgtacttcaatttatatctcattccataagcaaaatacaggattaatcataggcataaatgtaaaacctaaatctataaaacttctaaaataaaacatggagaggccagtcatggtgtctcaagcctataatcccagcgctttgggaggctgaggtaggaggattgcttgagcccaggagttcaagaccagattgggcaacatagcgagacctcatatctataaaaagttttaaaattaaccgagcatggtggcaggtgcctgtggttccagtaactcaggaggctgaggcaagaggatcacttaagctcaggagctagaggctgcaggaagctatgttcatgccactgtacttcagcctgggtgacagagtaagaccccatcaaaaaaaaaaaaagaaaaaagaaaaagaaaaaaagaaaaaaccattgtgactttttaaagattttatctcaaaagtacaatccataaaagaaaaaattgataaattgtactacatcaaaattaacacttctgttctttaaaagacactgttaagagaataaaaaataagcaatagactagggaaaatatttgcaaattaggtaggtgaaaaaggacttctctccagaatatataaagaaccctgaaaacttaataaaagtccagttctgagtgagataggataaatacacgtcactctttctctccaattgaacacaactataaaccttgaacaaaatagatgacgtaactctttaaggactctgaaaaaggaggaatggggaagaataccagaattcaaattaccagcaagtcagcatttcttttttcttcagcagcttccccagcctgaatccaatgcaacctcaaatctggaaaggagcactgtggtgcagaaagagaaaggtgtaccttctagttgtggctgaaactgcaggaagaggaactcccaaagcttagagagaatgcaggaatcctctgggtcttttcctctcctttttgtccattctcttatgcctcagactccaaaatatcccacagtaatggtggcagctgttacagtggctaccaacaggagactgcaggagccaaaactctaagggaagggagacttcctctccattcggtagagctcatgctgcaaaagagtgcatccaaacccagacctgttttttcccatctttctacccttccactaactggcaccagaggtggagcaattacgaaagggggtggtttccaaaaagggaaaccccaaggaaacagaaagtaccagagagatagtggaaatagaagagttcaggaaagcaaccccaattacttttatatgaacatgtaggcacaccttccttatcttcatatgcaaggctcttaatctaattagtgtaaactgagttaatagaattctgcctgggcccgagactaattactagatgggacaaatacagataacactgtaaaggcattaaaactgaacaaacattagagccacagctcacagaaggtgagttacaacttgtgcctaacctagtcaggttaattgcttgttaaaaaaaaataccaacagtctccacaggacttaaaaccaagtttcatagtgtcatattccaaaggtctaggagtataagcccaaattacttggcatatggagaaacacaaaagtcttagctcacatggaaaaatataatcaacggttgccaatgacaaaactacagatgttggaattacctgacgaagactttaaaacatattataaaaatgctggcatggcaattataaacactcttgaaacaaacattaaaacacaatgtatcagcaaagaaatagaacatataaaatagaaagaaccaaatgaaaaattttacatttaacatacaataaccaaaatttaaaactcagtggatgaactaatagcagaatggagaggacagaggcaagagtcagtgaacttaaatggagaaaatcaataaaaccaaaagctggtgtttaaaaagatcagtgaaattaataagccactagcaagactgacaaagaaaaaaaataaaagataaaaattagcagtataaggaatgaaagcagggatattactgtaggccccacagacattaaagggataataagagagtattataaataaccctacacacaaaaatttaacaactgatgaaatggagtgatttctcaaatatcacaaattaccaaaatctgttcaagctcaaataggtaacctaagtagtcccataaccatttacaaaattgaattcatagtttaaaatgttcttaaaaagaaatcttagggttcagataccaaatcataatgaaaatcccagaggatttcctgtagatagacaagctgcttctaataggtataaagaagggcagacgaactagaatgtgctgtgagacattacattaaaaaccaaaaaagatactaaaaactttaaaatttgaatcttgtagtccctgctctcaagaaacatatttcaggaggttccaagatggacaaataggagcagttccggtctgcagctcccagcgtgattgacacagaagatgggtgatttctgcatttccaaatgaggtacctggttcatctcattgggactgcttggacagtgggcacaacccatgtagggcaagcctaagcagggcgaggcgttgcctcacccaggaagtgcaaggggttgcaggatttctgtttcctagccaagggaagccgtgacagactgtacctggaaaaacaggacacttctgcccaaatactgcgcttttcccaaggtcttagccactggcagaccaggagattctctcccatttctggctcagcgggccccacacccacagggccttgctcactgctagtgtagctgtctgagattgaactgcaaggcggcagcctggcttggagaggagcatccaccattgctgaggcttgagtaggtaaacaaagcagccgggaagctcgaactgggcagagcccgccgcagctcagcaaggcctactgcctctatagactccacctctgcgggcagggcatagctgaacaaaagtcagcagacaacttctgcagacttaaatgtccctgtctgacagctctgaagagagcagtggttctcccagcacagcgtttgagctctgagaacagacagactgtctcctcaagtgggtccctgacccctatgtagcctaactgggagacacctcccagtaggggctgacagacacctcatataggtggatgcccctctgggacaaagcttccagaggaaggatcaggcagcaatatttgctgttctgcagcctctgcttgtgataccaaggcaaacagggtctggagtggacctccagcaaactccaacagacctgcagctgagggtcctgactgttagaatgaaagctaacaaacagaaaggaatagcatcaacatcaaaaaggacatctacaccccattggtaggtcaccaacatcaaagagcaaaggtagattaaaaccacaaagatggagagaaatcagagcagaaaaactgaaaattctaaacaccagagtacctcttctccatcacagctcctcgccaccaatcaaacaaagctgcatggagaatgactttgatgagttgacagaaataggcttcagaaagttggtaataacaaactcctctgagctaaaggagcatgttcaaacccaccacaaggaagctaaaaaccttgaagaaaggttagatgaatggctaactagaataaacagtatagagaagatcttaaatgacctgatggagctgaaaaccatagcatgaaaacttcgtgacacatacacaagcttcaatagccaattcaatcaaatggaagaaagggtattagtgattgaagatcaaattaatgaaataaagtgagaagaaaaggttagagaaaaaaaagtaaaaagaaatgaccaaagcctccgagaaatatgggactatgtgaaaagaccaaatctacgtttgataggtgtacctgaaagtgatcgggagaatgcaaccaagttggaaaacactcttcaggatattatccaggagaacatccccaacctagcaaggcaggctaacattcaaattcagaaaaatagataacaccacaaagatactcctcaagaagagcaaccccaagacacataattatcagattcaccaaggttgaaatgaatgaaaaaatgttaagggcagccagagagaaaggtccagttacccacaaagggaagcccatcagactgacagcggatcactcgggagaaaccctataagccagaagagagcgggggctgatattcaacattcttaaaataattttcaacccagaatttcatacccagccaaactaagcttcataagtgaaggagaaataaaatcccttacagacaggcaaatgctgagagattttgtcaccaccaggcctgccttacaagagctcctgaaggaagcactaaacatggaaataaacaaccagtaccagccagcgcaaaaacatgccaaattgtaaagaccatcaatgctatgaagaaactgcatcaattaacgggaaaaataaccagctaacatcataatgatggatcatattcacacataacaatattaaccttaaatgtaaacaggccaaatgcccaaattaaaaaacacagaccggcaaattggatagagtcaagacccatcagtgtgctatattcaggagacctatctcacctgcagagacacacataggctcaaaataaagggatggaggaagatctaccaagcaaatggaaagcaaaaaaaaaaaaaaaaaaaagcaggagttgccatcctagtctctgataaaacagactttaaaccaacaaagatcaagagagacaaggaaggccattacataatggtaaagggatcaattcaacaagaagagctaactatcctaaatatatatgcacccaatacaggaggacccagattcataaagcaagtcctgagtgacctacaaagagacttagactcccacacaataataatgggagattttaataccccactgtcaatattagacagatcaacaagacagaaggttaacaaggatatccaggacttgaactcagctctgcaccaagcagacctaatagacatctacagacctcttcacccaaaattaacagaatgtacattcttctcagcaccacatcacacttattctaaaattgaccacataattggaagtaaagcactcctcagcaaatataagagaacagaaatctcaaaaaactgtctctcagaccacagtgcaatcaaattagaactcaggattaagaaactcactcaaaaccactcaactacatggaaactgaacaacctggtcctgaatgactactggggaaataatgacatgaaggcagaaataaagattttctttgaaaccaatgagaacaaagacacaacataccggactctctgggacacacttaaagcagtgtgtagagggaaatttatagcactaaatgcccacaagggaaagcaggaaagatctaaaatagacaccctaccgtcacaattaaaagaactagagaagcaagaacaaacacattcaaaaactagcagaagagaagaaatgactaagatcagagcagaactgaaggagatagagacacgaaaaacccttcaaaaaatcagtgaatccaggagctggctttttgaaaagatcaacaaaattgatagactgctagcaagactaataaagaaaaaaaaaagagaagaatcaaatagatgcaataaaaaatgataaaggggatatcaccactgatcccacagaaatacaaactaccatcagagaatactatacctctatgcaaataaactagaaaatctagaagaaatggataaattccttgacacatacaccctcccaagactaaaccaggaagaagttgaatttctgaatagaacaataacaggctctgaaattgacgcaataattaatagcctaccaaccaaaaaaagtccaggaccagatggattcacagctgaattctaccagaggtacaaagaagagctggtaccattccttctgaaactattccaatcaatagaaaaagagggaatcctccctaactcattttaggaggccagcatcatcctgataccaaagcctggcagagacacaacaaaaaaagagaattttagaccaatatccctgacgaacatcgatgcaaaaatcctcaataaaatactggcaaaccgaatccagcagcacatcaaaaagcttatccaccacaatcaagtcagcttcatccctgggatgcaaggctggttcaatatacgcaaatcaataaacgtaatccatcacataaacagaaccaacaacaaaaaccacatgattatctcaatagatgcagtaaaggccttcgacaaaattcaacagcccttcacgctaaaaactctcaataaactaggtatcgatggaacgtatctcaaaataataagagatatttatgacaaatccacagccaatatcatactgaatgggcaaaaactggaagcattccctttgaaaaccagcacaagacaaggatgttctctctcaccactcctattcaacatagtgttggaagttctggccagggcaatcaggcaagagaaagaaataaagggtattcaattaggaaaagaggaagtcaaattgtccctgtttgcagatgacatgattgtatatttagaaaaccccatcgtctccacccaaaatctccttaagctgataagcaacttcagcaaagtgtctcaggataaaaaatcaatgtgcaaagatcacaagcattcctatacaccaataacagacaaacagagagccaaatcatgagtgaacgcccatttacaattgctacaaagagagtaaaatacataggaatccaacttacaagggatgtgaaggacctcttcaaggagaactacaaagcactgctcaatgaaataaaagaggatacaaacaaatggaagaacattccatgctcatgggtaggaagaatcaatatcgtgaaaatggccatactgcccgaggtaatttatagattcagtgccatccccatcaagctactgatgactttcttcacagaattggaaaaaactaaagttaaaaaagtaaagttcatatggaaccaaaaaagagcccacattgccaagacaatcctaagcaaaaagaacaaagctggaggcatcatgctacctgacttcaaactatgctacaaggctacagtaaccaaaacagcatagtactggtaccaaaacagatatatagaccaatggaacagaacagagacctcagaaataacaccacacatctacaaccatctgatctttgacaaatctgacaaaaacaagaaacggggaaaggattccctatttaataaacggtgctgggaaaactggctagccatatgtagaaagctgaaactggatctcttccttacaccttatacaaaaattaattcaagatggattaaagacttatatgttagacctaaaaccaaaaacaccctagaagaaaacctaggcaataccattcaggacataggcatgggcaaggacttcatgtctaaaacaccaaaagcaatggcaagaaaagccaaaatagacaaatgagatctaattaaactaaagagcttctgcacggcaaaagaaactaccatcagagtgaacaggcaacctacagaatgcgagaaaatttttgcaatctatccatctgacaaagggctaatatccagaatctacaaagaatgcaaacaaatttacaagaaaaaaacaaacaacctcatcaaaaagtgggcaaaggatatgaacagacacttctcaaaagaagacatttatgcagccaaaagacacatgaaaaaatgctcatcatcactggtcatcagagaaattcaaatcaaaaccacaatgagataccatctcatgccattagaatggtggtcattaaaaagtcaggaaacaacaaatgctggagaggatgtggagaaataggaatgattttacactgttggtgggagtgtaaattagttcaaccattgtggaagacagtgtggcgattcctcaaggatctagaactagaaacaccatttgacccagcaatcccattactgggtatatacccaaagggttataaatcatgctgctataaagacacatgcacacatatgtttattgcagtactattcacaatagcaaagacttggaaccaacccaaatgtccatcaatgatagacaggattaagcaaatgtggcacatatacaccatggaataccatgcagccataaaaaaggatgagattatgtcctttgcagggacatggacgaagctggaaactgtcattctcagcaaactatcactaagacagaaaaccaaacaccatatgttctcagtcattggtgggaactgaacaatgagaacacttggacacaggatggggaacatcacacactggggcctgtagggggtggggagctgggggagggatagcattaggagaaatacctaatgtgaatgatgagttgttgggtgcagcaaaccaacatggcacatgtatacctgtgtatcaaacctgcacgttgtgcacatgtaccctagaacttaaagtataattttaaaaaaagaaacatattttagactttaggataacattgagtaaattcttgcattttaagaagaacaactgaagggagcacatgtaaattagtaatgagtaaactgaaggagtaaattctaaggagatctagcttaaaaataatcatcagagttctggagattggttgcatgagaacgtaggcatatttaaagtaactgacctgtacacttaaaaattgaaaagatgttaaattttatgtagtatatattttaccaaaattaaaaataaaacataaatacactgctccacccatttccagcaccaatagtgcttctagaggcaaccactttcaaggctgtagatgcttctttgtaatttgcctttatttttctgacaatatgcaatactgctatatcttatacttgttgtctcgtgtcatcattttgcaatctttgatttcttatgttagatgagcactagcactaaagccttccccaccaagccttcacatgaaactttcctcacctcatcgcctacctatattgccaatgttccttttcattatactctcgatataagtataacagatttttttgtcagtcaatattcagtgtttgcagtgttacggctgtaatattaggtggaaaatgttattcactattgagtcaaatatagtgatggaattccatttcttcttcatgatgtgactaggtatggatctctttgtttattctacttagagtttattatgtatctttattgcataattttttaatgaaatttaggaagtttcagccattatttcttcaaatatttttcctgctccttcctctcttctccatttggaactcctactgcatgtatgctggtgtgcttaatggtgtctcacatttctctgaggttctgtccggttttcttcattcttctttctctttgctcgttggcttgcataacctctatcaatctgttctcaagtatactgattctttcagccagttcaaatctactgagcctctccagtaaattttttattttggttatttcactttttgacttcaaatttccattagttcttttacaaaaatttcttttatttttatttatttattttttcttttggagacagggtgttactctctaacccagactggagtgtgtagtaatgcagtcacagctcactgcagcctcgaccacccaggctcaggtgattctccacctcagcctcccaggtagctgagactacaggcacacagcaccaagcccagctaattttttgtagcgacagggtttctccattgttgcccagactgatcttgaactcctgggctcaagtgattgacctgcctggttctcccaaagtgctaggatggcaggcatgagccaccacacctggcccttttataaaaacgtctgtgtttttgttggtattctttatttgattagacattgtcatcataacatcttttacttctgtacacatggttttagttctttgaacatatttataatggctgttttgaatttttcatctattaaatccaagatctggaccctctcactggcagttctgttggctgctttttcttcttgtgtatgggtcacaccttcctgtttcattgcttgtgtcacaattatttgttgctattgaaagctgaacatttttggtaatatattgtttgacactagatacttatttcctcccttctctggagcttgtttttgttgttgtttgcttgtgtacttagtagctttgctaaactattttagtggtctgtttctctccccccacagcgtgaagcttctgtactcatcacagtgtgcatccttaggcatgggacagtcaccctggaatgactgatcttagcagggctctcttcgtttatctgatttcactttaaaaccttctgcccctttttttggtctccattaattgctggctgattgtttttgacaatgtcctgtggtataaatggttctatggtctgatccaattaaattcaggcagggatagtttttgaggctagtgtttgaggtttgttctgttctcaggagaactcttcttaactgtccctctctctgggtgaactagctggcctatgatttagcttattgttctcaatataatctttcaatcaaccagaccaataatagaaaatattagtttaattttattgctggagacctccctcatcaagacttctgacttgctgcttctatctgaactggtttttttctaggtctgatacacagctgtcaccctggggtttcctttgccatcttcctgagaattccctggaattcccctttgaattccctgaaatgaaggggtcccagcaattacattcctaggtatataatcaagagaaacaaaaacatatatttacacagaaacttgtacatgtatgtttatagcagcactattcatcatactcaaaaggggaaagaactcaaattgataagcaaaatgttgtataaccatacagtagaatattatgccataaaaaggaatacagtactgacacaggctgcgacattgatgatcattgaaaacattagcgaagtgaaagaaggcagtcacaaagaccacatgctatgatttcattcatatgaaagtccagaatagggaatctatagagacagagagtggattagtggttgcttacgggtggggaaaatggtaacagggcaatggtagcaaaagatataaggtttcttcttgaggtgacgaaaacctaaaattgactatggtaatagcttcacatatctgtaaataggttaaaaaccattaaattgtatactttaaatgggtagattatatgatatgtgatttatatctcaacaatgctgattttaaaattcaggccattgagatatttattggcaacctgaagttgtcattgaatcttgcaactctagcagtatatgagagtaactctttaatagaacctcttaagaaacttcccctcacatccattggccaggtttggatcccctccccctttcctaaaccaatcactagtatggaactgagatcaccaggtgtattagtccatttccacactgctgataaagacatacccaagactgggcaatttacaaaagaaagaggtttattggacttactgttccacatggctggggaggcctcccaatcatggtggaaggcaaggagcagcaagtaacatcttacatggatggcagcaggcaaagagagagcttgtgcagagaaactcccgtttttaaaaccatcagatctcgtgagacccattcactctcacaagaacagcatgggaaagacctgcccccatgactcagtcatctcccaccaggtccctcccacaacacatgggaattatgggagctacaagatgagatttgggtggggacacagagccaaaccatatcaccaggattacattagattaatcatgacttaaccaattaggaaatgagtgcattcataaataaaattatggttctgcccaacaagaatgaagggaggattggctattgggtgggtcagcaatagtgtctgctacacacttgcttagtgttttcaggtttccatgcctttctactatcttaattttcctcacaaccaccctatgaagttagcaggagaaatagctacatttttgagatgatgaaactgaatctcaaaaatgtaaattatcttagccatggttatactgcctgttgagtaatggagccaggacttgaatctaggtttttctgactccaaattcaatttttttttttttttttttttttgagatggagtctcactccatctcccaggctggagtgcagtggcgtgatctcggctcactgcaacctctgcctcccaggttcaagcgattctcctgcttcagcctcccaagtagctgggattacaggcacataccaccacactcagctattttttattagtagagacagtttcaccatgttggtcaggctggtctcaaactcaggtgatccacctgccttggcctcccaaagtgctggggttacaggtgtgagccaccacacccagcccaaatttaatttttaaaattagaattttttaaaaaactatgtccctataaatataatttctattaacaaagtgttacttatcataatttttagaactccacattgaaagatcctccagataacaattcttatttaaagctttctcttactttcccctctaacaaatacaaccagttcattctctccagttgacgtcttttcaatacaggccactacaccaatagattatcctgtgctcttattcaaagaattgttctgctaaggattgtgcattcctactaatgagtttgttgtagattttgtggaattaaggagaatgcagtagaattttaaattatctgtctttatctctaatggcttttcattcataattatagttttgtaatgagtgcatttgtgatgacagaaatccaccataacatattccattgtctgaattagcttcagacccttatttaatgacttattaatcaaccacagtcagccaacactgtatcacattagatctgtgaacaacacaggcaaagaatttttcttttctctctatgtaacccgtggagcaatgtttaacaataggaatctgttcaaacatccatccacagttccattacatctgcagttctattagtaaaggtcagcctaggttagttcactgtcagcagccagaaaggtgcaagaatagatgagcttaattgctgtatctttactatcactatgactatttagaatgcaggtaagtaaggcgtccaagatactaaatctccatttaggttaccaagaagcattagttaagtttcgattcttaccgagagccaacctaattattactactacggatgagcacatctaagacacttcctaaatcagtaatcagtaatatgtattataattactttaccacctattccacttctaccattcttaggatttaggcagttaatcaacgaatataatatcccattgggaattcgtagccagtatctacagatacagaacaacaatattatgtctttatctagacaaagtatgaaaatgctaaaataaatgtataattttattagcttacttgtgtatggagagcaaggattctcaaccttgctgcacagtggaatcacctggagaacattacaaaatattcatgcctgggttccacccagaagctaatataattggcatagggagcagcctggacacaaatttttaagtttcccagatgattgtaatgtgccccacaaagttaagaaaagccatggtctgtaattacatggggtgagtgagagagagagagagagagagtgagtgtgtgtgtgtgtgtgtgtgtgtgtgtgtgtgtgtgtgtgtgtgtatgatgggggcagtcaggaagagagggtgagaaattaaaagtctttggacataaaattcgtcaggcggggccgagtaaggtagctcatgcctgtaatcccggcactttgggaggccgaggcaggcggatcatgaggtcaagagatcgagaccatcctggccaatgtggtgaaaccctgcctctactaaaaatacaaaaattagccaggggtggtggcgtgcacctgtagtcccagctactcaggaggctgaggagaatcgcttgaacccaggaggcggaggttgcagtgagctgagatcacgccactgcactctagcctggcgagagagcgaagactccatctcaaaaaaaaaaaaaaaaaaaaattggtcaggcgggacctcaactttcctggtaggaaaatgatgtttaaaattctgaacactgaaatcaaattaatatataaatgcattattttatttggtactcacatattttattcttcttacaagttaaaccctgtttcaagtgctaaggattcaaagatgccttttctcttaggaagtcttaattagcaatggaaatttcctgattaagacggaatgaaaaggcttatcgttttccccacctggctgaaatctggaaccttaatttaaattattatgattttattccacagacgctaaaataaacttaagtaattgacatattttgaacatatatggttttgtttcaccttcatattcttgggataaactatatggcacatgcactttttaattcttgtacttctgtacatagtttcttgtgttaacttctgtttaatgaaattttgtaaagattcctgagcctaactaatagattttagagtcttattactgcttggcactctgtaggtctgtgcacctgccaatgaaacttgaattcttcagtggcatggcctttcttattgttgctagtggtcagcattcactagataactaaattagctcttaaactgaaaaagaaaatctataatgtgtcttctttctagagtagaaaataacagcagaagaattcacaatagtctagatacattgccatagccacagatcctgcctttttttccaattagcaaagggtttctctgggaactaaattactattcctcattcatccatctgcttccttcctccttgcattcagggaaagtataaaagttactttgtacacaatactagacatgacaagaagttgccaagattttctaaaccagccctttaaaagggctagtataccttttttccttcataaaaatttaaacatgttttaaccgaacaatttccaaaaacagttaatcatttccacatagtatttgccagcttttaagcctgctttttaaatgttcatgagcccaacttatttttctagctcctttgactacagaagaccctctgaatggtaaaaagaaaaagaaaacaaaacttttctgctccgtttttcaacttggagtagacaaattctaataccctatgcacatgtccacagagggcttttcttaggcaatgactgcataatcaaacatatatttttcttcttttgttttacaaaaaaaactttaatttttttcttctttgtactctaagagtcaaaacttccctacatgtgttatgctgattgttttgttactcaaacagaaaaaaacagcatttctttaaaatgtttttcatacaagtaattatagtacattatacagaattagggaaatatatgggggggaatcacctaaaattttaccaccttttaaatcattcttagcattttgatgtattcctaccagtctttttttttctgtacacctacatccgcacataatcatactgcagattcatttttgtgctacgtgttttccagttacaatagcctagacattttccatgttaatgtacagcgttcatatctatttttctcattaacttctttccattctttaagtcttagtgcaaaggtcacacctttaattagcaatgcctgtcttaacatttcaaactaggtctggttcccttgttatttgcttttacagaatcatattcctttcctatacagcaataaccagaagtgtaatgatttcatcatctgtcttccccataaggtgtaagctctatgagaaccaagaccatgtctacctacttttgcctatcattatgtaacctgaacaaaccctggaacatagtagacactcacatttgacaaatagagtaatggtcagttaatgatagcgacacattctgagaaatgtgttgtcaggtgattttgtcattgtgccattgtagagggtacttacacaacctagatggtatagtctactacacacctaggctatatggtctagcccattgctcctagtctaccaatccagatagcatgttactctactgactactgtaggcaattgtaacacaatggtaagtatttgtgtatctaaacatagaaaaggtacagtaaagatacagtatgaaagatttttaaaagggtctacttgtatagagcacttaccatgaatgtagcctgaaggactagaagttgctctgggtgagtcagtgagtgagaggtgagtgaatgtgaaggcctgggacattactgtccactccagtaaactttataaacattgtatacttaggttacactaaatttattttaaaattttttctttcttcaatcataaattaaccttagcttattataattcttttaccttatcaactttttaattttaaaaaattttttgacttttaataacacatcttaaaacatatgttttacaactgtacaaaaatgttttctttatatacttattctatgagcctttttctatttttagagttttctatttttattgttttactttttaaatgtttttgttaaaaactaagacatgaacatacacactagcttaggcctacacagggtcaggatcatcaatatcactatcttccacttccatatcttgtcccatcaggaggtcttcaggggcaataacacatatgaaactgtcatctattatgacaacaatgcctttccctggaaaatctcctgaaggatcagcctgaggctgttttacagttaacattttttttataagtagaaggaatacactctaaaataacaataaaaagagtatagtaaatgcataaagcagtaacatcattattcttatcaagtattatatagggtacatattatatatgctctacttttatatgactgctttgtttacaccagcatccccacaaacacatgagtcatgcattgcactttgacatcactaggcaataggaattttcatctccactgtaatcttatggaaccatgatcatatatgcagtctgtcattgaccaaaaaaaatcattaggcagtataggattatatttattgagatgccattgtatgccaacacataaattttttgaatgagtaaataaataaccctcattttcaatggccatttgataatctattcaatatatgtgattatactttacttagccagtccccatattggacgtttagattgtttccaatttgtcaacattataatgcctcaatgagtatctttgtgcatgtaacattttagtattcccaatttattttacaactgtttaccagaaacagaatttctggatcaaaaggcaaatatcttattatggctcttggtacgtagttccaaattgctcttcaagttatgttgtgacaagcagtgaaatggtaggccagtttcctttctctatctgttttgggtatttaaaaacgttcttgttaagttactagtaggcaaagaataatttattgttttaatttgcatttttagttataggctggatatttttcttatgtttattatttgcatttctataaactgtgtataacagtaccctttctaatactgtcatgatgcttctaagctgagaggatggacaaaatgaatgtggtaaataacgcatgaatatattatataaaaattaattttaaaacatatactttttccgtaactaatcaataaatgaatctgcatttcccatagcaattatatccgttgagaatagatttagctgcaagttgtagaaaatccaaaataagagtgccataatagaagttggtttctcccttctagggagatagttccgaggtaaatagtccagggctgttttagcaccccatggtgcaagggactttggtttttccatgtagctttactctgtgtggcctctgtattatgacccaagacaatagcacctatgttcaaacagcagaattgatgaagggatgaaaagaagaggcaaattgtgtgtgccacttgtctcttaagaatgttttccagctgggtgcagtggctcacgcctgtaatcctagcactttgggaggccgaggcgggtggatcacgaggtcaggagattgagaccatcctgattaacagggcgaaaccctgtctctactaaaaatacacaaattagccgggtgtggtagcacgcacctatagtcccagctacgcgggaggctgaggcaggagaatcgctcgaacttgggattggaggttgcagtgagccgagattgcgccacttcactccagcctgggtgacagagcgagactccatctccaaaaaaaaaaaaaggaaaaagaaaaagaaaaaataaaataaaagaatgttttccagaagttgccacaggatatttctatttacaacccattggccagaacttagttatatggacacagacagctgcaaggcaaactagggaaggtaacctctattctgagcagtgaaatgctcagataaaaattttattggtaacaataaagatggatctaggggaactgctactagtttctgccatagtaatgtaatacagttcaaataacctacagatataatttatagatcttcatctttaaacatcacaaatctcatcaacttctaaccagagcttacagcagatgctatagtgactagctgatggaaaaacaaaaacaaaaacaaaaacaaaaaaaacagatcagactcacttgcaaacttcttattcttgtttaaatgcccctgctgcagctagaccatgcttagttctctgaacatgtgcatatgaaccaaatccttcatctcacagatctagtcactgtctatttcaactttttttccttttcctttatgatatatcttttctgttgggacaactagaaaattctaacatattgacatttattcatatttattgaacatatatatatatatatatatatatataccaggctaacaggtaattagcggaaagagaaaaaggatgtgaataaattcacaaatacaataatgagcttttaattaaacatgatactgcttatagcaacagaaatttgaaaaacacccaaataagaaagatacagttaaagcataagatagccaaaacggtaaaaataataataagaagaaacgaacattttgttataaaacaaaaatactgtagataaagacattagcagctcttatatattttcatctcatgtgtattgtgtataccatcatttgacaacacagagggcctttcttttttcttaacaatattcagcaaacattaggcattcagtaaagactaccaaattatgaatgcaaatgagctccctcaaaaaaaagtgttgcattgtaaccacttctcatatgctacctccctgaggtggctcggctggtgtgactaactcttctatgagtttttaagattaacaaaaaaagagagaatattttcactgccatagatacgtatcagtatatgggattttttttgttgttgtttaagcttgttcttttttggtttgaccctgtaaccctattgcatctcataatgtaatataaaattgtagacatcttatggtgtacctatgctgtctcctaaaagaaagaatgttggttggttacaggaaagaaatatcttgataatgtagactgtagaaaataggataatattttgaaccattattccttctttgtaatcactataaaaatcagtgaaaagggaaaaataaatggtaattattattctgcagggcaaatggagttaactggaatttatcctataggattatcagttttagtgaactgtgatgtccttaaaagcccccaggtggcattatagccttgttttccctaagtcatttgttttcatatagcacagatcagaatccactttaacaagaaattccgcttactccaatgataaatgtgaatatgaaaaatactattttcttaatttgtttatttattcattttgagtaagttctcttctggaatagctacgaacttaaaatatgtttggattaaaataagataaaccactttccaaattaaatagtttataaaccaaactttcccaaaagaagtttcaaggatactactttcagaatccaataatatatgtctaaataaatatatatgagcagtacaaatttaattccaaatgaataatctcagtgagaagtagtttatttgcaattgttactaattttctttgcgacctccaataaattgttaattttctaagactcagtttctctaacgttcaaagcaagaacactacatttattaaactgaaaaacactttcaaggtctttagctaagtgctaggaataggtaagaaaaaagaacttttcagctaatatcaaataatataatttgtgtattcaataaatataatttcaggtacttgaccagtataattcaataatgaattactgtaatgaatacaaaaaggaaaataattatttattagggtattctgcctggttatttatattcagtaaaataaacttgtttaaattactctcctatatccttgcatacataatgagttttaatacttaaacctcctataaattattttcaaagtatgtaagaccaaacttatcaaactatacttgagcagtagacaccataatcaattatactgtatgactttctaaggacgttatttttgtattcactgtatttactaaataatcaacatggtaattaaattgtaagttcaggttgtaatttatctccaagtatttagtctttatttttttcaaatttaatctacccactgctctagcaaattatctttaacaaaatatactaagagttcaaacaaaattatatttattgtgaagtaattatttaatattagacctgaaaatagtttcttgtgaaacttgtaccaggttttaaactttttattctaaaaaaaaccaccttggtttgcatttaagttgaataattaaaaatattttttaaaaatcatgtatttttcatctttattaaaattagtttaagtgtttatgttaaatgtgaagtccattttaaaattatttcaattctaggcatgtacttaaattttttcatgaatttttccttataactttcatataaacacacacaggaaggctactagattcaaagctccagaaggttaattaatctaagcccttggattgctcattgaaaatatttttttaaattattcttaataaaatatattatttcaatgtattttcccagtatgttaaaattttgtattttttgtaagtaaaagaaaaacacctaaaaaatgtttttaggcctctaagttactctcctcatattatttgcagagggcacacagcctaactgggaaaaattgcacaattagagacctaacattcagatgagaatgccacgatgatcatgtatcttgcccttttggtgtaagatcactctctgacagagttccaggcccatttagaatggattgattaaataaaattaatttgctaaattagaaactacagctgtaacttgaaaaagggtctacgctaataaacgtgcattgacagtatttttgtaatctctttagaaccattattctaaagtccaaatgattctatgctatgattgataattacttgtatctaaagatctttaagatcttttccagcattaacccattaattttcacactttctctgtgaggcagtaggatgtaagtacggttagtttgattttccacatgaggaaaccaaatcatcaagaaatgaacttgctagaagtcacacaagcaacaccaacaaatgaaacagagctcaaagacctgacaccgcattgaacaaggaggtgccttatacactggtatatgcagaatgaccatctctatcaccaaatttactagctttatcctcgtaaaattgagccttgcttgacattctccctgcaaactcctcctcagctgctcatccaccctgaaaatgaacttcctttcagatctgaaccccataaagctgaaggtcactttgccctgttcccaattattacagagtacattatagctgttaaagagttacttgtaggtaagtaggttcagattatgcttgtgcagattatgctaggtattatttaacctatcaagacctagaaatagactttattttatacagggccgaaaactaggtttgataatgaatggaatttggagtctgacaaatttgctcttcagccgtcataagtatctgaaaacattcctccaggacatcttactggcagcaactcattactaccacctgagtttctcatcctcggcccctgaccttcgggaagcctatatgccaggagactggcaacccaaataagtctcgcccaaataagttggtattgccccaggtacccttgtctcctaaggttccttttaagccagcagtccccaacctttttggcaccagggattggtttcatggaagacaatttttccatgctgggggtgggtgggggatgatttggggataaaactgttccacctcagatcatcaggcactagttagattctcataaggagcatgcaacctatatacctcgcatgcgcagttcacaatagggtttgagctcctgtgagaatctaatgccgaggctgatctgacaggaggcggagctcaggcagtaatgccggctcccatgccactcacctcctgctgtgcagcccggttcctaacagcagggtaccggtaccggtctgtggccttggggttggagactcctacttaaaggtaagaaaatactttgtttccctagatgattatggtgaaaattgcctatctgcccaatgaaaatattataccaaaactcaaacattaattccaagtgattaatttttgaggtccacaatcccttatccataattccaaaaattcaaaaggctctcaaaatggacatctttctataaagtacttggtggcaaagcctcacctgacctgaccacattttatggcgaaacctaacctaaactgactagaggctttttacagtcttgactgatcacattccatgagaataatcacacattttactgcagaaatattaatttatgtgattatgtctgccatgctgcccccagaagggtatattaccttattaatagcatatgtacaccactatctttataaactcgaaaaaattctgagttctggaatgtatctggtaccaaggatttctgttaagatgctgtgagtcttttaagccgtaggtctttagtcttcaggctctaagacttcagcttgaatcctggttgcacctactagcttagtaatgggatgaatcacatggttcctcataagtctgaaacaattgcaggagtttttcctagaagaatcaatggaacttcatgaccaataggtgactaaaacatcagaggtgaagttaggaagggacactgactttgatatgctttcaagttcacacctgtttgtatttaagggaacctgtgaggacgccgtccaggcagatgtacagataggctgtggctctatgtggtccagaagtaagagctatggagttgaggaaaacaagactgaaaatggaaactttgagacagcagcgatttctgcagaaaaagccttgaggaagatagccccaaagaatgccagggaagaaggaatctttaaaagaaacggaaagaggccgggcgtggtggcttatacctgtaatcccagtactttgggaggccaaggcaggcggatcacaaggtcaggagattgagaccatcctggccaacacgatgaaatctcatctgtactaaaaatacaaaaattagccagtcgtggtggcgctcacctgtagtcccatctactcaggaggctaaggtgggagaatctcttgaacccgggaggcagaggttgcagtgagccaagattgcaccactgcactctagcctggcaacagagcgagactctgtctcaaaaaaaaggaaagaaagaaatggaaacaaccatccaagaaatagtaagaaggccaagaagtacaccatcataaaagccaagataagtcacgagttctccaaagggggcaactataaaaattaaatgctagaaaaaaagagtagggagtatgaggtgtttgagcaaggaccaaatgttttgaccagaaaggagccactgaagattttgaaagtgtagtttcagtaaaaacaacacgggattaaagaaaggatgtgtaatgtgtggtgagaaaatgaaggtaacaggtgcagagcattcctttgaaaaggaatacaagcaactgtaaaagtcaccaaagaaaaggaaaatttgaaaagtaaataatggaaaacaccacatggatttcaaaagttggccagacgctgtggctcacacctgtaatcccaacactttgggaggctgaggcaggtggatcacctgaggtcaggagtttgagaccaacctggccaacatagtgaaaccccatctctactaaaaatacaaaaattagcttggcgtgatggtgcacgcctgtaatcccagctgcttgggaggctgaggcaggagaattgcttgaacccgggaggcggagattgcagtgagccgagattgtgccactgcactccagccagagccagactccatcaaaaaaaaaaaaagatatattttctaccttttagaataatataacttttcactccttaataatttttatatttaccaagtgcttggtaaattctactttacaacttttctgaggggaaataattatttctattttacaaacaaaggagtaaagggagagagtttacgtgctttgcttgttactgttattcctactttcaaggcctttactgattacctactatattcagtaaagtatactagtgccacacctatagtgcctcacactgatcagtgcttaatttttttttttcaagtaagctgagttagaaatatatttgggtttagtaagtgtcacttcaggcaacacagatacctggaataccaggctcttttttagtttaacaatcttgccaacgatgagaaatggatttgaatacacccataaccatgccgaaaagaaaaagtgactataaagaataaatatcaaattgagagttcaataagacaattttgaactttgaatattgactgcattgactgaagtaaatgcccactcacttgaaagctaagaaaatgagaaagaaaaaagccagacttgaatgaactaagaggatttgaattatctgatccttttattaaagagaaagggagcatctagttacctagggaattgacaaatgtttcaaattatcttccctttaataagaaaacaatcttatatacgctgactatgatttttctaaacgtgttttctaatactttttataaattatatttcagtctaaaacaacagtgttcatgtgttcacaacagggacaaaacaatcaagttagtcctaaagaaaatatgacagattttcccccagagctttactgaggtgtagttaacaaataaaaatatgacagtttaaaaatagaatcggtaacttgctttcttttattattacattgggaattttatatgtcttaggtcagcacaacttgggcattttctaccaaagtactatggaaataataaatcaggccaagtgcggtggcacacacctgtaatcccagcactttgggaggctgaggcagcaggatagcttgaggccaggagttcaagaccagcctgtgcaacatagtgagaccctatcttggcagaaaaaacaaacaaacattagctgagagtggtggtgtgtgcctgtagtcttagctacttgggaggctgaaatgggagaatcgcttgagcccaagaatttgaggctgcagtgagctataactgggctactgcacttcagcctgggtgacagagccagatcctgtctccaaataaatagataagacacaattttttttttgtcttcctcaaggctttttctgtgaagctgtctcaaaggttccattttcagtctagttttcctcaactccatagctcttacttctgctccccgcagaaccacagcctatctgtatatctgcctggttggcatcctcacaggttatctcaaatacaaatacctaaataaatcactgacctaggagttgaggtggagaggacagtcttagcctagaagattctcagaaatctcaaggtctagcttaggcttttgtgttcattgaacattttactccaaaatatatctgaatttgttttaatataaaataatgcttcgtttgccaattacattacatttccctaaatatttgcagaaaatcagtcctctggaggatgcaccacaattcacctatggcttccccagcctcctgcaccctcagccctagttttaaaactacagctaaatgaattttgatgatgaggggaggacataacttaatgctttctgatcaaatgaatcctgctgaagattattgaagagggtagaataagacaacagagaaagtgagtgggtgtgcaataagaatgtaccccattgaagagccaaagcttcctaaacttcatagtaaaaatgaattcatattcttttcattatattccatgaaattaaattaaatgtcacaaattattttagtttattttaattcattcatccattcattcactcagcaattaatattttgtatgccccttcacatgccagactgtgtcctaggtacttaaggatacaaaaatgaaatagaagttcctaccttgaagcactcacagtctgtgtgaaggtacatgcagtgagacagaataggagctgcaaacataactgtacatagtgggcacagagagaccaactctttctagggatgctggcagaaaacaggaaccacaaaaaaaatgtaaatagtggctgagctgggttattaaattggggtttagggaagatctagacttttgatccctcagccctcttccttcaccttgcagggattccttaagaccactaaaatttggaggggtgcaatctgaaacctagtgtcttgtatatgttcccaattccaagaaacaaaagattccaagggcagtacattcagacctataggtaataagacctagaaaaagacttttgagctcatttaggacaatgccccatcttagaaacaaaaaaatagcccaaggcccggagaggtgtaaagatagtgccaaaggagtggagctcattagtggcagcttgaagcctgtaaccaagcttgtgcccattccactgcaacacacgccagcaccacccttagcattctgtgcttcattttctagcctttagtcagttgaaaaatatacataaaattttatccatcatgaaaatatttaaatgtgttaacattaagaatatatagtgcttttctaacaatattttattccttacaaaaaattattataaattttaactatacactaaaatagaggaaatagtataagacattctcatactacctattgattaaattcaatagcttttaacattttggcacacttgttttatccctctttttgttctttctttttctttgttactgcaaatattttaaggcaaatttctgacattatgtctacgtcatttcaaccttaaatacttctgtgtgttctctaaaaaataaggactttttttttttactacaatgtggtcacagctacaaaattaacaatgatcccttaatatcatctaataaccaatgttcaagtttccttatttgtctcaaaaatatctttttacatttattttagtcattttaaatatgtatttctattttactgcaaagtagtattctatatttggattcagcaatccaatttttcttgctttttataaacttctattctgaactggtaccttagttacaagggccttacatataagtcattaaattcaggcacacctacctaatcctgaccccagccataatatatttttaacacttcaatgattactacagatatccttcctgctttttcaccccaatacacacaagctatgactccctcattactttctccagtctattaaaattacataaaattccattaaaaaggcctttttatatcacagataaaatcacacttgctatatatacagtgattgtgattcatacagctgtaattataattcaataaatctagatattttcttgctccatcaatgctaacgtgatgattgggtttggctgtactcaaaatttgatatggctcctttcttagccagtgcttccaatagctatcccatatggaatctagtttatttgaatttcagcttgaaaccacatctactgtctctttccacatctatggaatctttttaaacaaaaatgcaaattttctctatacttatgacatacctagaaaatttgagcccatagtaaatatctcagaaaggccatcccattagcctaagtttagtaaaagccaaattccaagacctcctagcaaagcagaaataccagtaattgcgataaataaatattagtggactcaatactctagtgaaaacatagactgtcaggccagatttttaaaaaaaatctaattctgtattgttcaaaaaagatacacattaagaaggattttacagtattaaaagtgaaaggaaagaaaaacatacaccatgcaaacatctacaaagaggaagctgatatatctgtagtaatatcaagcagtcatatttaaggcaaaaaagcaatattagagacagaaaggaatacttcataataataaagaacccaattcatacaaaagatataataatgataaatttgtaggcacttaataatgtgaactcaaatatataaagcaaatgttacaggactagaggtagaaacagagaaacctacaatcatgaatagaagctgatagaatacacagactatacaatttaaacagaagaagaagaaacttgacctgattgatataaatggaatattgtgccccaaaactaaaatgcatattgagtttgttaaaaatttcattttcaaaaattgagcatgtgttgcaaagcaagtctccacgaatttcaaagaactgatatgagacagagtatgttctctgactacaatgtatctaggctaaatgtcaatattttttaaaactttaatatttccatctatgtggaaaataagaaatctacctctaaatgatataacagccaaagaaaaagtcatggaaaatattttgaactgaaaattcaaaatatcaaaacttgtaaggcgtagtttaaaggaatactttaggagaaatgtacaccattaaatgcacactagaaaagaagtaaaactaaaaattaatgaggtaagtattagtcacaagaagttaggaaaagcacagcaaattaaagtcaaaataggaagaaaataataaagattatatcgaaattagtaaaacattaaaaaatcttacaacagaggttcaataaagcaaaattaggtaaattgaaaacactattaaagttgataattgtatggtaagaatgaccaaggcaggaagagagagaaggcagagatttacaacacatatatagaaaagaataaattactacatataccaactattaaaacaatattaagaggtggctactaacaactttatgacaataaattaaaattttagataaaacaaacttcttagaaaatacaatttaccaaaatgacacaagaagtagaaaatctaaacagctcattaactattaaaagaacattaaatccaccaaggaagcttcaggccaggtggcttcccaggctaattccaccaaacagtcaaggaagaaataatgtcaatcttacataacacttccagaaaataggaaaatgaagactatcattcaacttcttctgtgagcctaaaataagcttaatagcaaagcctgacaagaacattttgaaaaagaaaaattactagccaacctcattcatgtacataatttagaaatgccaaacataaaatattagcaagtaaaattcaacaacacatggaaagaataacataatatgagcaaggcatgtttactacagaaatgcaaggctgtactaacacactaaaaccaatccataaaattcagagcattaacacaataaaagagaaaaatcatattatcattttgatagagaaaaattacctgacaaaattcgatatctcatcattatttttttaaaaaagaactttcagcaaactacaattagaagtgaacttgcttaatctgataaagattatttatttaaaaacctatagcattatacttaatgaaatattgatagctttccctcaaaatgtagaatgagataagaatgcccactgtcatttcttctatcaactttgtactgaactttgtactgtaccagtacaataaggcaagaaaaaaattaaaatgtataagaattggaaagaaagagataaaactgtcatattcatagctgacatgtataatggcatacatataaaatacaaaataatctacagaaaaaatattagatatcaaaagcaattttagtaaagttgctgactacaaagtcaataaacaaaatcaatttatttctatataccaacaacaaataaacaaatagacactttaagatgccatttataaagaacatcaaaaaaagcaaacaagaataaatctaaaaacttgtaaacctctacacagagaaacgctaaactattactgataaaaaaaactttaaaggtttaaataaatggagagatacaccacgttcatggattcagaggctcaaaattataaagatgtcaattctcccccaaactgatacagagaaacaataaaaccacaatcaaaaccccaaattttcttaaaactttacgagttgattataatattttaatgaaaatgcaaagtgccaagattagccaagacaatcttggaaaagaacaacaaagtgagaagacttgctttatcatatatcaaaatttattataaacctacagaattaagtcaatgtggtattggtatgaagacagaccaacagatcaatgagagaaaatggagagttaagaagcaaatccaggcataaatgaatacatggtttatgaaaaatagcagctcatagaatggtggggaaatagtgatctttaaaagataaatggttctggaaaaattgtatattcatatggaaaaaataaatttttgctgcttctttatacgatgtaccaaaattagtttcaagtgatttgtagacctaagcacaaaaaacaaaacaaataaatattttagttggcagcatgggataatattagtttggaaaacactaaccatagaaatgactgatacatcttacatatgtgtcataaaggcttctctcaagatacagaaaggaataaagcaataagaaaaagccagtcacatacaaaatgagagagaaagaaagatgctcaacatcattagtcatcaatgcaaaattaaaaccacgataagagaccatgacatgtccaccagaatggcgaatattaaaaagaccaccaacctcaaatattggcaagaatgtagagcaaacaaaactctcattcatttttgctaggaaaatggtacccctatcctattacccaacaattctactactaagtgtttacccaggagaaatgaaaacatatatccagaaaaagacttggacaagaatgttgattgcatctttattaataagagccctggactggaaataacccaggtgtccaacaatagaagaatagacaaacatctttataaaatgaattaccacttatcactaagaaaaatcaaactactgatataatcaacagtatggatgaactaaaaaaattatactgggtgaaataagccttacacaaaaaagaatatactgaacaagtctatttatatgaagttctagaataggcaaaactaatctatagtggaaaaaaacttcctctactcttgggagtttgggaaaattcatggaggaatatccttgcatagtgataatgttttatcttgatataggtttgggatatatggtcatatgtagctgtcaaaacctagaaaatgaacaattaagatttatgcatttcattatatgtaaaatttacattaaaaaattaactgtaaacaaatattgaattctatttaatgatatgtatgctgaaaaatttagaagaaagtgattgaagaactctgttttgaaatgtatcaaaaaggtaagatggattgatgaatgggtagaaatataataaaacaagcacagttaaatgttaatggtacaagaactggtgctgagacaactggatactcacatgcaaaaaaaatgaacttgcacccttacctcgcttgttatacaaaaattaactcaaaatgtatcaatcacctaaatataagaactaaaactataaaactcttaggaaaaaacaggggtaaatcttcatgacctcagatttagcaatggatttctagatataaaaccaaaagtacaaataacagcaacacaaataggtaaattgggcttcatcaaaatttaaaacttttgtgcatcaaaaggcattaaaaagaaagtaaaaagacaacatacagaatgggaaataacatttacaaattgtatatctgaaaagggtctcacatccagaatatagaaagagctcttacaactcaacaacaaaatgacaaacaacccaatttaaaaatgggcaaaggacttgaataaacgtttttccaaggaaaatatataaatggccaacaagcacatgaaaagatgctcaacatcattagtgaaacacaaatcaaaaccacaataagatatcactttgcgcccactaagatggctataaccaagaaagacagacaataacaagtgttggtgaggatgtgaagaaataggaacccttgtacattggtagtgggaatgttcagctgctgtggaaaacagttggtggttccttagaaagttaaacatagaattaccatatgcccccacaattcatttgtactcaaaaaaagtaaaaacaggtactcatacgaatatttgtacatagcagcattattcaaaatagcctaaatgtggtctatacatggtcatagcagcattattcacaatagctcaaatgtattgttcagtcataaaaaggaattaaatactgatacatgcaacaaggtggatgaatcttgaaaacattatgctaagtaaaagaagccagacacaaaaggtcgcatattatatgactccattcatataaaatatccaaaagaggttaatccataaaaacagaaaggagatcagtagttgccagggactagggggagggaagaatgggattaactgcataatagttatagagttttattttgagatgatgaaaacattttagaactagatagagatagtggttgtacaatattgtgaatgactacttgtgaatgtcactttattgttcactttaaaatgattacttttacattatgtaaatttcaactcaattttaaaaatttaaaaatggaacaagggagaggatttagaaggttctaaatgctaaaagaagttaatgatagaattcaggtagtgcgtatacaggtgttcactgaaatctttcaattttgctgtatgtttgaaattttttatgatgaaagttcagggggaaaaatggacaataacaagtatagtgcaacttaaaatagcaggaactctcaaatgctgctagtggagatggaaattaatacaaccactttggaaacctgttagtcattattcactgaagttgaatatcttgatattttacaatccagcaatccttcttgtaggtatatatccaacataaacgagtgtacatgagcaccaagagtcttgtaaaagaatgtccataacaactctacttataatatctaaaaacttttggaaactcaaatgtttatcaacagtagaatggataagtaaacagtagggtagtttataatcacacagtggaaccttatataacagccaaaaatgaactcactacagcagtacacaacatggttgaatctcctaaacataatagcaaatgaaagaagaaagactcaaaagaacatatatgtaactcaaaaacaggcaaaactaaattatacagtaaatattttaaaaattatacagtaaatatgaattattgggtggtaaaggtaaaaagaaaagcaaggaaatgattaccataaaaatcaggatagtggttacacttgggagaaaggaggggattatgattgggaaacgggcctttcatgtgggggatgctagcaatgttctatttctttactgggatgcctaaatttttgctttttaataattaggctgtatgtttatgttatgtacttccttgcatgtattttgtatttcacaatttttaaaagtaaaaaatatcttgcatacacatggacaagcatatcaggaaatgggatccctcatacattgctggtgggaatataaaccagcaagctctctcgggagaaggaagtatttcccatgaaattcagtaggcattctgcctaccacctggcggccccacttctaaatatctaccccagagaaattcctcacagatctctgcataggctgttctttgcaacatttgtttatttatttacttttggtagtgtgtagttggaggcaacctccgtgtttcttagaaaaggaactaataagtaaaatctgatacatacatattaaggaaagataggtagtcagaagcaatgaactctaaaaaaaatagagtaacatggattggttttttaatagtgttgagtgggaaaaagtaatacaattatatctatgccctttatgtaatgtaaaacacatatacaaagatacgtttttcagacacatacttatccaagtacaggcaatgtatatatacctacatctatacctatcccaaatactttagagtaggggatggctatgggaggtaggaaagtggaaacaaggctcaggatggagggactgaagggataggagcctgaaatggatgatgatggttgtgtgctgtgaacagaattatataattaattcaattctccactcctaaggttcaaaggagaaacaaaagagtaaaataatatactaatattgttattgttgctaatctacagcactctcagatcagtgtaggggccccttcatatccttaaaccttatcagatttatttttccgggctccctttgcaggggctacttctttatgtgatgcctgtgcttttccacatattaaagagctggtctccccagcactgcatcttcctttgcaaatcctacagaattattttgtggagttgttacagtacaccaaccaaataagcttctacaaatatcatctatgtgtgtggttttgaaaggcatactactgttacagctattatatgaatattaacctataaaatacaatgtaatatttctagtaaaaatgttcaccgctgcagctgaatctaaagattctaccccaagaatacaagtttaaatagacacttaaaaaagtattatttactttaaaaatgaatgtagcattctttgcttattaaaaaataatcccataaactactagaatattctttatggatcagaatctttaaatttacataggtcctatgtaaaaattatattcaaaccataaaatttcagataatattctagaacaaatttgcaactacaccactatatgtggggggcggcggggaaagaccttatatggacaaaaaaatgagaagcaagggtaactaagcagagacaatgaaaaacagttttgaataaagcatctacaaaatttcaatttttttttctttttgagacagagtctcactgtcacccaggctggagtgcagtggtgtgatctcggctcactgcaacctccaactcccggattcaagtgattctcctgcttcagcctcccaagtagctgggattacaggcatgcaccaccacgcctggctaatttttgtatttttagtggagacaggctttcactatgttgcccaggctggtctcaaacccctgagctcaaattatcctcccaccttggcctcccaaagtgctgtgattacaggtgtgagccacactgacctggcctcaaaacttcaatttaaccaaacacttattgagcatttaatgtgagaaaggcatagtctgggagctgaggataccaacatgaagtaggtcctgctctcagagatcaaagtctaaaaacaataaatgatgtgtagtggttttagtgtctttattccccagacaaagggatgttttgactgtgtttataaaatgtgtacaaattaagactcaacagtttaaagattatattttatatttgtgaacccaatagttatgtttaaacattttgtggcacattaactgttctgggtaaataccaaagacgttcatggatccagtcatttttgagttttttctttttttaagagtcatggttaattttagctggacagtctgaatcaggtcatttctatcttgctgagttcctcttacagtctcagctggacccagcatccttcatttcctatcctaaattgccccccttatgttctatgcttgctgtggagaagaactgtagctcttaattgtctgtggccagatcctcccactccatcttccccttctgcacagaacactccatgtcactctggggagaaacatgctatatttatgcaaagggtggccgtatggatgtttctcataaacaccgaggtttagaatgtcaaaagtcatgtcagaccttaaggtaacaacaaaactttcttggaaatctattccatgatgttcactttgatgtcagttacaactgtgttgtgcatacgtatatctcggtatagtcacagcaaagaagcagggatgactagcacacagggctaatactaatgactttattttctaccacatcctaccaattaagtagttctcatagtggttacctgaatcacaaaaattctagggtcttcaactccataatgacagacaggaaagggaacagttggcctagcttcagccatttatcctggactcacaaaaaccatcttttttcatttgtctagtctttcccagtcaccagtattaataaacagctgccagatgacaagacgaaattgcctctgcccatggattagagtattatgttataagctcaacagcagaagtttaaattatgaaagtgagaacaaatgaagcctacttgctaagatttgcctacctagctggtgtaagacaatcttagctctactgagaaatttacagtgcatattgtttttctttcatctgcccttataagaatggatagttctgcagtcaaaatttttgcccaaggattttactgtcacaatgaactttggtcatcaaagtctgagccaaagaaaattgaaggtgattggtctaatcagtttcccattccttgggaatgccactaaagaatgctaccctgttttcttggctcaatgcaaatagcctcatttattatgtgtacatccaagtttatgctcgtctgaggagaattatattcagaatttagattccaaaaagcaagccccctgcaagtctcctgatgattaattagtcatttaatttcaatgtttactgagatcctactgtgtggagtactgtgctaggtgccggggacctatatccctgtaatataaatatcctccttgatctcaaggagcttagagtgcaataaaagagataaaaactacctataaatgaaacaaggactctcagagattcataagcaaagtgttaaaaaaaaagtaatgaaaattatctggggagagcagagaagactccagtgaagatacagaagttaaactagaaataaaaattctgaagtcaaagacgaggaaaaaaagacatcaccaacaaagtcaaaggggcttaagagttaagtacagtcatgcaccatattaacaacatttcagtcaatgacaaaccacatatatgatgttgatcctgtaagattataataccatatttttaccgtaccttttctatgtttaggtccacaaatacttactattgggttacaattccctatattattcagaagagtcacttgctgtacaggtgtgtagcctaggagcaataggctgtaccgtgtagcctacatgtatagcaggctaaaccatcgaggtttatgcaagtactctctatgatgttcgcaccatgatgaaaccaccaatgcacttctcagaacatactcctgtcattaagtgatggatgactatagttcagaattgtattttaaaagagaaaaggcactggatgttgagttccaagacaggttttaattcctgcctcatcttttattctctatggaaacctgactggtaagaaaaatgggaataggtttgcttacatgcagaggtgctattcaaaaatttgatatgtggtattatggtataagcactgaccaatcaaaacaaatattggctataataatcagtacagacattttggtgcattccaagggaatacttaccgaccttgcctacatctttttccctcctatctttctgctttagaatttaggttccatgagagcaaccactgttaaccattgcgttcggaaaatgtgactgggatttattttcattaggtatggtaagacacataggcccagaaatggctgatatgaaggaacaagtttttactcaccagtccctggaaataggagggacatgcccatgcagatccacatggggaatccgaccatgtttggtcaggaggccgaagaggaagagaagaaaacatggcccagagcctttattggggttttcacaagaaggagtgggtgcagcagggtaggtataatgagcaagctaatgattagacagtttgaataattttgacggactctgggctgttggagtgcttcctagttgttcagtacctggccctggggtcatttagggcagaagaaatattggcttgttgtgtgagagtttgataaaggagatgtttcggggagtgggctctggattggttggtttgtatgttaaagatatgctcacagtggagtcatttgatctctctaggaattagctagccctgggagggtcggtctctccagcagcaaggcctcagcaagagcatcaagaatatagaaaataagaaaatataattaatacacactgcttccagcatgcctggtaagtgtaagtgctcaacaagtaggtattatatagatgaataagtaaatgagagattatttaaatgtgactggagtatagaatagacgaaaatatatatgggactaggactaaaaatgtatgggtattttgggggttttatataaacatatggggtacaagtgcagttttttacctgcatagattgtgtagatgtcaagtcagggcttttagggtatccaccacccaaataatatacattgtaccctttaaataatttctcatcattcaccccctcccactccttcatcctactgaatctctccactctctatttccatgattccactctctatgtccatctatacatattatttagctcccacttatgagtgagaacatgcaatattaatcttttgtgtctgacctgtttcatttaagataatgacctccaattctacccatgtcgctgcaaaagacatgatttcttttcttttctaaataacttccacttccacttttattttagattcaggaagtacatgtgcaggtttgttacatgggtagtgtgacactgaggtttggggtacaaatgatcctgtcactcaggtagtgagcataatactaaatgggtagcatttcatttcaccccttgcctctcttcttccctccccactatagtattccccagtgtctattgttcccatctttatgtccaggtgtatccaatgcttggctcctacttataagtgagaacatgtggtatttggttttctgttcctgcattaattcgcttaggatgatggccaccagctacatccatgttgctgcaaaggacatgattttgttcttttttgtgactgcataagattccaaaaagacaggatttcattctttaaaaatgtacattgaagtcagatgggaaggcttgcattccatgctaagaagctggtcttgtaacaaattttaaagtagttctgaatatccactatgtgcccgtaatgaaatcaggataattatattggccactcaagtaatgactggtaaactagagaggtttttgtttactttttctcagaagtctttttctatattatttcacaccatctgtctcagtgagtttgggctactataacaaataccatagattaggtggctttaacaacaagcatttatttctcacaaatctgcaggctgagaagtctaagattaaggtaccagcctggtaggggctctcttcctggtttgcaggtggccatcttgctgtatcttcatgggaggagagagagagagatcatctttctggtatctctttttataaaggcattcatctcatcatgaggggctccaccctcatgacctcattacctcccaaagaccccacctccaaatgctatcacactggggataagggtttcagcatcagaattttgggtagatataagcattgaattcattgcaccatctgcagacaaaagtggaaattagccttctataaatatcaattcatattctttgtgctctggaatgtcttccctaatcaagttaatctgccttttttatattctgttttggatcatgcttcttagactttaatgtgcgtaagagtcacctggcagatcttgttaaaatgtatattgtgattcagtaggtctggggtggagtggggctgattctgcctttctaatgagctctctggtgattccagtcctgctggtctagggggtgtactttgaatagtaaggtttcagagggtgaacacttttttattaaaaaggcaatacagtacacaaaactggttaagagcaagtctgggtttgaaccctgactgctgcatgtggctgaggacaagttacttaatctctctaagcctctgtttcctgtaaaatgaggataacaaatagtaccaacttcaaatggttgctttaaaaggcttagcacagtgttttatactaacagctaaaagaaaacaccacaatagtgacaagaatggcaagaatagtaaccatggtaatatttaggatagaaggataatcacataaacttggattatatccaatgaatattcctgacagctcagtggtcaggattctaagatggtacctaaccaccctcccaacaaatttatggcagtctgattaagattttttcctcccagtgatggaaacaagagtaggttctgtatagctgggcctttacatacagaacaggctcacaaaataaaatacaaagtaaaacataagcaatctttaagaatattacctagctttcctcaacccagtgaaggagaaaaagggaagataaccagctaagagggaaatgaagggttatggcatctcatcactcctgatagaattcccagtacactgtaaagcgagagggtgtcaaatgttactctagcagctggcaggaccccgtgggatgagtcttgctttgataattctgcaaacatatcacagcatatgcaatagcagcagaagcatgaaccccaactggtcttgtctcaagctgccttggggatatatggtcacagaaatatcagtttaagaattctaaactcttgaaacttctcaagactggctagacatttataagctatgctacccaggcccaagtaacgtaatgatccttttaaaacatactgctaagagctaatgacattcttacatttcaaacatagttttgtgtccattcaaattgctgggaggatcacatgattctcaggcaacatggtgaaactccgtctctataaaaaataacaaaaattagtcaggtgtggtggcacatgcctttagtcccaggctcgtagggaggatgaggtgggaggatcacctgagcccaggtaggttgaggctgctttgggccatgatcacgccactgcactccagcctgggtgacagagcaagaccctgtcaaagaaaagaaaagaatgtagggagggagggagggagggagggaggaaggaaggaaggaaagaaggaaggaaggaaagaaaagtcaaactgctgtattccaacaaaattgtataaaacctgtttcacatttatggtatacaggcttcaactaatgaaggtgatattttgatgactaaaaggagaatgtcttgtttcaaattggcagaggaaatgggagccaaagccctggaaaaagaaatttttctaaaacccctaccagtacaaaatctgaggctactgctataccaaggagaaaatcaatataattcagtagggggaaaagaaattgagaaagtttactaccaaccaattctcattaaagaaaattctgtgtatgcacttcaggcagaaggaaagtaatctcaggtggaaagtctgacatgcaaagaaaattgtagatatgtcatcagagtgaacagacaacttataaaatgggagaaaatttttgcaatctatccatctgacaaaggtctaatatgcagagtctacaaggaacttaaacaaatttacaagaaaaaagcaaacaaccccaatataaagtgagcaaaggacatgaacagacacttctcaaaagaagacatacattcagtcaacaaacatgaaaaaaagctcaatatcactgatcattagagaaatgcaaatcaaaaccataatgagataccatctcatgtcagtcataatggctattattaaaaagtcagaaaacaacagatgctgccaaggagatggagtaaaaggaattctttttttttttttttttttttttgagatggagtcttgctctgttgcccaggctagagtgcagtggcgcgatcttggctcactgcaacctctgcctcccaggttcaagtgattctcctgcctcagcctcctgtgtagctggaattataggcatccaccaccacgccaggctaatttttgtatttttagtagagacaaggttttgccatgttggccaggctgatctcgaactcctgacctcaggtgatccccctgccttggcctcccaaagtgttgggattagaagcatgagcaaccacacctggcagaaaaaggaacacttttacactgttggtggaagtatatattagttcaaccattgtggaagacagtatggcaattcctcaaagacctagaggcagaaataccattcaactcagcaatcccactattggatatatacccaatggaatataaattattctattataaagatacatggacacgtatgttcattgcagcactattcacaatagcaaagacatggaatcagcctaaatccccatcaatgataggctggataaagaaaatgtggtatatatacatcatggaatactatgcagccataaaaaggaacaaaatcatgtccttgaaagggatatggatggagctggaagccattatcctcagcaaactaacacaggaacagaaaactaaatactacatgttctcacttgtaagtgggtgctgaatgacgagaaaacatggacacatgggggagaagaacaacacgcacgggggcctactggagggtaaagggtgggaggagggagagcatcaggaaaaatagctaatgggtgctgggcttaatacgtaggtgatgggatgatctgtacagcaaaccaccatggcacatgtttacctgtgtaacaaacatgaacatcctgcatgtgtatccctgaacttaaaataaaagttggaaattaaaaaagggataaaaaatgctgtaaaaagagaaaaatgtagatatgtgatagactgaaaacaaaacactgattcttataaaataaaaatgaaaaggttttgtggagctaaacaaaaatgataaagttctattacataacaataacataataacatataagacagagcatgtaagccaggagtggtatgattagaattaaaatgttctaagattcaacatagtactggaagtcctagccagagcaatcagacaagagaaataaataaaagacatctaaatagaaaaaagaagtcattggcagataggaggcaggactagatttcagctccaactcggatggacagagcagcatgtgaagctcacattgtgaatttttgctccagaatgactgcaggaatgaatcaggaaacctgagaggaccggcagaccccctgatggaagtggattgcttttgcaggactcaggagacaccccaaatactgtgctggtatccatggctgagagacccacagacagttcacatcacagtactctgtgcagataacccccactaccagcccagagcctggtagacttgctggatggctagatccagaagagagataacaatcactacatctcggctctcaagaagccacatccttaggaaaaaggggagagtactacatcaagggaacaccctgtgggacaaaagaatctgaataacagccttcagccctagaccttccctctgacagagcctacccaaatgagaaggaactagaaaaccaactctggtaatatgacaaaacaaggttctttaacacctccaaaaaatcacactagctcaccagcaatggacccaaactaagaagaaatccctgatttacctgaaaaagaattcaggaggttagttactaagctaatcagggaggcaccagagaaaggcaaagcccaatgtaaggaaatccaaaaaacgatgcaagtgaagggagaaatattcaaggaaatagatagcataaataaaaaaacaatcaaaacttcaggaaacaatggacacacttatagaaatgcaaaatgctctggaaaatctcagcaatagaactgaacaagtgaaagaaggaaattcagagctcaaagacaaggtctttgaattaacccaatccaagaaagacaaagaaaaatgaataagaaaatatgaacaaagcctccaagaagtctgggattatgataaacgaccaaagcaaagaattatcggtgttcctgaggaagaagagaattctaaaagtttggaaaacataattgggagagtaattgaggaaaactttccttgccttgctagatacctagacatccaaatacaagaagtacaaagaacacctgggaaattcatcacaaaaagatcatcgcctagccacattgtcatcagattatctaaagttaagatgaagaaaaaaatcttaagagctgtgagacaaaagcaccaggtaacccataaagaaaaacctatcagattaacagcagatttctcagcagaaaccctgaaagctagaagggcctagggccctatcttcagcctcctcaaacaaaacaacagccaagaattttgtacccggtgaaattaagcttcataagtgaagaaaaggtacagtctttctcaaacaaatgctgaaagaatttgccactaccaggccaccactacaagaactgctaaaaggagctctaaatcttgaaacaaatcctggaaacacatcaaaacagaacttctttaaagcataaatctcataggacctataaaacaaaaacacaatttaaaaaacaaaaacaaaaaaacaaaaaatcaaggtatacaggcaacgaatagcacaatgaatggaatggtacctcacatctcaatactaacattgaatgtaaatggcctaaacgctccacttaaaagatacagaatcgtgaaatggataagaagtcaccaaccatctgctggcttcaagagactcacctaatacataaggactcacacaaacttaaggtaaaggggtataaaaagacatttcaagcaaagggacaatgaaagcaagtaggagtagctgttcttatatcagacacaacaaactttaaagcaatagcagttaaaaaagacaaagagagacattatataataataaaaggccttgtccaagaggaaaatatcacaatcctaaatatatatgaacctaacactggagctgccaaatgaataaaataattactaatagacctaagaaatgagatagacagcaacacaataatagtgggagacttcagtactccactgacagccctagacaggtcatcaagagagaaagtctacaaagaaacaatggatttaaactataccttggaacaaattgacttaatagatatatacagaacattccatccaacaaccgcagaatatacattctattcaatagcgcatggaactttctccaggatacaccatatgataggccacaaaatgagcctcaatagatttaagaaaatcgaaattgtaacaagcactctctcagaccacagtggaataaaactggaaatcaactccaaaaagtaccttcaaaaccatgcaaatacatggaaattaaataacctgctcctgaatgatcattgggtgaaaaatgaaatcaaaatggaaattaaaatgttcttcagactgaacaatagtgacacaacctatcaaaacctctgggacacagcaaaggcagtgctaagaggaaagttcctagccctaaatgcctacatcaaaaagtctgaaagagcacaaacaatctaaggtcgcacctcaaggaactagagaaacaagaaaaaaccaaacccaaacccagcaaaagaaaggaaataaccaagatcaaagcagaactaaatgaaatcgaaaaaaacaaacaaaaatacaaaagacaagtcagcttcttcaagaaaacaccgagtgacgatgatgccagtgcagcacggggacaggtcgggccggaggccccaagggccctgggatggggaaccacagtggcttccggggaggcttcggcagtggcatccagggccagggtcgcagccacggagcttgcggaggcaagttgaggacaaggagttggatgcccatcaccaagctgggccgtctggtcaaggacatgaagatgaaatccctggagatctatctcttctccctgcccatcaaggagtctgagatcattgactttttcctgggggcctctctcaaggatgaggttttaaaggttacgccagtgcagaagcagacccacgctggccagtgcaccaggttcaaggcgtttgttgccttgactacattggggactacaatggccacgtcggtctgggtgttaagtgctccaaggaggtggccactgccatccgtggggccatgatcctggccaagcagtccattgtccctgtgctactgggggacagaggctactgggggaacaagattggaaagccccatgccatcccttgcaaggtgacaggccgctgtggctccgtgctggtgacctcatccctgtgcccaggagcactggcatcatctcggcccctgtgcccaagaagctgctgatgatggctggtattgatgactgctacacctcagccaggggctgcactgccaccctgggcaacttcggcaaggccacctttgatgccatctcagacctacagctacttgacctccgacctctggaaggagactgtattcaccaagtctccc

SEQ ID NO: 36861 - DNA, 501168 bp, Homo sapiens
ggctcgagacggcggcgcgtgcagcagctccagaaagcagcgagttggcagagcagggctgcatttccagcaggagctgcgagcacagtgctggctcacaacaaggtgatgtgccaggaagcggttttgtgcccgctcgggctgctgcggctggggcttgcttccttatacccacctctcctcctctgggtctgcgtgtgtgtgagtgcccggcttttgggggtaaagcctgcggggaggggacacgcttgcctctgcttgtctcctcctccctctaccctcgtcgttgctaatgcatgttttccagggtcgctcctggcttcgtaccccttatttgacactgacatgcccccccaccccccgttgtgtctcctctcccagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgtaagttccgcgcacccacatccccgggcacacgcgcgcgctgctccgaggcgggggccgcggccgccggatgtgggtggggagtgggctccgttttctgaggagaggggtttagggaaacgcggcggcgcagggctgctggagaagttcacagttccgctgccccctcccagctggttcaagggcttgtttcttggatgcacaggagttcaggtctcaccaggttcacactcttcctcccccaccctgctctcccctgtgccccctcccggcccacaaaggttacaaagtgctggctctaacctctcaacttttgaatggtgtttctggcactggtaaacacagcagatgtgcctttgcgatgtatcgctactaaagtaactaggatcgatcctgtcactaatggtccattaaggaatttgagggaggaggtaggaagatgtaagatttataaatgcccgctctccaagggtgggaggatgtttggcggcaccagtaaggactcgttgaacgctcccgcttacataaaattgtcgatcagatttgtgcttcgacatgactttaatctagaacatctttgcaatgcatttgattatattttattccaaaatgaatcactgccttgaactctgcgggaagaggttgcgagggcgggaggattgcaggtgacagcgataaaagagttaaaccatagactcccctggggagttttcaaaagggttattaagagggagccaggtttccacacttgaagctagtggccatggcttgccagtcatttttattttcctcacctgatctgaatggagcccagtaagagctgctcacgtacagagcacgatacaactggaagccttgaatttggttgtcccagtgaggaggccgccctgttggctgaataccgcccctagcccaccctttaaaacgcggaaggcctgaactggagcgagagtggttcctagacacattgccaatccttaccgtgacatttgagagaatttctcgtggagtccatctgcagtgcactacgtggagatgagttaacttctttcatcagctccgactcagtcaccatttaggaaaataaaagggagcctaggctagctttcatcctgcctcctctaacccattctctcagcctctccatgaagtagctgacaagccaaatctagcagagggattcctgaagaaacacaaatttttactttaaaattaggtttagccatttgattgagaatatttaatggagaaccttgcctacatacttcatgaacaaagcttaagcatcattttattgctaaataaatgcccttataaaagcatacccgttgcatatttgttttaagtttacaccaatattgagtacaagcaaaaaggatagcgagtgagatattcctaaacctaaagaaaatttgtttatcatgccctcatttggcaaaatcaaaaacaaaaacgaaaattgaacacttcatcagtatttgaacagtgtttgacattatgacatttcattatttaatggctgctttaaaatcttctagaaatgaatttttgaaagacctcccaacaatgggatatatttagtaggtaatactggttgcatgctgttttctatttgttttgggttttttttttttttaataaaatcaactacacaagattcctcgctgggagaattgtaagagtattactatcttcaatgagagcagagataaaagctttcttctctaaaatgtattttaaattttgaataacttagtattctcttattttattcaaattactttattaaattattgagggacttggacagtttgtgaatgtgtttgacttaaactattgagacaagctgagttgcctactatagagctaaatatgctagaatttatggagtcaatttctatagagatggagattttattgctatatcattctcagttattctaggatctcaaggaaaaagtccatcaaaattgtacataaattttaaaaaggatttactgatacattttatgcaaatatctgttttgaagtatatgcaacacctaaaaataaatattgatttatttgaaaaactttcatcaggttttagtattaccattttagtaagacagttatgtttttgcaaagatgacttctggagggaatggagcggataaatgccatcattttttacccttgaaccacctgttgcttattattaacatgatgaaaggtatgctgacagtgtggtttctcaaataataattcagaatgcataatatataatccttatctagaccatccaccccactgctatttatgtatattctttcccttttggggaatcattagcttaataatcttttctgtagctctcaggatgttatttttcagttggttttcagctggaagcacatggcgataaggcattacttgaaataatactatactgcatgaatctacctttaaatgttctgcatgagcattcatatctcaaataatgatttatgtactcactttatatgagggcaaagaaacatggaattctgaacctcttatttgagaaacaatttaactgaagtacttttgtgcttttttcccataaaatataattaattttatttatacaaaagccttggaaagcatcagcataattattgcttggattaatccttatgattattttttcttccgaagtgactgttttacataatcagcactgtttaacaagtgactccttaatgaaagtttgaactgttctttcttttgaaatacattttaaaagtatcttaaataatatttaaaaatacaatttagcattatattttaattgaataattttaaaaataaatgttactctttatatatttgtaatatacgtatgtaaatataattgatttacaataaagctttaggaacaaagagcatggatagagttacgagagagtaggtgagcataaaaactactgccgttgaggctcattttcttgatttcctcaatataaatgctaaagaagcaatgaaagcaaagacaagcttacagtgaataggtattaacacaggagaaacaagcttgcaatgagtaggtgttaacacaggagaaacctcaagtatttttgactgctctatgctagcaatgtctgttgaataaagtttgttacctttgttgtccttttgaaggacgcttggagtgtacgatgcttaatgttatagacataaagagctttcactgttttgaaaattattaatttatttggttattagtataaaaattctgataaggattttaatatctatgtcttaggaaagcatacaagtttcacttaatctaaagatacagaaaagtcaacacatttaaacataagtacagtagatagaaccagcatgctttacttaggttataattatgtgattttgaaataaaataaaataagaactccctcaacagtggtatatattcagtagatatactggttacatgctggttttttttttttttttttttggtggggggctctgttgactagtgataaaattaagtacacaagattcctcagtgggaaaattgtggggtaccattactttctcccagagcaggagtaaaggattcattcatcccattcttgtgaatatattaggagaattggaaatcagcatcgttatgaggaaactgaattattagctcgagtggcttatgtattgcatatttcaaatatttatattttatagtttaattaaaccataccctttatcatgtaataaatgagtatggaatttggaaccaatgaattacttagtaatgcatggtataataacattatcaaaattatctattattgatttcactgaaatacataaattaattaggaatgacaaaaaaagataaaatatgagaagccctcaaatattgtattttggaatcaatataataaaaacttagaaaaaagaggaatgatggccatgctaatttttaagtaactcatataataaaaacaggattgtaccctttaatggaaattcaaatagttctagattaaattaaatttgtttttcaataaaaatacctggggctcattctgaactttttgttttaaggaatggtgaccactagtgttatagaaaccataatcaacttcagtttacatttattccttaagtgatgtttaatatcctttgggtatatttaacgtaataataaagttctacagtttaactttacagatttaaccttaatgtaagctaaagaacatgtagaatattgagaaaatgtaaaatacaggctgacatgtctcagaggcactcaaattataagttgacttttaaaaaatatctgatttgtgggtgttgaatagtaagcagaacattcttaatttgttttttctttttatttgcctttttcatctaaggtgaggttcttaagtgcacagattatttaagagataatggatgatggtgtgggatatttcctggaacttagtgggctacagaggggtaaagattctcgagggtctatcaacttctactgttgttagaaagtaaatacaacaatttgtttctatgtctactccaaataaagtattctatggctctacaggccattaaaattcaaacaatgagaatctttaaggaatgctctctcagtactttgtttaggtttatgatgtgccttgattatatttcttgagttacaggcatactcttagcattgagggatcctcctttctggcaacaaagttgtgctattatacttttcaacaatatgtatcaaaaataaaattaaagatttatttgtaatttggatatatttaataaagtgaactactgttctctctgtttaagaatgctttctcaataatggatatccaattcttatgaaaatgtacattttcagtgtttctcactatgaaacaacatttgtaactgtggtaataattacctatatttcactgtagttgagaacataggcatttcttgggaattcttcacagttaattgagtgcattatcatgagtgtttttctctctttcttttgcttttttggtgattacaggcactgggtttagttcttaaaagcttgtgaatatagtgtatatatttgcagatcagagctggtgaagactgtagcatgcagtaatatttttattggactattattcatattgtttaaatcatggggagatttaatggagagaggcaactgacctcttaagagaagcaataggcaatctttgatgattctgggaccagtgagtaaccacagcagcaaagggctaggctctggcagcatcctgactcttgtttttgtcatcaggatcctagttaagccgtgatcacagcacaaactccacactcctattttttaaacctgctactacaaccactatcctgcttgccagtcaggatttaagtttggttttgtcatcaggttatcacatgacgaaggaaggcaggtcagagaatgtccactgatctgcttgtttctgaagggaatcttagctagagctggtatcacattatcagactctgtcaggaggtatgaattgatcacaaaactttactcgattttctatgtgtttatcctaacagaaattaaagagaagcaagcaatacttttaaccctctagctttcataacttccagtcaatgactagaaaagtgtaactaagtgtaaaagtgtaagtaagagaaacaaattactctatgtatgttgtatatgtttatatgtatttatgtgcgtagattcttgcataaatgtatatctacatatatgtgttatgtgtgtatgtcaagttgacaacagattaatctgaaaacagaggcaattatatattgtgctataggttttttgtatgcaccagatatgtgtatagttattacacataacatgttgagtagaaagccaacatccatctagccacccccaaaatgttaagacatgttaggtttctttatttatttcttttcttttcctggttaggttttctgcatcttataacttgagatgatttcatttactgttacatgtgtggacacagtgtgcttttctgtttcttacagctagtcagcttgcttgggattatatatttaaactttttatctagatatacaaaaggaacatcgtgtaccactatagagcatttatgttgctactctgacagtaagactttggggttggatgcttttagatcttatgattgtgactcagagtgacattttatgttctcacacaactttagttttcatgatctgggtcataattttatttcattttatgtacttatttttaaaggctgatctttgacttctgtaaatactatccaagtcctgtaagctcctggagtatttatatgtcttttttcatttatgaaaatcatttcatcttttctattctttctacctcttctagtttacagatttggacaccccattagactgtgaactccctacagctacagattgtagtctcccttcctctccatgatcctacaactcacctagcattaccacaataattgtctcagagttatcactagaaaatacttactaaatgaggtgacattatattcaaaatacattgccaattgaaaaatccttacctaaaggttttttagagctgtgttgtcttttattggccagttcaatttctggccacctcaagcccagttttgtaatttaaataaaaattcaatttttataaaatataaagttataagtattgaaccactttagtcctataagttccaaaacttgccaaaatagaaatgccgtgtctaagctgtcgtgtccagttttagaatggtcaacagcagatgacaatgacatgcatcatggtgctcccttggccaattagttcaattcttttttccacagttcctcttcaacaacataattgtgttgctctaacatctttaaatatttttgctgcctaataggtaatatcaagcactagcatcttccctttcttcttcaactactgaacttcaattaatggttatataggtaaatccagatactttactgacagttcagatttatttctttctcttccacctcacttacaactgccaatgcgttggttagagagaggttaagttcctgcagaaaggagaccctgaatcagagtacccgagtaacgatagaattctcttttgcaagcatgagaccatcaagaaacgggtgtccaggcctgggctttcagggttactccctcaagcaagcttctctattaatggccatttcctatctaacaggaggcgtttaagagaaaatctaggacaatcaccttgtcctagaattcacctgaaagtcatcacacattacttctacttgtatcccacaggcctgaacttggttacatgtcaacacccagctacaagggatactgggaaatttaatctttaatgggaatgatcagcactaaaagaaagcaagcgatactcaatactcggagaaaatgttggtaactacggtatctggttatgctctttcaatcatctaaatatctattgaaaatattctcagtctccatccccgtgtcctctgatgggaatgttttttatcattgcctgtcagttgtttgcctccctaatcaatctttcttccaaattccatattatcccagtatcctcttagccatgatggacatgcttgagtagtgcttgctgggccaaaactatgacacctagtacctactgttctagatgtaggagtttggtagtaagtagtagagtgctaatttctaaaaggaaattttgaaggtcaaaaccaaagcagagtgtccaaaaagctaccatgttaaggagagactgaatctacttaccaatgctgttttcctttagtgaaatcatttagcatgacttctgtgaaatctttttgagctgtagagctttggtcataggaatggaattccttgtgttaaggcattaatggtgattggtgggcaagaatcagaatttacttctcacatctcttagttaaagaacaggatattttcttgctgttactggtgtatttcctccgatgcagaaaaaggaaagtaccactaacaacattttgctgaaataatactagaagtgacacccttgccaggttcatgcagctcttaggcttgaaagcaaagaaaacaatctttttggttctagtatctctgggacagttaggaaataaaaactgcagcaaatcagatttgccagaattcccatacaggctttactctttagatttttttttttcttaacatgcgagattactggcaattagaatgcctgaacttcttaactgaatcataaacagagatggtgagttgcactgtctatcaggttttgttttttggagagatccttgagtttttccatcttcatacttgctacagaaaaacgttcctatttatttatcatttttcatatatattcatggcatgattatattacaagggatgattatataattttgcttaatatgttacacataattaatttaataatagtaataatatagtatacaaatatgtaaggtaaaagggtaggtaaaaagtcttcataaagttatttttcccttgcagtcatgtcatttctcccaaaggattgatgctttccctaatattcttccaccagaagtcatctggccttcgattttctgctcacaagctgtttcctttatcgaggaaataatggtctgaatcagaaatgttgtctcccacctccaaatatatattgcagatttttctatttgtaaattaagaataatggcctaataaaaatttttattccctccttcagaaatagcactattatatttcattagttcatttattggttttaaaagcatcatgttgaataaataataataatcttaatctgtgtgaggtagattcttcctgtttttatatgtggcttgtatattttggaaacttttaagccatattatcactcttgttgtaaaacagagataattaaattcagtattctgttttcataactgtttgattagaatagttattgattatttaaattatgctatttcagtatagaaaagaaagttttggatgggtgtggtggctcatgcctgtaatcccagcactttgggaggccaaggtgggcagatcttgaggtcagcagatcgagaccatcctggccaacatggtgaaatcccatctctcctaaatacacaaaaattagctgagtgtggtggcacgtgcctgtaatcccagctactcgctactcgggaggctgaggcaagagaatcgcttgaaccagggagtcagaggttgcagtgagctgagatcatgtgcctgcactccagcctggcaatagagcaagactcagtcttaaaaaaaaacaacaaagtttaagtacttttttattgcatttatctgtattatatatcttttttgttaagtttgaacatttggtagcttggtttactgttgattaggaaattaattaggaaaaaacttacatttggtatacatggctattttaaacaatcaaataacgagtggcatatacaaaaattgcttctttttccacagcattctcttaagcttttttatgtggatttagaatgaactatatgttaatgtttctattttcagattgttatagcatttcatcagtaaaatatcccacatctttatctacatttttgaatatgcaaggacaaataaactctattttaacttttccatactattttttcatggattcctctttttgtcctattttattctctgaaaattccagctaactatggtaattaagtttaaacacaatgtctttaatagtgcactaaacatgtatatagtaagcaagatgacaaagataataaaaatgaaaaaatatgtgttagaaaactatgatgtcagaatttataaatacaactttattagatatttgatggaaataattttaaaatcttttaatttaattaatggctgttttctaaccaaattacttttaaaaataagttaaatccacaaatagtctgtattttatatatgaatagggtactcaaaatttgactcactatggctgtagagaatgatgatggtaaaaatgcactcacccaaaatatcaaatgaggtaagtactaaaaattttataataaaaatacgacagactcttccttgtctagaaattgataataatataataataacaagcactttaatacagcatatcacatgcaaggagtattataagttcacttttaatttaattttttaggaataaggactggctatattgcccaagctggtctcgaactcctaggctcaagtgatcttcctaccttggcctcctcaagtgctgggattacaggcatgattcactgtgcctgactagtttttaaaaatgtattaattagtaatatccccatatggaatgtgcaactgttaatccattgtgcagctgaggaaactcagggccaagatcacacagctagtatcagtcagggctctctccagtagtagaattttggctctaaagactttgtccttaaacacagaagagtaatgcttcttcatctgttaatgctgttttgggtctgtgttatatgctaggcactttaaatatattatcccactttaatatatatctctctctatatataatataatatctccctctataaatatatatttatatataaacataatatacataaacatatataaatatatatgcttatatatgattattcatatttataaatgaatatataaatacatatttataaatgaatatatacatatatttataaatgaatataaaatatattatatattatatattcacatataaaatatacattattcatatataaaatatatattatatattcatatataaaatatatattcatatataaaatatatattcatatataaaatatatattatatattcatatataaaatatatattcatatataaaatatatattcatatataaaatatatattcatatataaaatataatatattatatattcatatataaaatatatattcatatataaaatataatatatattcatataaaatatgtataatatatattatatgtttacatatttatatattcatatataaacatatctatgtttatatatttatatattcatatatcaatatatatctatgtttatatatttatatattcacatatcaatatatatctatgtttatatatttatatattcatatatcaatatatatctatgtttatatatttatatattcatatatcaatatatatctatgtttatatatttatatattcatatatcaatatatatctatgtttatatgtttatatattcatatataaatatatatctatgtttatatatttatatatgaatatataatatatatctatgtttatatataaatatataacatatgtgtatatattatatattcatatatgaatctataacatgtatatatattatatattcatatatgaatctataacatacatgttatatattatatattcatatattcatatgtaatatatatgtttatatataaatctatataatttttaattgtaaaaagcacgacataaaatttactatattagccatttttaagtgtataattcagtagtgtcaagtatattcacattgttttgcaaccagtctccagaactttttcattgcagaactgaaactttatactcatttaaccacatcccattttgcccttcctgcagcccctggtaacaaccattctactttttgtttctacgaatttgactactttagatatataggtggaacaacagtatttgtctatttgtgactggcttttgttagcataacatcctcaagtttcatccatgttgtggcatgtgacagggtttcctttttcttaaaagactgaataatattccattgtatgtatattttacatttgtccacttatctgtcaataaaaaaccttgggttacttctacctctttgctattgtaaataatgctgctatgaacataggtatgcaaatatttcttcaagatcctgctttcagttatttggatatatactcagaagtggaattgctgggtcatctgataattttgtttttaatttttttaggaactgccatactgttttccgtggtggttacgctgttttacagtcctactcacaatggataagggttccaatttttttgcacccttgctaacacttgttaatttacattttgttgttgttgttgttagtagccatctgaatggatgtgagttgatattgtggttttgatttgcattgccctaatgattagaaatgttgagcatattttcatataattgttagccacttgtacagcatttctgaagaaatgtctgctcaagtcctttacccatttttaattgggttacatgttttcctttttggtaaaatcttttaacaatcataaaagtagagattattaatcttctttcacaaataaagtgactcagtatcagcaagcttaatcaacctgctcaaaatcagtgaagtttgaaacgactttctaactctaaagaccatgtttttttaaaattaacagttgaccactttaaaacagttactacagacagctcaaattgctttttttgttgtattatattatattatttattttttaagagacagcaatttgctctgttgcccaggcttcagtgcagtggtgtcatcatagctcactgcagcgggaaactcctgggctcaagtgatcctcccactttcgcttctcaagtagctgggactacaggcatgtaccaccatgtgtggctaatttttttttttttaattttttgtagagactggggtttcactttgttgcctaggctggtctcaaactcttaggctcaagccatcctcccgcctcagcctcccagagtgttggcgttacaggtgtgtcacattgtgcctggcttggttttctatcttttgacataaagttggtccttttaaacggtcacattgactgtctattttcttacctgctagaccaaggaattgattaaggtttgcaatttgtattagaatttattgtcctttatacagaatcaccatgatcttgctataatttgatcagtatatcttgaagctgcagtaggaaacttctagttgcctgtccttcattagtcttacaaatgtcagtagtttcaaatcacatactgttcaaatagtaatgtttatccctacagaggtactatatttggcaacagcatattactggcatttttattactgaccttttttgatatcaaagtgcaggtctgaatatcttatgtggtcagaaatagctgttaaaagaaatactaggctgggtgggatggctcacgcctgttaattccagaacttccagaggccaaggtgggaggatgacttgtggccaggagtttgagaccagcctgagcaaaaaagccagacctcatctcagcaaaaatgaaaaaaaaaaaaaaattagctgtgtgtggtggcacatgcctattgtcccagctattcaagaggctgaggtgggaggattgcttgatccaggaggtagaggctgcagtgagccgtgatcacaccactgcactgcagcctggatggcacagtgagatcctgtctcaaaaaaaaaaaaaaaaaagttcttacagtatctgttgtttggattagaagtttaacatcttcagaagctgttttttaagtgttactgtgcctaatttttaatttctacagttgtgccaccaccccctccttttcttggctgaagagaatttgacttcttcctattatcaaattatgtaaaatggaaaaaggaattattttctttaattaaattctaggattcacaacttactatcatacgtaatcaacatacatatcatttgtaatacaacataaatgtaaccattgttgactgggttctgagaaaaccaagcaatctctgtcctagtagaaaacatagttttctgttttccatgttgaatatcaaagagagatgtaatgttattgacttaaaaaaatgaaatcctatcatatataagataggttggaatatatgtaagtttttaagaatattttgttgtctacatatattttgaagtcctctacgtctagaatttcatttaagatattatgaacaataacactgaacatgggttctgttttggagattttagcaaaaaagcaaaattaatttgctgctacactgaagaaaatataaatttgagtaaattaaaattcaatgatttctgtaatttatttttaaattacagagaacttaatgccaaattttatactaagtatgtgaaataaatggttatatggaatattctgtaacgaaaattaaaataaatctttcagtcaacttgaaatctttatgttgagtgttctagataattttgtgagttctttattcttagcataagtaaaagctcatttaacaggaatgagaaaggaaccaaaaatgccaaaactcaatctaattaattgtcttctgatatgtaaaacattgcaagacattgtgcgcctgaatactggtaaaacattagatatacctcctaaaaatagtaatttgatagtccgttaatcacagctcacttttgcttttctattaccaaactactttgtgactttcaaaatatttacatagggtacaataggcaagatactctgaaatacgagcttgctaattgccttggcacatggtattagcatctgctgagaatcggttttagaatatcaagacaatatttatagcctttcatggcatacagtatagtgtgaaattatagacaacctcctagtcttccagtaaggctgcctgaggtgcccttggcaacatctgatattctcctcggatgtccctgaggcagtcagattcatctaaaatgaacaatccctgaggcaaaacttttctagaacattgtatcaacagcattaacctagtattacctgagacatttttccttgacataaaatatatttttttggagttgagatgttatacactttatagttttaagaactattgtacttactgaaactgtgaattaaaggcacactccacactgataactagggaagtgctagtttggaagctgtgaaatttgaaagtaactctaggcaaaggagcattcgtacatagaccacacacttagtacattatccttggaatttctttttgattaaatatgctaactttctttgctaatgttattgtcatttaaaattgtttatttcagaatttaaagtttttttgtctttcgtttacatatttttctagataaaaattttttaaaatgggaaggtggtctatggggaatgacatgtttaattcagataacaaattagtggtcaagataggaaaaaatatcccacatttgtttttagggactaaaatatattaaaaactttttaaatgtataccatgaaccaagttttgaataagtttgagaagcataggcagtttttaggtcagtgaatgagatctggacatctaatttcagaactgctttgtttgctttgagtcactgaaagctacctggctttgctacaagaagtcttatgtttattcttgggaggagtgcctctttattgaatatgctgtttgctctaatgtgtaggttctagaggatctttggcatcagcctcaaaggtgacaaaagcacccctggtgctagttgctactcttgaactaggatcagaagtcaagtaaaacgtcaaaacatcatctgaggccaagttaatgtttactggggatctcagacacttactttgctattaacacacgattattttttagctaagggcagttccctgacttctaattgttcagcctgtgtgcccctgaatagcttttaagtgctattcagaaatgtgccatgttagaaacataagaaagcttgttcttgtagcagtagttcttgtaagtggtaggtagttgcgtgatttaggaattgtaattaaaaaaagtttgttcttagttattggactttcataacttaattttcacctttttatttttggactatactgtgatgtttctgatttgtgtttgttgtttgctaaaaccctttggtttgtgggtttaactttttttttttactttaatgaaactgtatatttaaataacttcctcctagatggcctaataaaaaatccatagtaatttttatagcaatgttgcaatatttatatcatgtatagccatttagtatgtgaaaatatgtatttcagattgagttttaagttgggcacatgttatattatccaccaccaagtttctttcttaaataaatattggctaactcacctaataatcaaaataagctgtgtaaaggacatattaatagaattttgtatgttatacgaatttgcagtagcatattttttaggtttttgaaatattttcatatacagtcttctctcagtatccatggggaattggttccaggacacccccaccaggagagataccaaaatccatggatcctcaagtcccttatataacacaatgtagtatttgcatgtaacctacactcattctccaatacactttaaattacctctagagtacttataataccttatacaatataaatgctatgtaaatagttgctttactgtattttttaggaaaaaataccaagaaacaacaaaaaaaaacatctgtacatgttcagtagagaggcaaccatccattctttttttcctcggtattttcagcctgtggttggttgaatgcatggacgtgaaattcatggatacagagggtcaactgtattacaatttttaactgaaataaccttgtaaataaaattgtccaacttgttaaggatattcaaattattatttaacaaacttttgtttaattctttttaaagtttacattcattaataaaaggcaaataaagtagccacataaattttttttcaccgtgtttaacaaattgttttttgttctttaacaaagccattggataaggcaatttgtacatgtgtttagtttggcaatgtagtttatctctagtctctgatcttatttatatttattttaggatttctctgtactattgtcattcagttatgagtgtttacttttgcaacataataaagtgtttctacatgtattaaactgatgcttttccaaagctaatcttctgggccaaaaatccttaattattttggggcgcagaaactcagaatttgaggatatctatggttactttttcagaaaatacttagatatacaaaaaattgtgtataatattcagagaattcacagttctcagctgtgattatttaaaacgtaggtaaaagtgagctgtgcaatgccatcatttctacagaacacaactcttaaagctgtgcaaaaaaaatttaaatgaccttgcaattacaggaagtttattattgatgatatcttggactcttgtcttcctcctcagcgttcccaatcaaatcgcttgcatatcctgtcagggtcttctctgcagtatttttcaaatccaagactgttcacccttctttgggccagatcctcattatccatcccttaggctagtcttgtagataaccttcatgttttcaggcttctccctgcctgcaagcaccaataatacttttttgatcaattattttttttcccaaatcatagttctgatcttgttcttctgtttaaaatcttctattcatcttttaatgtattacagaacaggattgtatatagctgcaactgtaagttgccttccaaaaatctgtaaacggtatttttttcggtgggataaaccgcaaactccacataatggatcagttcatatatatgtatagtcacgttagagggagatcatgtgattcctaagtctactggagactcttcaaatattgtaacatatacttggagggtggctgttcatcagaagaagtctgaagtgagacacagaaaaatcatttacccaggcaacatttgccagtactaaggaaagacagtggtcatttctaacattactctaatgctctacaacatgtacaggtcaaaaattttcctttcttcaattccatgctcacccagcaaatttctgattttaatgcagctcagcctcagggagcaaatgtaccagtcttcctgaaacatgttttctgctgacagaacaaggtttctgaggctttagggctgaaggccaaatcatggatggtgggaaattcatcaaggtaatactgcagtgtgagctctttcacaggcagccaggatgttcctgatgatagacaggtcttaccagaagctttctattcaaacatcaacaccaaacaacatccacatttcctattcccaaatccaaaatctcttcactacctgcctccaaaccatatttgctttcggatccttgtttcctctttcatgcattcttcacacaaatcaggtatcacctatcttcacgccacattcactgctctttctttttttgtgtcttcctcacagtgagtttttcatctagaaaaggcggcctttgtcctgttacgtatctcattctcatttttcatgacttatttttatgttttcctttttccatgacctcttccatgattactatagtcacatgcaacctgtctttttcatgagtccctgaagcactttttgaaaggcggtgtcagcagtggaaagagccgtgtttcttaagagttctgtaccttgcactccaggagtgcagaaggaatagtcataaaacattcaaatatgggtaagtgaagcaaactgaaacctattctttgcagatcaagtataggagttagtagttagtataaataccccaacccaggttaatattattagttgataatacaacattttatcttatttcttctgtagaaattttctattgatcctggtagttacggagcacatattcatttttaatttctagacagtctttcctaaattttgatttttgcatttaaactctcatttactttacaagaacactgtaactttttactatcatgtttgaactacagtaaatatatatatagtaaatatatatacagtaaatatatatatgtatattatcgagggtttgccatggcatatgcaacatgtttttgctcttccaagcagccaactcctgatctatgaaaatgtcaacagtaggctgctgggtttctgctgtaagtcatcacataaattaggtgccccaaggtaagctttcaaacctagagaaagggttctcactgcatcttgtctgaactcaaactttctaaaaatgagaaacattttaggtaagaagaaacactggtgaaatgctattaagactcaaatgattcattctaagattcaccctaagattcattctctgtgtgtaaaattacagaaaagtgaaatttatagactttatttttcctggaaaagcatctattttaagataacttttaaacctgattttataataaaaatggtaagaacaatcacttgggaaaaaccaaatgattgttattgagaagacaaataatctaatgtatattaagtaatgtgaagttgtagtcatgaattttaaaaatgacagtgtttttagtaccccaaacaaaattgaaatcataatttctcgctaaactgtttttttctatttgctgataatgttatagtgttatgcattcaactctggagaatctaaaatactaatgagagacaagtggggtttataatctatgctatatagttacttaaaaaagataacgacaaatatttttataggtattttattctttaaactacataaaaacagtagtaacaacaaatacaattctgaaaccattacaactgctacctattgggtggtttcatgatggtatgctttgctatattcttaaaaccttttctaaatttacatcttggaagacatcctcaaccaatataataaaggttgcatctttgcatctacactcataaaatcaaaagcagaaatgaggcctttgagaacgtaatttggtatcaaatcatgtactccaattgcttgaatattaccatagcattttatagtacaggattatagtgtttcaattttcatcataataaaaaagacaaatatttaaatcaagcagtcttgtgacagtacaatagattaagtcatctgtgtgatgaaatgccaccttgacgtttacaattttttatggtgactgcttattggtattgtgatctgatatgttatatattttgtgctcttttgtaaaatttctaaagattcaagattcaccatatgtcatcttttaggatttcatcatcaaacactggtaatgcaaggtagttgaatgtatttatattgaagccttgatgttttgacttataattggtgttgaaattgatcatggaggaaaaagagatttctatttcctccattatatttaaatgaatatttctggtaatagtgtttatgtttcaaactctagctccattttatccataaagtagcagatgatattggcaaaaagacaaaatgaaagaccaccaaaataaaagaaaattttcttgttaaatattaaagttttctcacttatggggagagttaattttataatatcacataaccttttttataatgttatcattaatgcaatttgtgacatgaaaaaagcaagaatatttaatatcatcaaatagcagaaaagatttaaaaatagttacaattttgaataaactgtgacctatctctgtggcattctggctccacgtaacacagaattgcatctgtttttgcacaaacacaggaagaaattgcacatgtaaacagttttattccatggacaaaaataaaacattaagttgattttccctagcaaggaactgaggcctagaaaagcaactttgccatttactttgccatcaattagcataggctgacaccaggccatctatgctaaacttaaacgattcaatcacatgctgccagtggcagtattaacatttctgtaaataaacgtctggaaaatgcttagatgtagattgtgctccagcatcttcactacagacggggtagtggccaaaccaaatgttctaaggtaattcttaaaggcacgtggacaaatgctctatgtttcatttgttttgtattttgtcatgtagcttgaaaaatattcaaaaatcactctaattttctaaaataccttgaccacactgtttctaataccctagagtataattttctagtgacattatgtaagcaaattggaaaaatgtactttatcaattttgaaatgactctaaatgtattttgaattgaatgtgatttctgttctctattatgatgtagtgggtggagaaatgtgtcccttggctgttggttctctgaattacattaaagtttactgagacagatacaacttgtgctattatcaaagcaataggaatagaaaaatatggtttaggttaaaatcatcaaaattttcttgagtccagatttctgtctatattcagaggtataagaataaatctttggctgggcgccgtggctcccgcctgtaatcccagcactttgggaggccgaggcgggtggatcatgaggtcaggagttcaagaccagtcctggccaacatgatgaaaccccggctctacaaaaaatacaaaaagtagccaggcatggtgctgggcgcctgtaatcccaggtactcaggagactgagacaggaaattctcttgcaactggaaggcggaggttgctgtgagccgagatcacaccattgtactccagcctgggcaacaagagtgaaagaaactctgtttcaaaaaaaaaaaagtaaatcttttttaaaaagtcaaataaacaaaacaaaactgtactgaaaaatctaaaatgaacacaacacagagtgtagtgccttggagtaaaggcatatattagaactggttttgtcatttattatgtgtttgtttatattaataacaaccctgtattgtaggtattattgtcattattttccagaaagccagaataagcagacaaacagataatagtggtcagagatttgcctaatgatgctggagtcagtatgtttacactgtccattgtatagcaatttgaacaatttggtaaatagtaatgcaaataggtcttgaagtttctgttttatatctgcatagctcagcaaaggaaaattgcttcactaaaacaattgattaaaagtatgcttttgtctgttgttaaaatgaaaagtaccatatttactatgttccaatatgtacatgtattagtcctttttcatgctgctgataaatacatacccgagactgggcaattaacaaaagaaagaggtttaatgaacttagagttccatgtggctgagagacctcacaatcatggcagaaggtgaaaggcatgtctcacatggtggcagacaagagaagagagtttgtgcatggaaacttccctttttaaaaccatcagatctcatgaaacttatacactatcacgagaacagcataggaaagacctgcccccatgattcaattacctcatagagggtccctcccacatcacatgggaattcaagatgagatttaggtggggacacagccaaaccatgtcattccgcccctggccccttccaaatctcttgtccttacgtttcaaaaccaatcgtgccttccctgcagtcccccagagtgttaactcatatcagcattaactcaaaactctaccgtccaaagtctcatctaagacaagcaagttcccttcctcctatgagcctgtaaaatcaaatgcaagttagttacttcctagatacaacaggggtacagggattgggtaaatacacgcattccaaatgggagaaattggccaaaacaaaggggctacaggccgcacgcaagtccgaaatccaaggggcagtcaaatcttaaagctccaaaatgatctcctttaaccctatgtctcacatccaggtcatgctgatgcaactatgtatattaagtacataacatatgttaatcattttttctgtcattatcaattacataatttataacttaagttgaactttaaaaaatcgttcattgtttagcaattaaaccacatttagattaagcatgttttccaaaatatgcaggatctatcattttccagtaaatcagaagtgtctatgcaataactgaaatatgtgatcagatattaaattaaaaatgtgtttgcatatatatagagagagatacacagagagagagagccttctgcacttacctattttgctctcgagctagtcatatatttgtatgactcagcctttaaaaatgagaatgatatttgttttttcaggaaatgagaggattattatgaatatcaggcaatcaaatgtatgagaaaacactttagaaaataaattgctaaaatatatcatttcaaaaacaaacattcttcatctatataaagttaaagtccttctttgctaaatacacacatttatcttttaatatttatagaatttatattaaataatcattgagattgaaagcatgtcagtaaagaggaaaagacctctttgtttttaaataatcatgtgtgccacttttagcccactacccaagacgtaccatctcctccctgaagaatccttgtgatagttgaaaagattgacatgttgaataatgattcaatgcactgtgacaatggaagtcagataagtacatgcaaattacatctgtagtgggaggtgattcaatgaaggcctcacagagtccatgacactcaatctgtgttttgatgaatgagcagagtttgttctttgaacaggtggaagaaagcatacctgacagggatctacacatgcaaagttatagaggtataaaagtacgtggcatgttccataggtataagaaattaaatgtgcgtaaacaaattgtgaatgatagagagtcaagacagaggagactgaaaattgttaggactaggatctgaagttatttccaaaacctgctaagctgatgattttcataaacaaaggagtgctcctacaattgcctccttgacagattttgatggatatccacaaagtcagaggaagacttttgcagttgttgctacctgaacaacttgtgatgtcccccttcactgccctatatttgattcaaaatagaaagcagagtgagaaattagtataaggaattcccattaagttctgctttttttcccatgatgtctactttgcattattttagaaaaactataaatacaaaattcactaaggtttaaaaattttttttgtatattgtaactgtctgagtgtccccagttgtctgagtgtccccaatttgctagtgttctaagcacatgctcctgcattctcaggtaatgcagtacacaattattgatcttctatgtaatggctggtgcatccatccacattttataatctggctatttaagtgagaaaatgagaactgaggaaaatgtgtattctagatagggcaacaggagctctttaaggaaagtggggattttttgaacataggacgtacaaagacatgaaagattttcttctagcctccaaacacagaaaacatgattcatttccataccatatcagattgaaaaattcttcagtgttagcattgtgaaatatctttgaaatatcatttttatttaaaatttataggccttttgcattttgttccattctagtactagtgaaaaattctactcatccatcaaaacctagtttaagaatcaaaaaacatatttgcttcaatttaaaaataatattttcaaatattacttagaaaactgatatattgggagttcaggagaaaccactacatttccagtaacatggaacattccatatcatggcacccaatacaggaaccccagtccgagaagcacaatgttaacaaaagccattttacctttctcttggcttattgaaactaaattgcagatgcccttctgtctttagtggtgactctagtagttgtgattgttgtacagcaaacaagacaataattgaattataatatattcatccacttcatttgtagattaaaatgacaaaaaagatatttcactattagtgatctatgtgcaaatacaaataaatagttaactagcatatgtaatttttgaaaagagtgattgcaaacaaatataactctaagctgttaacaggattttaatgttttccttatcaagatattgttttaagattctcattagttgtaacttttataggaaagtttccttgctaaatattaacaaaataatcactattccttttcacagataaaatcatgctaaatttacagaaatattttctcatatttttagcagatctacatgtataaacaaaaatctaaatcaaatgtcattcagcttactatcatcaggtggtaaatatgttatcaaaaatgtgcttagttcaacaaggagtaatggaatagaaatgaaaaaaaataaagaccagttaaatttggaatattagaatgagaattgaagatgtttgcccaagataacatagctagtaagtcttagatttggcctgtttgactctgaagccaaagatcttagtcagtgttctctactgatttcctaaattacaaagaattttcctaaaagtaagcgacttgagtctgtaactatttggagagaaataatgctccaaaataaaataaaccaactacatttcctattatatctctgctcacagagggaacaactatgaataaaatagcaaactacaaataattgaaacaaatgttacctctgttgttgttattataccattttaattttacttatcattcaataaatctctaagaaattgcccccgaccagtttttttttcccacttttcggcaatggtgattcaaagacaaatattttaagggaactaccttcatcttttcagttggaaaatttcttatagaagaggtttcattggcacagtattgaggaatgagaaagtgtttgccaaatacttaggaatctgggagtaggggtggtcttcaaatcagatggagccctgagtaagagtatcaagtacctgagaagctcagaaggccatttacacaacaggcttccttggcttagcattaaaatgcgttgtcatgtaatgaaaagcattgcggctcaattcttggttagcagagacaatctgaaactgaattttttttttttattattatactttaagttttagggtgcatgtgcacaatgtgcagattagttaccatatgtatacatgtgccatgctggtgtgctgcacccattaactcgtcatttagcattaggtatatctccttatgtagttcagaaaatgagtgatccaaaacttataattgcatattaacttattgaaataggtttacatttgtattaactattattcaaaaattgtctaacatgcttcacaagatttaaaatgagatattagaagaaatattttaaatagggctacagatggtgggtttgtaggtaataaatgaataaacaacattgttttaaattatgctattcattgtttaaaatagttaaagattcatgttttaaaaatataaagctatagtgattttacaccaaatacatgacatatgatgtagtaattgaaaatattatttttatttcctacattttttttagtttttttattagaaagttagacagtattctgttaatatataatctttctaaaataaatctttctaaagtcataatggtaggactctgagagtcgtagtattggaatgttcatttacctctataagcaggtgtttattttgtcaaagtaatagtttattgtcaaagagtttaaataaatcacaatattatataaacagtaaatcaacacatctgtcaatacttattacctatgcattctcaggtaattttatttcaaataaataaaaacaacttatagacaaaatccatagtttatttttataaaatttaatttaatttttatagttgacacgtaatagttgtgcacgtttatagggtacacagtattgtttaaatacatacaatacatagtgataagatcagggtaattagcatatccatcatctcaaacatttatcgttttttttgtgttgggaacattccatgtccttctagctatagtcatcctacagtgctatagaacactagaacctattctcctatctagttgtaactttgtatcctataacagattttttttctatggactactttcaaattggcagctggcctcttagtcatttagttttgataattttcagcaacataagtttttcattacactaaaaatctccaagtccaggaccatcacaaaacaaaagaaaaaagaaaaaaaaattggtatctgttaacagaattacttgagtcttaagatggagttttattgtgttcagttgatataatatttcatttgaactgaatagctcatatttcactgtaaatatttagttttcctcaagactcattagctaccaaagcaaacatatatttgttgagaaaagtgccacaagtcattcttgctgatgaactttttaaacaacataatagttttattttttaatgtaattcttatatattttgaatcagctgtcatttaataagaataattcattaaattttgtttgcagatatatatatttatacacatatatgttattttctcttcaggatttaagggttcaatttgtgtatgcaacatacataaacatacttatttttttttatttttcaagatggagtttcacttctgtcgctcaggctggagtgcaatggcaagatctcagctcactgcaacccccgactcccgggttcaagtgattctcctacctcagcctcccaggtagctgggattacaggtgcataccaccatgctcagctaatttttgtatttttactagagatggaatttcaccacattagctaggctggtctcgaactcctgacctcaagtgatccaccctccccgtcctcccaaagttcataaacatacttctttaaaaaatctaaaattataggaatgtaataggaatgtacaggtagttacattaactaaattgaaaaatcaagattattttctaaactatttcaacaaatttaaactcaaaataaaaacctaagcagttttcctatttaaaaattattttggggctggatgcggtggcttatgcctgtaatcccagcactttggaaggctgaggtgggcagatcatgaggtcaggagttccaagaccaggctggccaacatgtgaaaacccgtctctactaaaaatgcataaattagccaggcatggtggcgcgcctgtaatcccagctactccggaggctgaggcaggagaattgcttaaaccccggggacagaagttgcagtgagttgagatcatgccattgcactccagcctgggtgacagagtgactccgtctcaggaaaatatatatagatattttatatatattatagaaaatatattttatattatattatatatataatatatattatatattatataatatatattatataataatatatataatatatattatataatatatattatatattatatattatatataaaataaattctatatatttatataatatatattatattatatattatatattatatatttaatatataatatattatatataaaatatatatattatatatataaaatatataatatatatattatatatataatatataatatatattatatatataaaatatataatatatattatagatataaaatatatataatatatattatagatataaaatatatataatatataatatgtattatagatataaaatatataatatataatatatattatagatataaaatatctataatatataatatatattatatatatataaaatatatatatatgtattttttttttcagtcaggcatggagtgttcatgcctgtaatcccagcccattggggcacggtggtgggaagccaggagttcaaggccagcttgggcaacatagaaagacaccttctctaccaaaaaaaaaaatagctggtgatggtactgtgcacgacccccaacacccatagacatagctacctaggaggctgagggaggaggattgcttgatcccaggagtcgaaaggtgcagtgaactgtggtagtaacactacactcaagtatggggtgacagagcaagacccgatttctaataaataaataaatatgattttcattaggacaaaggctgttcctataacaaagacccgtcgccccccaccccgaaaaaaaacagtgactttaaaaggttagaagatgatttttttctcatgtaacaactcaagcctaattaaccaaagagagttctgataatggcacagtgtgggggtgacatggtctggctctgtgtctccatccaaatctcatcttgaatagtaatccgaattgtaatccccacatgttgggtgagggaccttgtggaaggtgattagatcatggggtggtccccccacggtgttctcatgatagtggatgagtgctcatgagatctgatggttttataagtgtctagcatttcccctggtggcactcattctctctcctgctgccctgtgaaaaggtgccttccgccatgcttgtaagtttcctgaggcctccccagctatgtgtggaacgtgagtcaattaaacctcttttctttataaattattcagtctcggctatttcttcgtagcagtgtgagaacagactaatacaggaggatacaagttttttctttgttgttttgtttcacccttgtatccagagagtttctatccagtggtttatgatagccaccctccttgtgccacgacatctatattccagccattgggaaggggaggaaaggaggaagggcaggattactttgcagggctcaacctaggaagttgtatacaacaatttcactcatacctgttttgctaggatttagtgatatgcgttcacatagttacaaagggatcaggaagccaaatcttatagctgtgtgtacatctaaaactagaggttctataactatcacaaggaaagaatgggtattaaatgaaaacaagcagtttctgctacagaaatgttagaatatattattttagaaattttacagggaaacagtccttgccttaaatagtagtgtatcatttagaatatttccagctgcaagtattaggcaatgcagctaaaagtggtttgaactataagaatattttttatctcatatgtgtagagctgtgacaggattggttatttcatttctcagggaatttttcaagggctacactctttttctttatttttactccacatcttcagcaagattgtcattcatagttttttctacaaggtcgtaattggctgttgtagcttcaaggcattacattcccagaaagccacatccaaatgcagggaggacggttcctcattgctttacctttcttttctgtctttttttttttttaatcagatagaaatatcttttctgtgatctcctaagcagtctcatctcaggtttcagtgacaaatattgggtcatacattctttgccttggtttcaaggagtattaatacttgctatttttagcactttaacagaaaagaagatatttgggaaagtctgctgtaatggcatccaaaagtctctaccacaattaaataatgtaacttaaaatatgtatataggtaagatgtttgcttatttactaaaaaaatccctagaaagtttatgtagaagctattatacaaaatggaagtggtttgcttctttaacattggatttctaatacatacaatttttcatgaccttatattactgtagtaatactactcataagccttactaaaaaaatcagtaagtaatattttcacattataacagtaaacacaaaatacagaaattcattaatagctgaaaagaattttggagtgtcaagtcatgacttcatctaattaaatattttataatttattcacacattaggaataatcaggttttaattgtgtatgcatcaatacaaatatcaaaagaacatgattattattttataatatttactttttaaaaaaccaaataaaagaaacataaaaatgacaaaagaatgcttaagtggagagaaaaaattactattaaatatctttaaatataggccaaatggtttagtattcccctttatctacatcttaatattgctgacatctggttttgagctaagaatgcatgaataggggaaaaaaagcaatctccatagtttttttttttattgaatacacataagtttattttgggaacagttcatttatcaaaagtataaagagatccttatttcatgggtggaaggtgatgcagtcatatctctacccttcacagttgagattggcaacatggtttgtaatagaagtattaaaaaatcagagggagaattataacagttaatttcattgcaaatagtaacaattgggttatttaaagtggttgtggcataaatgctaggatgcatgtggtaatcccaaatgccccaatcccaggtatagcaagtgtgttttaatgatacctgctaactagttaaaatggtcactttcacaaagctgactatattttatacactttgcataaactgtcatgtagacaatctattttttctttctctcatgtctatataaacctttataaagactataaagtgattctgtatatactactttaatcaaaattcctatgtgatttgcataaataatagattgcagttgctgctatgagactgctgatatagaactgcataattggaacaaaatttgatgaaaattacattgtttcaagtgtgcaggcaggacatggcatctaagagtgaagtttaacacttaatccaaacacttatatttggagtaggtgaagcaggtagtactaacagtggttttaaaattataaaacaacattttctatactgttatttaataaattacacttaatttttgaagcctaagtgtattcagttgaccaaacaatcaataaattctggtctataaattaaatgtcatgaaggtgaacaaaggtgaagaacagtaattatattttcttgagtttatgataacaatatataaaactgaaaaatttgctccaaaagaagtcatacataaatcataccatcagtttggtttattctagaaaggtctgcaggtataactctaaatttctttagttaggatccttagaagatacattagtttaaatttcattctcctacaatactgctaactttagatacatcacagaactaccagatgcaatgtttggtttagaaattgtcccacattagtagtcattaaagaagaaaaaaaaaaaggtgatttcttcttctgctataattcagtaaatgtgtttttaatatgcatatatttatgtgggaatatatatttgcaccttgataattacataaatttatacaagcattttattaattagacagtattactcttgcaaaagcaggcatgcatttattttgagatatttatttccaataataataaataggatttcaatttaagaagtgcattagatatattaaggatgatatgacagcttctgagctcatagcctccatatttttgtcttcccaattctcatatattttgtagaattttgggatgtggattatgtattctacattatttcttttaatgactgaggaaaatattatcatcaatcatcatcattatttcaaataagttttaatccatcataattttataagaatgtacagtaatcatagttgttactactgttgaaaagagataatacagtatagctttgattttcaaattttttatgttcttacctaattcttaaaggaatgcatgtttatttttcttctcttgacttttctcttagaacttaaattatctctcttttctttccatctctgtccctgtttttctatccatcatgccaccaaagagaaattgccagtatcttaaggaagaaattttactcagctcaattgttttaaagtgtgatgagaagctttaataacctatgcagcaagaggtaaaattaagttgtttaatcatagctggtgtgcccgcatacacaacagtgggtggcttctgctgaagagatgtgtttgggatgaattgctataaagaatgccataccaaaaggatacactttctttctttgccaaccaaaatttccaggtacttttgtttttaatacaataaatagtgttttactctcctacatttacaataaagtgacgtgttataactcaacagaatttccaacttgttttctcaacttccaaggttagaaattgatagttaatcttgtgggagccctgttgatggtgaaatcagcaactctggggaggcagtttacttcatttgaccttctcttgctccttagtatctgctcattatctgatgactttcctattcatagctgttatcagttgtaatattatatgtatgttattagagtaaaatgcttaggtttgaaatgtacgaaaaaattgtttgctgagagcactttatggtgtatctagtggctgatggagcccattgctttttcagtatagtactccttgccgtactttgtaatttcaacctgtaaatttagttaatgaaatctaatgtgccatccttaaacaacataaagggtatattttttaatagtattgtacctgtgtcagtgaaatagactagattttaatttctacactagtcatatgtgtttaacagtagatgctgttgtgtttctttgaatacatagaaatatctaagctgatcatctgtttaagcaggatttcaatccatcaagtaaatgaatccccttcatattttatcttttgtatcctgaattttcctgcaagcagtgattattgaaaaatacctgattgtatttttagtaatatctatggaacaaatttcatatgctgctgctgagtttcccttctggagaaattcagaaatttaaaaaagtactttcttgtctatatagtaattatgccaacatttcaaagcaactattatgtcttctgttttctcagtcaaacattcactattaaatagattacatattattcatgggtttttttcatttttagtaattacatatttttttatttatttgtagaatttttctaaagaaggattattttttccaaatttgtaaagatgctcagagtttagaatagtacatatgataagtacaggaaagtgcagaaaaatttttctatgatttcattacccagagataatcatagatacttgtattggcacttaaagttattattattattattattattattattattattattattatttatttcacacattataagttgggtttcacagaaaaccagctttcagatttgaatggaagagttttcctgggggctattcttgcaaacatctgtgagaggacaaggcgagagaactgagtagaggaagaagctgacctagaatgaattcacagcagctgtcataaccaatcacatgaagaactgtggagctaaaatggctcttaagaattcaatctcttgaggcaaggggccagtctttgttcttgcacattgactagtatttgaatatgggtaacccagggatggagtgtacctttgggttaggcagctgccattggcagaaggcaatacctggagaatatctcacctataagccatcagcagctaacacacctcacagctggggaatcagatacctgaagaggtgtctggggaacactacatctactaaatacacacacacacacacacacacacacacacacacacaaacaaatatttagcatattgaggatcataactaatatacttccttgaaattttttatactaacaatgatttctgtgactttatgtattagaaatttcaggcatcaatcagtgctgtgctgctttcaagtaacttgaatgcaatttttacttttctgatttgtttttctgatgagtctatacaaatagtgatcactttattatgtacacaaaaatatacttatggccaatgcaatatgaataatgggatattttccataaaaaatgatgggtgtttttagctactacctaatatgttttctggagcttcttaaattaataaataaacttaagaatcatatattataggtctgattaaataggatttaaatctattacttttgctccaatctattacattagagacaaatttattgagtttaattttgtaacctaagtaggttgctgtaaaagtctgcccttgagtgagctgaaatctgttatcagatttgaactatcgttctcagaaactgagctgggcaaagagatgaggtaggattcaaagcatggacactaagagatctgaaacagcgttacaaaataaaagaaaaacacaaataaaaactaacaaaaaagtatgttctttcctaattttttaaattattatgagcaatatcccaattgtagattgtatatactggccttgtatcaaccaaatgcagattttggtacttctacatctaattgacatttggtcattttagatgtatgtgtgggcatatttgcgtagacatgggattcattaactcttactttttagagaagctataacttcaacaaggtgggagttcactattttcctccagaaagctctgagacatctataaccaaactatcacatagggatgtcatctagcagggccatagccattccagatattctagtctggctttgggggttgtgacaggaacctccacagaaagactttaattttttttgatactaagcaacaagaagtttatgatagtattaataacaccaaatggatctcattcatcgtagctccattttgacattcttattttcaagaggaaaatatattttcaagacccatattactatggttggctaaaaatatgtataatctgattccagctatattctgttttagggaattaaatacagccatggacatagattttttatatatcataaagatggaccaaacacaaaagaatagaaggcacactctttagtgagacaagcgacatcagcaacttagtggaattgttgtcaagaatgttgcaaagccacacattggttggcccttttggaatcggagagaatgaggtgtcttctgcaggcttgccttacacagtttggatctgtcctttataaatggtaatgaagaaaataatgttttttgtaaggatcaaaatactttcttgcaaaggccattggggattcacttcatttttcatgcttattttttgaacacaaacttaaaacataacatcagatgagcgtggaagtggaaatagctaattggggcaaacctgatttttgtccagtttcttaattattttaactttaaatttcacaagtttattcccacttttgtgggattttttttttttctggttgaaggcaatgaagacattcgagtacaatcttaaaataatattaaggaaacttaacttttgagcatttatgtacaaatttagaattaatgaactatagatttctcacacttaaatttccattagtttattttcacttttgttctaatttcatctaccttataagtaatagcctaaatttcacgtcatgaattaaaatgtgtaaatttaaaataatttctacttttatagatgtttaacttgtctgttttgcatttagtatcatttttgagtagctgagaaggtactccttaatctatattattgaaattggtgaatttatacaactgtgcacaattctgcatttaggtagatttgaaacttaatttgacctctgataaaggcaaattgaaagcacccatgaaagctttaacaaaaatgtgtgtaataatccatcccaaggctagaaattcaaggttgggtaaattatcatggctacccagagttgacccaagcctggtagatgcaccctaaggtaaccctcaatgagtcacaccctcacacctttgtattaacttctacccttaagtgtaggtggaaactgtgatatgcttctcaacaataaaccttgataaaggtaatagaaggtcattcccatgattagcttctgttatatggcaaagataatgttatatggcaaaaataaatcatatatactatgataatgccatagtatataaaattccatttaggcagactgtgggaaaagattgtcctgctggccttgagaaagcaagctgccagtatatgagagggcctgtgtgaggaccatctgacaactgtgagtggctcctaggagtcaagagtggaccctgataatataaaaaatgaggtattcactcctacaatagcaaagaaattaatttttgtcaacaaacatcaaagctcagaagagaaccctgaactctagaaaagaatgcagctgcacaaaatatgaggtctgcagctacactcagccaccatttcagacagatgattcatcttgtaaacagatgatgtaaacttacggaatcaataaattcagtaaggcactctaaatgtaaaaaaaaaagaaagaaagaaagaaaagaatgcagctggttgacaccttgattacagccatttgaaaccctgatttaaggacctagtgaagtttgtgtccagactactgacacatggatagtgtgagattaatgaatgagtgttgttttaagctcttatatttgtggataatgtgttacatggcaatagataactaatacaacaaacgtgttaatgttggcagttctgtgtagtttaatgaaataatgaaaatgaaaataaaaccccaaaatacaagcaagtacaacataagaggaatattttggtatatttatataccagggtgctaggcattaaacacgatatagtagcttttggtatatttttaaatgaatacaaattggttgcaaagtatatactctttgcaagcattctgagtatacacagagtatgctctgtatgatacaattttttcttaaaaatcagtagatataaatgcattacaaaagaactgatagaatatacactaaattaaatatggagaagaggattatggtaatctaaaatttctttgagagtgacatcagcaatacgacagaataggaggctccccactgggtatttcccccagcaatagtaacttggcagccattcacaaataaaagtacctttgtaaaagttttgggactcaggtattcggttgtgacaccccagcgtgtctctgagagccattttgagaaggaaggtctgcacccaggtggcagagcttccttgaccatggtccctgccacagacacagaacaatcccatcctcctgtgaacacatctgcaatgcgttttagccttggtcctacctccagcgtcatctaccaagggacctgaaaagagtcatacacacccacactttgggtaataggcctgctgaccttggttccacagtaaatactaaaacagatctgaacttggctctagcctgtctcagtcccagtctaggagaggtcctgcccagctagggactcacacattgacatgcctgtctatgccctcagatgcaggcccactaacctggtcccagagcagatcctgaaatgacctgtaacttggttctagcctctctcaacagttctgcactcctaattaccttcttgggaacacatccatggtgaccctgcaggcaggcatgcttacgctagtctgactttggatcttgaaatggccttgtaactcatcctcagtccctcttagtcatggtctgaaaatgggacaaggggtaacccaaagagagactcacttgaagcagctctgtactttggctccagctcctctcagctacagtctgagaacaatcttgcctgcccaagtacccaatgggtgagacacccatctatgtcccttggtctgactgcagatcctgaagcagccaagtaacctgtctgcaactctgcttactcatgctctggggcagtactgcccaccctggaacccagcaggactcacgcccatccatgtcactagaggtaggcctgcagacctcagtatcagctctggaccctgaagcaggcctgactcagtttcagaccccctcagctgtgatttaggggctagtactgccaacacaggtatctttacagggaccgaatgggagacctcccagatacctagtgggagccatatccatccaagccatggtaacagtccccatgtctttggaccctactgtggagcctgaagtggtgtatccttgtcccagcactagccctactggccaaggtcctggagacaatccagtcttctcagggaacagacaggatccacaactacctaagtccctgaaacaggcctgccagccagggacctgatattggaccatgcagcaatactgtgacctggtttcaatactaataagctacattcctaatggcagtcatatcagccaaggcactaaaacaggaaaaggtctttacctgctgaaactagtctgcacactcggagagacattaactccttcagatgcacagacaccagtgaaaggctacgtggatcacaaggaaactaatgacaccacacaagtaaaacatgacaccacacaagtaaactaataaagctctagtagcatgcctgaaagaaatggagatctataagctgcctgatttaaagaaattcatcttaaagaatctttcatctcaatgagatgcaagagaatgcatgtaggcaactaaacaaaatcaagaacacaaacatgagaagttgaacaaaataagaagtctcatacaaaaatagaaagtgtaagaaagaaccaaacataaattctagaattgaaaaatacaatgacagaagtgaaatattcatagagaattttaaaacctgccttagtaatgcaaataaaagaatcagtgaactcaaaaacagggtgtttaaagtgagacaaacaaaggaaccaactgaacagaaaatgaaaaagagtgaagaaagcagaggaacaatcaatagagaatgcaaaacagtgtagaaaacatactggacctatcggataccaaaaagcaaattaatatacacattatgtaattttcagaacgagaagagagggagaaagtggtagaaagcatatttaaacaatggctgaaacatcccaaatcttgagatatggacatctagatttgtgaaactcaaaaaaccccatgcaaagtcaatctaaagaaaataaccatgagatatgttataatcaaatggtcaaaagtcagacagagaaaaaattaaaagcagcatgagggaagtggtttgtcacctataagagaactctcataagattatctttgggtttctcagcagaaacattgcaggcctgaagggaatggattagtatatttaaagtgttgaaacaaaaataactgccaattaagaatactatatatggtaaaactgagctcactgataaagacaaatatatagtgaaattgggatattctgatactgtaatggtgatgtataaatggtgctgcataaatcacttttaactttattaaaaagttaaaaggcaaaagtattaaactaactatagctatgataatttattaattggtgcatgatataaaaatgtgtaaagtattacctcaataatataaaatgtatgtggaggaggaaagtaaatgtgtggggtttttatgccattgaagttagttataattttgaaatagactactatattataacaaaggtattttatgtaaacctcatggtactaacaaagcacaaacctcgaacagatatgtaaaatataaagggaaaggaataaaaccgtaatactacaaagaaaatcaacaagttaaataagagacagcaagagagaaagaaagggacaaaggtactatagaacaaccagaaaacaacaaaatggcaaagtaagtccttgcaaattagtaataactttaaatgtaaatgaatggacccaacagacacataacgaagacttcacccagcagcagcagaatacacattcttctcaagctcacacagaacattttccaagatagatcatacgttgggtcaaaaaataagtgctgacaaatttaagaagattatttcaagtgtcgtattctaccacaatagtataaaactggaaatcaataacaacagaacattgggaaatgcacaaatataaggaaattaaacaagacatacctgaacaaccaatgggtcaaagaagaaatcaagagagaaataaaaaagtatcttgaaacaaatgaaaattgaaacacaacgtatcaaaagttacgggaggcagcagaataagttcaaagaggaaagcttatagtgataaatacctacgtcgaaaaaaaataatttcaaacaaataactgtacatcttgagatgtcagaaaaaagacactaagttaaaagctaacagaaggaaagaaacagtacaagttataacagaaataaatgagacacaaactagggaggcaacagaaaataatggtaaaggtaagagcgtttttcttaaataaaatagataaatttttagaaacatacaacctaccaacaacgaattaagaagaaatagaaaatttaaacaagccaataacaagggtgaagattgacacattaataaaaaagtctctcaacaaataaaagcccaggaacagatggcttcctgaggtgaattacactaagcatgtaaaaaagacttcattccaattcatttcaaactctgccaaaaaaagtttggagagaacacttccaaattcatattatcgggttggaatattatgaggcgtaataccaaagccagaagaggaaattacaataaaagaaaattataagccaatatccctgaagaatttaaatgtcaaaatattcaaaaaatactatcaaaccaaattcaacagtgaatgaaaaggaccatatactatgaacaaataagatttatctttggaatgcaaaaattgttcaacataaaacaatcattaagtgtgatatatgacattaacagaatgaatggtaaaaatcaaatgatcatctcaataaatggagaaagactatttggaaaaattcaatatacttttatgataaaaactcgcaaaaaaattaggtaaagaaggaatgtacttcaacttaatgaagaacatatatgagaagcttgtggccaaccttatattaaatggtgaaaactgaaggtttttttcctaagatcaagaacaagagaggatcaccacttttatcacttctatcaacatattactggaagtcttagccagagcattagacaagaaaaagaaatgtaaaactttcaaatatgaactgaagaatttaaattgtccttgtttgcagatgatataatcttatatgtagaaacttataaagacttcacaaaaaaaaactgtcagaactaagacatgaattcagtagaattgtatcatacaaagcaatataaaaaattatttgcatttcaatctactaccaagtatctgaaaaagaaagcaaacaatccaatttacattagcatcaaaaagaataaaatgcctagtaataaatttaaccaaggaattgaaaaatccatacactgaaaactaagatattgatgaaagaatttgaaaaagacacaaataaatgaaaagataatccatggatatattcgtagattggaagattttaatgttgttaaaatgtccatacaattggctcttgagccacttgcttgagcccactcccactatactgagggtaatttcatttcaataaatctgtgctttttttgcttcattcttttcttgctttgtgcattttgttcaatttttgttcaataataaaaaaatttaaaatatccatacaatcaatgttaattatagatttaatgcaatccttgtaaaatttccaatgacatttttcacagaaatagaaaataaaaaaacaatcctatactgtgtatgaaaccacaaaagaccctgaatagccaaaatagtgattagaaagaagaacaaagctggaagccttacacttcctgatttcaaaatatactacaaagcaaagctatagtaatcgaaacagtatgttctggcataaaaacagacacttagaccaatagagcagaataaagagatcagaagtcaattaatgcacttaatggtagactaacctttgtcaaaggggtcaagaatacaaaatgagaaaaggatattggatattctctactataaatggtagtagtaaaacttgatatacaaatgaaacagaatgaaattggacccttatcttatatcatacacaaaatttaacttaaaatggattaaagacgtaaaagtaaaatctgaaacagtcaaacccctagaaaacaaacatatgaacaaggctccttgacatttgttttggcaatgatcttttggatatgataccaaaagcacaggcaacaaaagcaaaaataaacaagtgagactacatcagaataaaaagcttcttcatcgcaaagcaaataatcaagaaaatgaaaaggcaacctatgtaaactatttgtgaaccataaatcagataagggcttaacatccaaaaatatgtaaagaatgcatgcaactcaatatgccaaaacaaataaaatacaattcaaaaagagtcaaatgacatgaatagactttttttccaaagaagatatatgaatgtccaataggtatgtgaaaagatgctcaacatcactaataatcaggaaagtgcaaatcaaaatcacaaagagatatcaccttacttggctacaaaaggtattaccaaaaagatcagagatgaatgttggtgagggtgtcaaaaagggaagccttatacactgttggtggaactggaaattaatacagccatcatggcaagtagtatagagttcccacaaaaaattaaaaacagagttacaatacaacctagcaatcttgctctgagtatatttccaaaggaaataaaatcaatatgttgaagagatatctgtatctgcatatttattgcagcattattcacaatagatgaaatatgaaaacaatctaagtgtccttcgtgaattaataaaaagtgatatatatgtacaatggaatattattcagccaaaaagaggaaatattttcataggtgacaacatgaatgaaactggaggacagatttcacctatactaagtaaagtaagccaaactcagaaagacaaatattgtaggatatcacttatatacagaatcttaaaaagttgaactcgtaaaagcagagagtagaacagcatttggcagagactaggtggtggaagaaatgagatgttggtcaaggatacaaactttcaattatgagatgaaaaagttctggggatttaatgtacagtgtgtgagtgtgactgtagttaataatactgtattatatacttgagtgtttttagacagtagatcttaagtgtaatcaccacacacacacacaatggtagctatttgagatatgagggatgtgttaattaacttggttttggcatatcagatttcacaatgtgtatgtaataatcacattgtacaccttgaaacatacaatttttatttattgtacctcaataaagctggaaaaaaataataaattttttttggactgatgaatgcctttaaaagtttataaaatcagcttgtttcttggttaaatacttatgaatggcattattggctcatatggtaagtatattattaattgcatttgtaatgagctgacaaactatttctaaatatgatatggtatattaattgatttttaatgttgaagcagtcttgaacattttgcatatttaagtgaacttcaaatttgactttgtctagtgtacttttcttattatatattgttgggtgttatttgctaacatttgtaaaggttttttattttttgccctttgtctagactcatgagaatactcatctgtagttttcttgtaatgtgtgtagttttgattttggggtgaggttaacttcataaaatgacttggaaaatgcttccttcttttctttatttgagaagaatttctgtagggttgttactattcattctgaaatgtttgacggacttcaacagtgaagcctggagttttctctgtgagaagaattttaaatgcaaattcaatttctttaatatatctagggctattcaggttacctcttttcttgtctgaactttggaagttggcatcttttaatcattttgtcaatttcatttaaactgttgcatttattggcaaatagttctaatattcccttattatcaatttaatgtcataagatctatagtaatgctccctctggctttctttatattagcaactgtggcttttgaaaaataaatctggtggatgtttaacaagtacaatgatattttcaaagaaccaggttgctttgactggtttttgtttttttctgctcttttcttatttattttttcgcttatttggggctcaaatttatctccactttccatgtttattgattttaggctttttattttggcattttaattattttaatcttattactgtcattgtgctcttaaagttccccatctttcatctattgtccacttttttctgttatatcgtaacatattaatgataaattttaaagaccttttttcttatcgttccagtatctgggctatttctagttctattctgttcactatttcatttatcagtagtgacctcttttcctcttttgtatgctctgtaattttttatagaatgcctgattttgtgagtaaatgtataaaggaacaatagaaagtgagttaagtaatatttactccccaaaagggacctctctctttctcgtcaggtctttggtgtgggagtcataatcaatacagcgggctgtttagctgagttcgggtttgattgctgccatatatacctttcgtgcatgagtcttcaaattctttcagtcgtgaacctccactactttgcactatctggattatcgtgggatttttctcaatattctttctctatcctcaacttttagcagcagactcttttatgaaactcagaactgcagatttctcagtattcctatcactcatctggtgacaaacaacctctgtctcccactcagttcagggtagagtgggcagtcttttttcttccccttacccttgcatggcagcccacatccacttcatatttgtacattatctaaggcacaataaagtgtccttcatggctttgcatagcaaatgtcctctgtaattaatggtgtcagaataatgtttactaaagtagcactgcacataactcatactcattttaattgaggaatcatttgataataaaggagttcatttttctaaaattattaatcataagatatatataaaaatggaagttcctaatcaaaagattttaagtgaaaaattaatataatagtatttatagtgtcttagtgaccaagaaaaaaaattaaacagcataaaaagattaatcatagcactttacaatagcaaaaaaagactggggcaagaaatacctctaatgcccagcagtagttcatttattaaagaacttgtggaatcaaaagtggatggttataaatgagggagaaaaaattgtaatgtgtagggtgttatatcatggagaaagtagagaccatgttgggttcataattagggtagtgataaaatgagaaaaaaatgtaagaaagagtagtctgaaaattaattcttgctgataaataggaagaaagagtacaatgagggagatcatcctggcaaattgtcattgagagtggaaaaaaaaaaaaaaactggaaccctaaagttgcttctagaaacaagaggcaaagttttgtgtgaatgaaacgtaaaagatgaaacagaagttgcagcatgacatcctgaaagaattgtaaggtcaccatgaaaaatgagatggtacatgtctgatgctttaggggaatatgatccttgcaactctattaactgtatatgtttttaaaattaaccaatataaaattaatctaaaattataatttctggcttcttagtgagatatcttatatagcaagtggactactgtctttttttttttttttttttgaggcacagagtcttgctctgtcacccaggctggagtgcagtggcacgatctcggctcactgcagcctctgcctcccgggttccagcgattctcctgcctcagcctcccaagcaggtaggactgcaggcatgtgccaccacgcccagctaatttttgtatttttagtagagatggggtttcaccatgttggccagtctggtcttgaactcctgacctcagattatccacctgcctcagcctcccaaaatactgtgattacaggcatgagccactgcaccttgctggactactgtcttgaatagagatttgttttctgttttttttgttgttgttgtttgttttttgtttttgagacagagttttgctcttgttgtccagactggagtgcaatggcatgatctcggctcactgcaacctccgcctcctgggttcaaatgattctcctgcctcagcttcccaagtagctgggattacaggcgcccaccaccacgctcagctaatttttgtattttcagtagagatggggtttcaccatgttggccaggctggtctcaaattcctgacctcgtgatctgcccacctcggcctcccaaagtgctgggattaacaggcgtgaaacaccacgcccggcctagagatttgttttaaatgtgaacaagtatttatgaaatgagaaaaatgtaaagctggaatatgtatttttaaatgtaaaataatttttttagatttttctctttgtattttgaatcttattctaattttgcacttaggtttctagttgagttgtaatatccaggtataatattttataattaattgttgaatttgattttgtttttctgaaaaacattcattctaaagagaaactctacatactatgggagtcttctaaattattcttccatctctgtcctctttccaatatcaatatcatctacttttatatctttagagctctgttgtaaaataaatctcagcaaattgtaggactattgggcatatgttatatttgagggtacatatgcagtttggaaatagtacaaagcattttactgtcccctttctgtaatacagtagttgtcaaagtatgtaggttatcagaatctgggataagggtgaaggaaagaaatgaaataatatttgcatttttattttagaaactcgttggttcaaaaaaaatcctatcattgtattgtcaggatctaccttctaatttttgtagaagggcagctgttactagagaggaatgcccctcccacactatttgtttatgctaaaatatagtgaactccagtctttctggtttttcatgtttcttgtcatagatatgacttcaccgacgactgtattttcctaatcagctcaattatttgtgggagtagaacccacacagcagatggcatttatacagggaaacttgacttatggccatggcagagctttggatgatttagggttggttctctggtggagaaagaaaaaagaaagggaagaaggcagaggaatgagaaaaaaaagttaagattaaagaacagacagaaatcttcactgactgttaagtgtgtaggcacaggatgaggcacctgctcttggaagtatgggtaacattggaggtcaggataagatggctgccaatttatcaatggtgggaatattacagtaaaagataaatgcgtgacataatgtcaactgggtttaatcactgttttaatatttagttaaaagtgattcctaatccccccatattccatgccctgatgagagtccaatgccttaaaaatttttaaagatttctgtgaatgtttaagaacctaagattgttatgattactaccacattttatgttttgctttcacccagttaatttaatctattaacacagaggtagaacccagactcttgatttccaaccatccacaacacataatgcgaacaaaatataattcatacaaggcagataaaaggtaaccaacttgtttgtttgaaatagggaggggcagggggttttacattacatattcaaacaacttacaattgaatatcagacatctctgttcttaacaacaatttctacttccttcactactactagacttaccccagctcactcttcaacaccaattgccttccatttcatatttaaaggaagttaatgatgattttgttttcttccctagaatactacagatagctaattctttcagagtctcagcttccaaattaagaaattttaaaggtattttaaaatcagactgttcttatactcagaggaaagctggtgataagtgttttattttccagtttttaaaagttgtgatataatggctaagagaatcagtcttcctggaatagtatactggttccatctcaggttagcaaatctattccttacttctctaacctataaaatggagatgacaatataatctattttatagtttagtgatgagacttaaaggaattaattctggtaaagtgccttcctgcagtggtacctggctcagtgtgaatgctcagtaaatgttatctcctactaaatcttgcataaatgagttttttgctggatacgacagagtaccaattatcatgggaaagaatgatatatagtgaattaggagcatttaagacatacataaccaagtgtccatgctatttgccttctgaattcctgtgagttgaaacatgccacctaaaactgaattggctgtttcttgattaaatttagtgatatattctcttgtcagactaaagaaatagttaatgcccagatacatgtatgatgattcttttggggaaataggcataagagtgaaaggggattaatttcaaagtccctcaatattgaagcctcatttttaagaaatatgttcaatgtgcacataaagagaacaatttctttcagtgtatatacatttaacaagaacaaatgggaagttaaacaaattaccttcacaaccattttgatttattagcatcttggtaactcatgaaccatttgggcttcaaataaatgatcctggtatgatattcaaaaaggtttttcaatcaatgttttatgaccatctctaataaaagtttctatgtctagatatttcttctacatcttcctttaatgggccctgagggtaatgttaggttgattctggtaagctctcatggctgaagactatttgctgtcattgttctcatagtcttttagacaatctcttatttacagtctgataaattgtaggcttctcttcattctatttttcaaaggatagcttttattattccgggaatttgtttcttttaggcaaactataattttatgtggctattgtaccctaagattctttttgcaatagtaaaatgctaacatcaatgaatatcacaaggcttttattctctttattcctattttgttttgttcagactctttttttatcatgaaagcacttcagtatcacattttattcatatgtctttaagaagataattcattagaaattccttctatgcattttgttttaaagaggtgtcattttttttcatgctgagtatttcaacctaaattctgactagaagtcattttttatttttgtacttgaactttttatttctgacttatgaaaaaaatcttttaagtaagtgtaaaagatattttggaaagaagattatattggttttatgatgtgcataataagctacctaaaaactcagtggcttaaaacaatgatcatttattatccttcagatgtctgcagttgggctgggctgggctggactgggctgggctgaatgttttcattagggttttctggctgggagtctctgcttgttactgcagttctgtgggttagttggagttgctctgttccatattctctaactgtcttaggaccaggagggcctgctgtaatcattgtaatgctcaagaaataagaacaatcaggaacttgcacagtctcttcaactctgtgctcataatggacacactgccatttctgccttcaaagcaaatcacatggcaggatgcaaagttaagggataggcacctgctttgtcaatgatgatgccatggacaggatatgagtacaaagacatgtaaaagattgaagtcagtgttacaatctgccaaaagataagtaagaaagaaaatgggacgggcacagtggctcacgcctgtaatcccagcactttgggaggctgaggcgggcagatcatgaggtgaggaattcaagaccagcttaactaatatggtgaaaccctgtctccactaaaaatacaaaaattggccaggcatagtggcgcgcgggccatcctacctactcaggaggctgaggcaggagaatcgcttgaacccaggaggcaggggttgcagtaagctaagattgcaccactacactccagcctgggcaatacagcaagacttgtcttgaaaaaaaaaaagaacatgaaaactgctttgcgaacacttgtcaggtatgtttttatgattgcatattttttttttccattgacttctgacttcttccaaatatctttctttgagcataagactcaggagtagatttttttttttttttgtctttcttttgtctttaaggaattccttctagaatccttttattcatatataaatgtgaaagggttaggtggaatcagattgggggggatcatgttagttctggctaagtatgcatactttcttttctgctggaaaactagacagatattgcagtctgtggttgtactttgagggctagaaaactaagcattatttaaaacttgataaccaagggaaaaaaaagttgccagattaggcagtatgcattctctaatattttgttgtaaacagaaaaattgctagaattttacaaattgtaactctctacaatgagttatttagaaagtcattaaaggatagattaaaagacagtagcttaaaaaatcatgaagttctaatttttctgctattatttaatttatccaatagcatcatattgggcatcttactgaacaccttattgagcatcttatcacatgtgctgggtggggatactacaggggacttcatggtacttacatttcagtggtagaagacacataggaacaaaaatgtgtattacttgggtgactattgaaatgaagaaaaatatagcagataaaattagtgagaagaagcaaacatgtcttcatgtattgggtggtcaaaaaagacctctctgcaaatgcaactactgagtatagcttggaacaaaaggtaggtaagaatcatatgtttatttaattaaagagctttccagttagaagacaaagcaagtgaaaacatcctgggttgggagtatgggaatttgagttacaccaaggaagtctttatgactggaatgaaggaagcggaggggaaatacagaagataaagtcagagtggtagtaaggaggaagatcataaaacaactttttaggccaagactaacaatcataactttagacagataaagagttattggaaggttttaaacaagcaataacttgatcaaattatctggagaatagaacaaaggtagaaacatggaggcaagttagaaaattcttccaacagtttcagaagataacctgtagcaacagagatagtaagaaggggtcggactggagatatattttgaaggaggaggtcacagaatttgctaatgaatccttggagagaggagtcagggatgactcaaggctttttgtcctgtgcattttaagaatagagttgccttgtaacaagatggggaagattactcaaggaggatgttcacagagaaattcaggaggtttttagggagaatgttaagtttaaggtcagtagggatatagatttcagagtctggaggattaaggaaaaaatgggaacagaggtatacatttggaagtcattaacctataggttatatgtaaagcagtggatctagctgaggtcctctttaattaataattatgaatcagtgccatggattggtcctattcaatatagtccaaattaatgtaaacatttaaataacacccaaataattttaattttaatgtaaatgacttctatatttttaaattttatgtaatggttccatatctacttattatcacctcatcgggctgaaaatttgtctgtaacatatgcttttaaaaacaaaatattttctcttacatggacgttcttattctaaaaatgtttggccatgtcttcctgatttaaatctagcctttcttaagtacctggattattggactcatagtcataatcttagctatttttctggtggctataaaatataaataggccaggcacagaatgaaccaccaaccaggttattgattctaaaatataaatgctgcaatatcactgtgattcatcattgtgtgcataaaaatgagaccaccttatagacctcagtatttcttgcttattagaacctatttacatatttatagaaacgtaacctctctttcaaggttctcttaattttatcctttctcctcacgggtaatgaaacttgagctcgtgattgtggcttaacactcactctcaggctgctgctcacatggtgatgtccctgttctgtcctgaccatgacagccgctgcttttgggggcattcctcaatgttcaggtgttcctgctgctaagtacaactttgtatgagtggaatcatcctcaattctacctcacagtctccttggcatatgtcctcctcctctgatgtctatgtcagaagcattccagagcagggtttttttaagaccctgagtggttactgtttttccgtattttacttggctcttctctatcaaggtgctcccaaggaaggctgagttcatttgaaacaacagtgcccaattttacttaaaagtactacttctctcagaccctcaggctctgtcattgagtccagcttgtaaactacacccctttcactgaaatggagtccctccctggaaagccacattcccttcttgcagtataacttctttggggcattaaccttgctcctctgtccatcctgtactaatcctggcatatttgccattctgtgagttacttaattctcaccattatattttgagttttattctagaaaactcacaagcctccaagtccatcaatagacacaaattttaagtgtaaggtgaaagatttcttcttagttctcctaagagacatgcctaaaattcagttctgacatagctgagacccctgcctcttacataccgtgaatgaaaagatctttattaatataatgcggtatcattctgacatgcataaaacaaaatgtgcaaagtctacttctttagaaggttaaagtatagcaggtaaaaatcaatatagattgtcatggctgttcattaaatttttatattaagattgtaagaaacccatacataataaattagataaagaaaatagaacatctatgaatgaataaaagttacttgattataaaatatatttcctgtgggaaattatgttagcaactcaaagagttttgtggaaccaaaactgctcagggaaagaatgggaagtagattaataagtagatttatgtgcatgtgcctgccctgggacatttgtaagcattgtctatggtattttttgttttgttttaaagactttgagcgggacacaggctctgcagcagagagtctggctcattggctgtggctagcatagacgcataaaaatggagactttcatcctagaaagtttctacgttggccaataaggaagaaactaaggaaaatgcagttttgtaacaatggaatgaaacataatatctaatcagggcctatatccagtgtaaatcttaccctagccaccttgagttccatttggcagactcttccaggactctgataaaaataaactgtttcgtgcaaatagcagtgttacaagtcagtcatctttacaaaagtttactcaggaaatcccaaaaataattctggaaaagaaataactgcttgcaaaatttttaaattgacattgaaagtttttcatcaaatttaatttgatatgacataatttcaaacatcttataaaaattgtcattttaaaaccaattaaacaattctctttaagcacctaacaggatataaaaatataccattttataataccatgtattttattttaattatgtatgtattttgtatttacatcatcttttatttttatgaaatcatggtttttatcccctttcttaaattgtacgaattccctaaattacacaatgaatttttgaaaatcttttgctcagtatgttattatcatatctctttgaataaaactaaaaagttattgaaattttttctcacatcatgagtctctaaatgttaaaaatgtctataggattaagttatgtaacaattaatatatgttggtcaaacaaagagcatatattacaaacgtattccaattgttaacataaaatgttaggaaggaggtgaaattggaactttcagtgagacaaatggggaagtttggtgacttgattaaaggtaatttcatggacaacagtattttaaattgccttagtgattttcacttaggaggctttttcatcttggggtaatgctcaatgtatagtaagagtctgcctaagtgaaaattgttatttatatggaagaatgttaaattatttaaacaatggcaaagggttgaatgtaaatgttgagaagtgaaaccctcaccattggcactcgttcaggcagagtagttttaaaaatagaagtttacagtcacagaaattgaatcctgtgaaagcattcacagcatcatacctcttagaagatctttgtggtgagctctgggctgggaaatgtggcattatgtttgtcactacagctgctgctggctgctgataatacagcacaatggccaaagacttagaatctggaactcaattacctgggttcagttcctgctttgcacatagctgagtgacctttggtgagttattgaaacttcctgagcctctgcttctctatagataattcagagacagaaaaagaggaaagcagccctgatatttggaaaaagaacttgaaatcttacagctaggtcttagtattggtaggagctggactgacaatcacagcaaagccttggtgttctcctatgagacataaagaaatctcacagaacatcaacatcagacaagatgattctggacctgtgtaaagataaagacaggcaagttgacaatgttgactaagtgcagataaaagaaaaaggtcagtgtaaaaaccacaaaatgtctgctgatatgagtgattgctgctttgttagctttattatagtctgccctccatttagaaaacatttattaatatacctaatcatagacttattcctgtcccttcacagtacccagtccagtctgccttctggagctctcttccaaaatcatcttgcctaagcctgaatcccataataagtccttccaatcactctctgaggtgccccatgattctccacgtacatccctcactgccacaagtattaaatccaactcatggaactataggcgttccctttgtggtccttgcttggaaggcatgtcagtggtgatgataatagtggcatcttccttataaggttttcatgatgataaaattaattagtgtgtggaaagtgctcagaacgtaactgactggaaaaaaaaaagtgctgttagttgtccctctgtcccttcttcctgggccttttgatctgtgctcttctgggttcttctcctgaagaattgccatcctctaccatacccctgctctcaggttactcaggccacggatcaataactcagttgtctgctcatgtcaggaagagcccatgataactagttcctcgtcaaataattgcccttctagtttcttgaacttggcacacacttttcacctatttggtagaggttagtggaatactgccttgttaatgataaaattggggctatcttgaaaaaatagccctgtctgtcatcttcatcaactgatttgctcagcaatcaacaacgctgtggacatagagttgaacaaacatagtccttgcacttagtactgctgtgatctcatgctgtgcttttgtgctgagtagctatgtttgcaacgtttgacaggtctctctctgcccccgtgaaccacttggccttgtctccatatggagcagttcttactacatgcttgcaaatgctgaggatttccctgccatgttatgaacagtcttatttctaccctgtccagttccaatccctttctttatatcacactcattatctaggtgctgctgctccgtgtttagtagactagactgaatgggatatagcgaattgatacccaagaactgaaagagatggaagcacttgtctttatgcaaaaaattagtttaatatacatactgtgaagatacattgacaacaaaaaaaatggcatttaattatataatttaggaagatttagactagagcaattcattagaaaaacatacaatttgaaattctcaggtaaaaatgggcatgctaatagaatgtacattataaagtggttgggaagatgaagatgaagtagttggtgagaacttaaggtaacgtgcttagctggttgcttccgtgtgctaatcactcaatatatctgtgataggtagaaaaatggttccccaaagatggtcatgccctgatccctgtaatctgcatatattactttacatagcaaaagggatttggcagatgtgattaagtatttgagactggaagattatcctgaattttcttgtggcccaatgtaatcacaagggtcatgataaaagggaggcaggagggtcagagtcagataaagagattaagtcacagaagtaaaggtcagaatgactgggccatgaaccaaggaatgcagacaacctctagaaactaaaaaaagcaaggatagcattctatagcacctccagaaggaatgcagccctgattacaccttgattttagtccagtgagacttctgacttctggaaatagatgatattaatttgcatgggttaaatcattgtgtgtggtaagttgttacagcagcaataggaaattaatacaatacactaaacagattttttattattattgatagtattgtattagtttgctggggctgaaataacacagtaccagagtggcataaatagcataaatctattttctcacagttctgaaagttagaagtccaagatcaaggtgtgaacagggctggtatttcctaaggactctgagggaaggatctgttccgggcctctgtttagctcatagatgcctgtctttcccaagcctccacagcatctccacctctgtgcatgtttctgtgttcaagtttccccgtattataaggacgccagtcatattgtatataggcccactctaatgaattcactttaacttgattacatctgtaaagatcctggcttcaaataaggtcacactctgaagtactggggcttaggctttcaacgtttaaattttgaaggaaacaaaaaatccataatcattgttttgtgcctttaaagcaaatcctaaaattttagagcaatgactatattctcagaaacaaaaagtatctaaggattattttagtcgtaactttgatttgacaaaggtgattcttttaaaggacaccataattgggaatgtgctgtattgcagagggaccatgacttattggtttaataagaagtagtatcattgattctaccactgggatacaacctcaattatgggaaatggcaatttagcagttctaaaaacaactcccttttataattatagagaatttcctttagtggcatcagaagttctataagtcactcatgttttcccatgaggtccccataagtatgcggttactacatcattttgagcatccccgataattctgcaggtagtaggtaaaatagcttgtctaacatagcacgtggcagctgtatcctactacagaagaaggaaaccaaatcataattaacaaaaatctgactttcattagatttgtcctggatcagtggggcgtaaaacttcaaggactcctttgagaatgtatattacaaaagaaaaaaaaaagattagtttctcatgagaagagtttgtgtgcatgcctgtgtgtatgtgtgtttgtgtgcgtgtgcacgcgcacttaagtttgcataattttcaaacaatttgaagaacttttaaagcttatttatggagcccccaaggtcccactctataaccttttatctgaagcagtttttcctcaaggcctctcgtttgctttagccacctttcaagatgtcctatctttattggcttctagagccttcattctcatccgataggctctaggctcatctcttgattccaagccagtacctgctacctagtgtttgacctgactggtcctttaaaacttctctgaatgctgcacttcatcaactgcctcctccttgtttcaacccggggaactgtaaatccctatatatttttggtcacctctgtttagtggagtaattttttttttttcaaaattttagagtataatctgtagtgtatgtataactagtaattttgcttatatcttctttccctgaaacataaaatgtacccttaaaatgcatttttataagaaagataatgtatttttaaatcgtatatattttattatcctttaaaaaatacagtatgattttaaaaattttttaataaaattgctatttgctttatgagttccaatatttcttgtactggacaaatcatacactaatataatatcttatgactgctgtttacattaatattatatagttgtatgttttatttggatggatattccatgtgttcttgcataaataagtaaggaataaaatgttattgtttcatttctgaagctattaaaaaacaatggtaaccaaatattgaaaatcttgaggaaaatgtagcaaagaacttaacttggaatgaattatgttgcatgttacctttgctctagctattcctctgcctggaatgtctggtctatctttgctttctcccagttaaaactccatcaatgaagcatttcctgaaaccctcaggcctatagggccctatgaatccagggattctctgtttcagcaatgaccacataaggctacaatcactaatttcttcttcctctcctcctagtcttgctagtcatcctcctccttcttttttgtcagtttttctcactgtactctgagattcttgaagtcaaagttggttattgtttgaaaccccagcattaagcacagtacccattactcagtaggcactcaaatacgcctgttcgattaagaaaagaaagctcaagccagtaaagaaatgactggggagaggagttggaatattctttgtattataacacatttttcttgtcattgtcactatgaaataattttagaaggccatatgaagaaatttactagcaggatgtaataaacatccttcagattcagagcactggttagatagatatagtggggaaaaagactaacacttctttccgtaaatttaccaagtagttggaaatacagcctcaaactacgagaaagaaaagttacaaaattcaaaggaacttaaaaatatggaaggcaatattgtgcaggcaatttacatatatattgagaatctgtaataaaggtgattgtactcactgtagtagaaggagcagaaaataatgaaaagtaaaaatacagagatatttcactttgtgttgcaacatcaaataaagtgccacttctgcattgataaacaaagtgcttacgggtatccatttctcgcctttcatcctgaagaatgaaagtgggaagtcgtaaaaacataactcaaggcaagtgaaacataaacatggactactgtcctggactgcaaatgcctcgtgctaatgaatgatagagatgaaatgaaaacatttgattggcatatggctctatacatttccagcctaattaatatagagaatatgaaagagaaataagaggaggatttatttctgtgatcaattttctaagattttaaaataatttctacctgaaatattatttaaagtaatgtgctcttgaaaaagcataaactctgaagtcttccaaattccctgaaacctttggtgaattgtcaaccagatatgtctttccaaaatgaaatacttgcatatatacataaacacatatacatatacacacacacacatatatagatgtatacatacatatgcacacatatatgtagatattctctatgaaaaatgtttattataagtcacaaccaatttataaaaaatatgtccctagatataacttgagtataataaaaactaactgatttaactcatttggacaaattaaggaaaactagtttgaagttgcttatgtattttaggaaatatgctttcatttatatctatatatactaatgtgaactatcaaaaggaagaaataattattaggaatcctattttaataaatatgaatggttggttgtcagtttatatacataaacattggattgggcagcttttgccttcattatgtgctgttttagaaaatgaatgactctctgttgggtatgaaaaatggtatttgattatttacttccaaactgcgaaactaaaaattggtatagtcccagtgtaaagagagatattaagtcaatgaagtttgtaaaaatgactttgtgaagaaattttgattatgaactttggttctgatttggcatcagcaatactggatttgtaggcacagcaaatgttgtaccctggcccttgctatgtctggctgtctctgtcagtctcttggtgcctgtcttgagtgcccactgctgagagattccaggctggcctgcacagactgctctgcctagagactcgccagaagcagctgacttttgctgtccttcccattagcttctttcatttcttaaaacccagttaagttcatctccttccatatctttttacctttatgcagtatcctctttagtcctgttcctgtacttcagccttttctattgcttttttcattatggggggagtggggggtggtaatcttcttctttttcttttctttttttttaaatttactttttatctttctatttattcctgtctcgtcccatgtacaagagaatataaatagatgaaatcatgatagtgatgcctaataagacagaaattcctttatgttaaggaaaattatgccatagattttaatgcaaagttagatataatcaaaatatagtatcattaactttcaaaatattcttacttccctagggtttgttttggattgtctcacctgcctcgtaattttcttctaattaagtctatattgttttctcaaacgaacatttaagaggaaatataaaatttggtcatttggttaatgagtacattatattattatctaatgattgtaaatattaatatttcagctaaaataaggcctgattaagcaattgattattagcatgagaacttaagcaccttttgtacatttttccccattgggaaatgggttacatgctgtagacaagtacttaaacacacactcttggaagctaacctgctttgtatttggaaatgtctgaattatattaaatttctaatgatgaactgaataccttataccttttattggatgtgaccaaacaaaactgcataatttcagttcttatcaacctgtgcacattctacacctttaatgtgcagctggttagtttgaataatcaaaataaataatttgtcaaataaataagcccttctttcctcatttattgctttagtaagtcaaatttttattcatagcaaatgtgttttaactgaaaaacttgggggattgggtgctttagtctttcaatcatctgttcttaatataggtaaggcgaaatacttgaaagttactctcctcttgataatttctgcttctttgttgcttgcaaatttctccccattgttccatcctcttctcctcaccccatttgcttttcttttgaaatcatgagcccttagaactgacttgatttttttcagctgtaagtcagggaccactgtactgtcagtaaatagaataatctgaagtttgaattttgaaaagttgaaacacttgaactctgactcttctccaccttggggctctaacacctccacattctgaaacatgatgttctttctgaagtgttttcaggttttcaacaattgtttattttctttatcaagttttcttaagaaaaggtaaacttaaaaacttgatagagactaacagcttaaatcttgggctcaaagctgaattgctggattcaaagataagttctgccactttccagctgtgtgactttggcaggatattatgactcgtgtgtgctttggtcttctcgttagtaaaactggaatgattagagaattgtcatggggatttaatgagttaatacaagtaaagtatctagattagtgcctttcccattcaaattgctcaataaatgttagctctcatcattatctctgcttagaaaagtgtatagttgatgatggccatatagcaaatattattcaatgaatgatggattgcctctatgtactgtcagcacctggtgcatttttagcgcttttaagttgagttgcttaaaggtatcggacattcaaaaactgtcttagagtagataaagttcaagttactttttcttctagcattttatatagaacaaatcaaatacacatcccttatttgtatgtacaatagtgaaacagtaactttcctaaatggtgaccctggtcataaacataagaaatgactagtcttttgaattgaatttcagcaatgttaatactattctaccattattaaatatactgtttgtattagtccattctcagctgctaataaagagatacttgagactgtgtaatgtataaaagaaagaggtttaatggactcacagtcccacatggctgaagaggcctcacaatcatggcagaaggagaatgaaaagcaaagtcacatcttacatggtggcaggcaagagagcttgtgcagaggaactcccatttataaaaccatcagatcttgtgagactcattcattaccacgagaatagtatgggggaaaaccacctcatgattcatttattgccacctggctccaccttgacacttggggattattacaattcaaggttagatttgggtggggacacagctaaaccatatttattcctcccctggaccctcaaaaatctcatgtcctcacatttcaagatcaattctgccttccaacagtcccctaaattctaaactaatttcagcattaattcaaaagtccacagtccaaattctcatctgagacaatgcgagtcccttcctcctaatagcctgtaaaatcaaaatcaagttagttacttcccagatacaatggaggtataggcattggataaatacaccaactccaaatggaagaattagctacaggccccatgcaagtctgaaatccaacagggcagtcgattcttaaagctccaaaatgatctcctttgacttcgtgtcacacatccaggtcatgctgatgcaagaggtaggcacacacagacttggacagctccatccctgtggctttgcagggtacagctccctcttagctgctttcacagtctggcattgaatgtccatggcttttccaagcacacattgcaagctgtcagtggatccactattctgggttctggaggatagtggccatcttctcacatctgcactaggcagtgccccagtggggcttcaaccccacatttcccttctgcactgccctagtagaggttcaccatgagggtcctgcccctgcagcaaacttcttcgtgggcatccaggcatttccatacatcctctgaaatctaggcagaggtttccaaacctcattcttgacctctgtgcatctgcaggctcaacacctcatggaagctgccaaggcttggggcttgcactctgtaaagccatggcccaatgtgtaccttggatccttttagccatagctaaagtagctgggacttaggacaccaagtccctaggctacacatagaagcagggctgtgtgcctgccccacaagaccattttttttctcctatgcctctgggcctgtggcgggaggggctgctgtgaaggtctgtgccatgctctgccaagacattattcccattgtcttggtgattaacatttggctccttgttacttacgcaaatttctgcaactgctggaatttctccccagaaaatgggtttttattttctactgcattgtcaggctgcaaattttccaaacttgtatgccctgcttctcctttaaacctaagttccaatttcagatcatctctctcaagttcaaagttccacagatctctagggtaggggcaaaatgctgccagtctcttctcatagacagagtgacatttactctagttcccaaaaagttcctcgtctccatctgagaccacctcagcctggaccttattgtccatatcactatcagcattttggccaaagccattcagcaagtctctaagaagttccaaactttgccacatcttcctgccttctgagccctccaagtctctaggaagttccaaactttcctagattttcctatcttcttgtgagccctccaaacagttccaacttctgcctgttacccagttccaaagttgcttccacatttttgggtatatttacagcagcaccgcactctaccagtaccaatttactgtattaagttctttctcctgctgctagtaaaggcatacccaagactgggtaatttataaaggaaagaggtttaatggactcacaggtccacatggctggggaagcctcacaatcatggctgaagatgaatgaggagcaaagtcacatcttacatggcagcaggcaagagagcttgtgcaggggaactcccatttataaaaccatcagatctcatgagacttattcactaccatgagaacagtatggggggaaatcacccccatgattcagttttctccacctggccctaaccttggcatttgggggttattacaattcaagctgagatttgggtggggtcacagccaaaccatatcactactattcatacatatgttaaaggtaccgatatgaacagtcccctgaattttcaatgcctgcagtaacatatttattaatacatatacagaattataagtatatattgataaactaaaaaaggtcttctcaactacttgatactggagcaaatgttccctgtctacatttgactcaatttaatcctggtgtaccttctcactatacagatcctctatcacagaaagtggggttttgtacttcttaggatgaattgtttcacaaaagatactaactaattttccttcatgctcttatcttcataatagtgagaaataccatacactttgatgatttatttacagttttctgaaagtattttaataggcagatggagtttgactcaaggtaattacaccaaattgcaaggcacttgcagaaagaaataccaacttttaaatcatgtcttataattaggaattgccaaaggcagttggtgaaagaggaatcttggtaaaaatacctccattctcaccaaaacgcaatcttagctttcacaatggcaaaggaattacactccttacatcctcctccatttgaaactattttttaaaaattcaaatatcaatactgtgaatatgattttttgtatgcttgtttcttggattattgatgatctcattctttgtaatcaaaatgcatcattcttaagaaagatatagaaaagagtacaaaatgtcaaggtgaaatttgcatcgggaaagacaggaaagttacataaggagttcagcttgccccagcaagaataaaaataaaataaaatgaaacatcatatgaggacatttgagttggaagtgtcctataaactcctagaaatatacagaaagttaatttattcctggttctttaaaaatatttagggcatggaactccactataagtgtaattcgttatgaaaagactcagtttctttcttaagactaaaatctttgagaaatactcagaatagtttggcttaatattttattccgctacagaatcatgatacaaaaaggctccttggtattttaaaaccattgccattttcaaaatcccatgcatacatttttaacagttttcaaaagaaatatgtaaagtgctattctcccgctaaggagtgaaattaatgattggtgggccacatttcaacagaccatttaccttccattgtcataaatattagctgtctgacaggacactattaaccagtccccaggaaactaattgctgaaaagccttacaggtgcttttataaccagagttataaaaatacagaaaactcttaacagcaagagcacacgaactcttgacagtctagtaagaaattcaacattttcctgctcttgagagatagattgtagtacagtgtcactgacagatcagtttaccttttagtacagtacaaaaagagagggttgtaggctgtcaactacttcaggaagtaagaaaaaaaaatgtatgtagccttgaggtacagttgaaaagaattgtgcctactggattctgtggaacattcagttatgttttaatttcttggaatgttaggtactgacttcttatttttaaaaagattttttttctgcaatgttctagttttgtccagggaatattaaaatagtgtaaaatttctagttctctacaatatcaaaggaaatagctatattggatttgataaaatacaagttttataacagtagtaattttccaaatttttgctatagaatttcattgcatgtgggttatgaatttctcattgttgtctataatcctctattttgagcagtaacttgtcatccatcttagagtttattgccttttcattaagatgttatttaaaccatataaaatttcataagtcagtttcataaataaagattttcttttttttaagaataaagattttcttaacccattccaaatagattatatttctttagttcacatatgtcctctcagggtgatgtcatatctatcaatttacatttggatttttcttgaatctctgataactccctcttatatgcaactgcaatattgtgtgatctataatagtttggtgtgtgctcaacaggcctctctcacactacatgctccatttgaaagtcattccttatggcatttatatatagttttaaccattatatttttggtttatgtatatttttcagtacatgtatgctttcaggtattgtttctaatttctaggaattgaaccaaatttaacattgaaagaggttaggttttaccttgtttcttgtttagaattggtgatcctgacttttaataatcgccattctgactggtgtgagatggcatctcactgtggttttgatttgcatttctctaatgaccagtgatgataagctttttttcatatatttgttggctgcataaatgtcttattttgagaagtgtctgtttatatcctttgcccactttttgatggggttgtttttttcttgtacatttatttaagatccttgtagattctggatattacatctttgtcagatgagtagattgaaaaaattttctcccattctgtaggttgcctgttcactctgatgctggtttcttttgctgtgcagaagctctttagtttaattagatcccatttgtcaattttggcttttgttgcaattgtttttagtgatttagtcatgaagtctttgcccatgcctatgtcctgaatggtattgtttaggaaaaagtcagaaaacaatagatgctggcgaatttgtggagaaatatgaacacttttacactgttggtgggagtgtaaattagttcaaccattgtggaacacagtgtgaagactcctcactgatctagaaccagatatatcatttgacccagcattcccattactggatatatacccaaaggattataaatcattctactataaagacacatgcacacttatgtttattgcagcattatttacaccagaaaagatttgaaaccaattcaaatgcccatcaatgatagactggatacagaaaatgtggcacatatacaccatggaatactgtgtagccataaaaaaggataagataatgaccttgaaagaacatggatgtactggaagccgtcattctcagcaaactaacacaggaacagaaaaccaaacactgaaggttctcactcataagtgggagtttaataatgggaagacatggacacagggaggggaacatcacacaccggggcctgtgtgggggttgggggaaagatgggggagagcattaggacaaatacctaatgcatgtggggcttaaaacctagatgacaggttgataggtgcagcaaaccaccatggcacatgtatacctatgtaacaaacctgcacattctgcacatgtatcctgaacttaaagtaaaattaaaaaaaagaatttgtgatcctaataaatcccatataatctcattaatttttttgaattcatgtttatatcaaattcatgtatactgacttagaacaaataaatacttttaaatttcagagtaatataatcacattaatcataaaacctcacatgattatggtatatatgtgaatatgctgaaatattttcttagctagaatgttacttattttgagtgatacaaaaatgaataaattggagttagaattaatttattatcaaattacattgatcacaacttcctattcccaactgaagctttgttagttcttgtctggacaagtctgaatagttttgttttttctgggtttagtattttaaagaaaatgagatctggaaattttaaccttaaatcctaggattgtattttttattccaggtcctcaaataaaatttccaagatttcctcacatgtctagattttatggagtaaatgaagacttttcttctaatagactataattgataagctataaaaccagttatatcacataaaaacatcataactcttgtccaaagacataatttatcttcacatttaaggtcaggatttttttctggatcatactaacttgaatcatattcattgttcacttgagtgattatcagctaatttgctgattaggaaaatctggtataaagaacacatgttctgaatgaaactggaggacattatgttaagtgaaataagtcaggcatggaaagataagcttcacatgttcttaattatttgtaggagcttaaaattaaaacaattgaactcatggagataggcagcagaatgatggttaccagaggttgggaagggtagtggggaggggtggggaaagtggggagagttaatggctacaaaaacatagttagatgaataaaatctagtgtttgatagcacaacaggccaactatagtcaattataatttattgtacatttagaaataagagtataagtggtttataacacaagaaatggtaagtacttgaggtgatgggtaccccgtttccccagatgtgattattacatgctgtatgcctaagtcaaaatatagcatgtactccataaacatatacacctactatgtacccataaaaattaaaaattaaataaaattttcatgtaaaaaataaatgttttaaaaaaggaacacacgttcatgtagtgacattttctcatatttaacatgatgaggattacctaaaatttaggtttggcaaaaaaaaaaaaaaaaaatcccccaacaaaaaaacctatgttttaattgttgcattcaagtagtacaaaattgtatgtaaataaaaattataataaaagctaagaaaaattttaaataacactttaatataattcaaacaggttttagtatcaaatatgtgtcataaaacatggatgacgtataagttgatatttatattgtatttagtaattataaataaaaaaactaaccacccagagaatgaaaataagctgtcattgccactgctgagttcacctgtaatctcttccaaagtttaatttttccactataattttgcatactaaacttaatttagtatgattattgtatgaacactgcacgtcttcatatttggtggtaaaaattaccctcatatttaaaatcatataaaaaaaagtcgagagtaaatacaattggcatttgctgaacatttgccatgataggggaggcagaattatgcagtggaggcagaccgccataattatatcccagctgcagcactttcagtaactctctttcctcttctgtagtattaaaaggtgataggtaataatgtataccttcgagcagcactgtccagtgggcctttctgtggtgatggcattgtctatattctgtgctgtctaacacagcagtcatcgggcacatgtgccagttgaagtgaaaaactaaattttacttttgataatttaaacttaagtaagtacatggggctagtgtcaactgtattggacagcacagatttgaaagagtgttgttcaagtgttaaatgagataattcatagatagtgcttaaaataatgcccagggtagggaggagaatattttcctcacccattgctaagtctggggctaagtctcctataacaaaggcagattaaccaaagtaatgcacacagatttatttaagtttagtgtaacacaaaagctttcctaaataaagacatcagagaaacagataaactggtgtatttttttgtgctaggtttggtgaagaggtggttagtcagggagaagtgtgattagacaaaagggtatgacctaatgttcataaataggtggggagtggtttagcaagacctgtttgtccagagccttctctgtgtcttctttttttttattattatactttaagttttagggtacatgtgcacaacgtgcaggtttgttacatatgtatacatgtgccttgttggtgtgctgcacctattaactcgtcatttaacattacgtatatctcctaatgctatcccttccccctccccccaccccacaacagtcccccgtgtgtgatgttccccttcctgtgtccatgtgttctcattgttcaattcccacctatgagtgagaacatgcagtgtttggttttttgtccttgtggtagtttgctgagaatgatggtttccagcttcatccatgtccctacaaaggacatgaactcatcattttttgtggctgcatagtattccatggtgtatatgtgccacattttcttaatccagtctatcattgttgcacatttgggttggttccaagtctttgctattgtgaatagtgccgcaataaccatacgtgagcgtgtgcctttatagcagcatggtttataatcctttgggtatatacccagtaatgggatggctgggtcaaatggtatttctagttctagatccctgaggaattgccacactgacttccacaatggttgaactagtttacagtcccaccaacagtgtcgaagtgttcttatttctccacatcctctccagcacctgttgtttcctgactttttaatgattgccattctaactggtgtgagatggtatctcattgtggatttgatttgcatttctctgatggccagtgatgatgagcattttctcatgtgtcttttggctgcataaatgtcttcttttgagaagtgtctgttcatatccttcgcccacttgttaatggggttgtttttttcttgtaaatttgtttgagttctttgtagattcgggatattagccctttgtcagatgagtggattgcaaaaattatctcccattctgtaggttgcctgttcactctgtggtagtttcttttgctgtgcagaagctctttagtttaattagatcccatttgtcaattttgtcttttgttgccatggcttttggtgttttagacatgaagtccttgcccatgcctatgtcctgaatggtattgcctaggttttcttctaggatttttatggttttaggtctaacatttaagtctttaatcaatccatctcgaattaatttttgtataaggtgtaaggaagggatgcagtttcagctttctacatatggctagccagtttgcccagcaccatttattaaatagggagtcctttcccatttcttgtttttgtcaggtttgtcaaagatcagatagttgtagctatgtggcattatttctgagggctctgttctgttccattggtctatatctctgctttggtaccagtatcatgctgttttggttactgtagccttgtagtatagtttgaagtcaggtagagtgatgcctccagctttgttcttttggcttaggattacttggcgatgcgggctcttttttggttccatatgaactttaaagtagttttttccaattctgtgaagaaagtcattggtagcttgatggggatggcattgaatctataaattaccttgggcagtatggccatcttcacgatattgattcttcctacccatgagcatggaatgttcttccatttgtttgtatcctcttttatttcattgagcagtggtttgtagttctccttgaagaggtccttcacatcccttttaagttggattcctaggtattttcttctctttgaagcaattgtgaatgggagttcactcatggtttggctctctgtttgtccgttattggtgtataagaatgcttgtgatttttgtacattgattttgtatcctgagactttgctgaagttgctcatcagcttaaggagattttgggctgagacaatggggttttctaaatatacaatcatgtcatctgcaaacagggacaatttgacttcctcttttcctaattgaataccctttatttccttctcctgcctaattgccctggccagaacttccaacaatatgttgaataggagtggtgagagagggcatccctgtcttgtgccagttttcaaagggaatgcttccagtttttgcccattcagtatgatattggctgtaggtttgtcatagatagctcttattattttgagatacatctcatcaatacctaatttattgagagtttttagcatgaagggatgttgaattttattgaaggccttttctgcatctattgagataatcatgtggtttttgtctttagttctgtttatatgctggattacatttattgatttgcgtatgttgaatcagccttgcatcccagggatgaagcccagttgatcatggtggataagctttttgatgtgctgctggattcagtttgccattattttattgagaatttttgcatcaatgttcatcagggatattggtctaaaattctcttttttggttgtgtctctgcccggctttggtatcaggatgatgctggcctcataaaatgagttagggaggattccttctttttctattgattggaatagtttcagaaggaatggtaccaggtcctctctgtgtcttctaagagaaggatgttcctttcctccggttatagggagggcatctcaggaatgaggatattatgacctgctttatgagagaagggcaaatggaaagtaagagagaaacttctgcttctgatattttctcaggttccaagatgccatattttgggtagttgttttgaaccctatcacaatcatatattaattattatagtaataatcaccatggtaccattgggataaatgttaaaaagacattttttcttttaatacttatagtagttatgcgagatagttattactttttagatgagaaaataaaagcttaattaggttaaacaacttacctcagattataaaggattcacaccaaggacagatggataattaaacctctgttcttgctagttcctgtgcttttgctaacatatatcattgtatatgtttgaggattgagctcaagtaagatgtttgcttttgaaatttttgttctaactatgtatgtatgaacacttttctggttaactagctctgccttccttctagtttgcatgagtaggtattttactgttactgagatctttccatggaaaaaacagacaataaacaaaataaaaatattttgatgaacatttacctcagttacatttctttaaagatcccaagtgatatctattataaagatttcaattataagttcaggtaaaaagtttagataatatgtgtggatttgattttgttacccattttatttctcctacactatttcaagtaaatagagtttctttgaattgaactatgtgaaaactgtaataatcttaggcttttactaataactattacacatcacactctgaaagaaaaccacttaagggctagttcacatcttagaaactctcaaaggttatttacttggttctagagagaatggtgttctggtaaggagaatgatcttttgtgtataataacaaatcctgacaaaactctactgtacttcagaataaaaacaagatgtgtgatagattgttgctgacaagttggtgatgacacccactgcatttcatacaaatgtgtatatgtattcacatttgatggccaggcatgacattttaatatatttttcaattattgtttaaataattatgtttaaaaccgcagcagagaccattcttgggggtgatgacatgaggactatattatctctgtgacttattaccaaagactatagtgtatatcctatttctatattttttaaaaaacatctcatttaaggttagagattaaaattactgtaaactacaactgagtaggcttagatttgtattcttttacatgtatatttattttctctatcctcctcagactataaacaatcatcttcagcctcaaatatctatgttaatattagtaagtaaaatgctgtaaggatatagttgtttttacacttgatctatatagcactcaaacatatttgccatttaaaaataaaaattgaaaataatataaagacctctggattattatcaaaacaaaaatccacaatgacttgcatatagggctcgttgcaaaccctattactttcattactttcagtgaagtggaattgatgtggcacaaaagaaatacaggcagaaggggtggcagatttccaaagatggggagaaatatctgagaaaccaaaactacgtttgggggtgtgtctgtgtgtgtgtgtgtgtttaaacaataataaaaattgcactagcatttccagaagtgtgctttttagaactctggattggtaatatgtttactgttacattaaaaagttaaaaaaaaagttttaaacaatgatttattgtgtttttttttttaaaaaaaacctttcctatctgaaaatgcttggtaaatgtctcacagaagaaatataatatgtgacatttttccagatgtttttaatgtcagaaactcccaccccaactacccccacctcatttttttctgttgatcaatctacaaggttatttagatttaaaaattttatatatagttggtcaagaaaatttctaatagttttatgcaagtgttgttttattgctttgcatgagtaacatttaaaccaaaaaaattgtaaattgctttaaattattatatgcttcaccttttaaattcttatctttccgaagtcatgagataatactatacttagaccatgtcagagcttgggagataaaccttacaatctttgtagagctggttgttctcaaaaatataatagctaacaaactaagctttataattttgaattttctcccgctttcttcttctactatttttttaattcataatctgtttcatagattgttaaagcagaacttgggcaaaaccataggttttgaaggagttgttctgaatattatattttctgtacttccactacccctcccagaataatgcactgacagattttgcaagtaaaacttaatgcaagagatccagcatttactgtcagaatttcagatcaggtttcagtatcatgatatttgataaaaattacagaatattttcaatgagccctttggtagaaatccattgtttggcctaattccagtttaagtaattgtctttctttaaatcttgccctgtaatttccattcttgaattgtggaagagtcttaataattccattttcagctccagatgttttggatgggaagctctggatgctgtcaatgcttaccatgggattggcatagctgatcatgctttagggctcattttgaagaggctgttttacataaaatagggaaattatgcacacatcagtaagttacagaatttctttttctaattctttgctttatgtttttacttttaagtaaatcctgtatttcacatcctttataattaaaagaaaactcatttatgtcttgtagtttttgtccatggagtagctgttgtttatcttttcacatgcctgaactacaaaaaggggactaaagcactgaaagattaacactcatgctcgaatcattgctcatggtgcagatagattaagttttgcatgtgtacatatgtgtgcagacatttcttcagttgttacaacataattgggaggtgatctggaagcgttctaagttactgcatccctgcgtttttatggattgaagttgaaagagttatgaaacagaattatcatcattgcacccttattcccattaactatatctctatatctgcactggcccatagagtcactatgaagtacttggaatgtggatagcacaagttaagattttgctgtatatgtaaaacagaacacacaattgtgaagacttagcgttaaaaataatgtaaaatatctcaactcatattgactaaatgttatgatactattttgaattgtattaagtcaagcatattgttaaagtttatctgttttgttttaacttttctatgtggctgctagaacaacttttttttttactttttaaattttttgttaaattttactttaagttctcagatacatgtgctgaacatgaagttttgttacgaaggtatacatatgcatggtggtttgctgcacctatcaacttgtcatctgagtttcaagctctgcatgcattaggtatttgtcctaatgctctccctcccctttgactactagattttaaatttcatatgtggctcggatagtatttctattagatacagctgcattatgtcttcaaatattgcagtcaatatttttctccctgctattttcatttaacttctttgaccctttcaagcctttctatgttttcctgttaacaaagtccacatttaatactctctgcccagtgatttcaaatttattctgtgaaagttttaaaactcaagtgaattaaaagtgtgttcaatctttaatgagttgaaaaatattagattttgagctgctttacacggcaattttactgtatctcatgtgttgttttctttctttcatatatttatcataactttagttttaacttgggaatattgtttggttccattttctggatttaaaaatagtagatattagcagatatgctgggcgtggtggtttatgcctgtaatcccagctctttgggaggccgaggcgggtggatcacttgaggtcaggagttcaagaccagcctgtccaagatggtgaaaccccatctctaacaaaaatagaaaatattagctgggcgtggtggcggagtgcctgtaatcccagggactcaggaggctaagacaagagaattgctttaagccgggaggtggagattgcagtgagccaagattgcaccactgcactctagtcttcaacagagcaagactccgccttaaaaaaaaacagtggataatcacaaaatttttgaataaattatgatacatttataatacattactagatatactatataacttcctgttatgagggcaataaaaacttacttggatgaatgatttaacacaggtattaggttaaaataatttcaaggcaaaacattaggataattgaatactgtttttcctctcatcatcacaattaccaagcaccaaggaagcaggagagattggaaagtgcagcattattgtcactactttgctagatgctagcaatttcatgtaaagttcctgtgatccgattttggagatgctattctacagggcttctatttctcaaccatggactccaataaagatgacatactgtaatgatgccctgaaaatctgtagtcattctgtaatgtgaagattgatttacaagaggatcacagaaatgatagaaattttcaatttttgttgaatcccaagtaatcataggcaggggggatttctcaacaggttatgggaggattgtaccggaaatgaatgttgaagaaacttctttcctcccatttctattgaggtaatttctttctttagctcagttgtttaaatctatgacagctgcataggaactgagaactaaaataatcttttagcattgcagccagctattatttttccttcccctaaccctctcatattggaaaaataacctcattttttctcggttgctgaccacactcattctgcatgtatgctttgcgctggggcctctgagtgtccctaggaccgtaatcctggtcccaaaacaggcaccaaaattgagctgctcaaacccttttctgggaattttggagatgaggctggagggaatataatcttactctctttctagatgcagtgttcataaacattgtgtgtgtgtgtgcacgcgtgcatgtgtgtgtatgtgtgtgtgacaaggatcacttacgtgaagtctatgaaccccttcttggaataatatttctataggaacataataacatacttgggattgtaaaggaccccatttttattaaaatttatcaaaatataacagaaaaactaaatatgtgataaatattgtacgtgatccttaacagagagagcaaaaactagtattgggggcttgaggcagaaatgagagtgaaacaggtatgtagagaaagcagagaggagtatggaaaggaaggctctgacagtgattaaagcctagtttttccctgaaatctacctatgtcttgtcatttttccccgcttaaactaatttgaagtcagttactgtcacttgtaatcagaatatcactaagtaatataattgtctttgttagttgatgacttaaaaactccttgtgttttgatgctatgtgtcatttgaacgctagtgcagtattcactgtgtttaatagacatctaacatgctaggaaaaatactgctaaaatttaaagccacaaagtgaaatatacgactttctgtctcttaagatttttaaggtaatgatatagagtgttgtccagtaaaactttctatggtaataaaaatgatctatatttgcattatccaatactgtagccactagtgctgtgtggttatggatcactgggaatgtggcacgagtttctgaggagctgaagttttaaaatttaatttaattttaattattttgatttaggttcaaatagtcacatatgggacagcaatcctataaagcaatcctctttgatttatataatctaacagttttctaagaaagaaagtctagaattgatgccaaaagctgctctgctttactgtcccatgggcaccccatttattcccatggttttttgctttgttttgtttttgttttttgagagtgatcgctaagtgcatgtcaggaagatagcctcatggagggcaaagagcattagatgatctgcagatgatctgtaattcagtcaaagcccaatcacacatactaaccatatgtggtggtaaccttaggcaagttatctcaccttactgaacctcagttttatcatctgtagaatggcaaaaatagtatctctctcatggtgttgttagaataaaattaaacacctttaaagagcttagcatagcatctaacactattattaatcaataaatgatagatatgattggatttctttacattgggtaattgttaaaatatccaaatagataagttcactttcgtgcatgctaaacaaataaatagataggctaaacaaacaaaacatttcatcttaagaaaaaaattaatttttttctcagtatatttggagcaaattttaaaaaacatattttgataaatactctggtcaatatattaagatagatattagagtggattactactttggaagcatgtgatgcttcatttatttgttttgttgaacttttcctactttttagaaatatgatttatcctcttgaaatgggaaattctgctctcagccatcaacaagcactcataattacattttacttctatttaagtgcacagtgattatttaaaaagttgaaatttcagtttagtccaagcttagatgattatttaaagtgttcaggtgttgcttttatcacacagatgtgtcagatatctgttatgaactgtcaggaaaatgagtgttcagtgatgctactcgactgtctggattagttatattctctaccctgagtaagctgagaaactactccatggttcgttgttatatatgtaaaatatcagcattggttatgttctcctaaaatgtttctatccttaatcattttgcggctctcttcatccttgtgtagttattggtggattatctgatctgtgtacactgaaactttgagtcatctaacaactgttccacagtgttctggaacatttgtattaacggtatacttcagcttggaatcttaagttgtaaaattatgtatggatgttcccataactaatggccactttaggacgcacggtgttattttttacaatgatgtaagctacttatatttgtatctcaaaataccttatctcactttttagaactgttgttgtttctctttattaatttgccttggggcttcattacatattttaaattttaagtaaaaattccagagactcattgttgtgttttctatgaacaaaagaggtttgttgatagggcccgtctctactgtctagtactgaaagccagtgtgacactaaaaatgcagtaagtcattagctgtgagatggcttacttagcagagcatagcaatgaaaccatacagctgctgaatatgacaatattttcacagttagaggaaagatatttaagattttatttcacactttaattccctcccttctttttctctttatccttctatgacattgaaattaagaacgtggaaagtgaggctgggcgtggtggctcacgcctgtaatcccagcactatgggaggccgagacgggcggatcacgaggtcaggagatcgagaccatcctggctaacatagtgaaaccccgtctctactaaaaatacaaaaaaattagccaggcgtggtggcgggtgcctgtagtcccacctactcctgaggctgaggcaggagaatggcgtgaacctgggaggcggagcttgcagtgagtcgagatcatgccactgcactccagcctgggcaacagagcgagactccgtctcaaaaaaaaaaaaaaaaagaaaaaaaaggaatgtggaaagtgagaaaacactaacaacaaaaagttagcctgagcagcctttggggttgttggcaggcttgcaccaagtgctgccgcaccctctgtctttagctcttgctagcctatgtcatcctatccaaagtgaggatgctatgcaaaaccttagagcgtcatttcttcaatttagagtaatgaattttaactcgactacgcgttgcaatcaccccaaaaggactaaaagttgttgatgtctgaggcctaccccagagactctaatttagctcatcttgggtgtggcctgggcatcgacatatctaaaaaactgtcaacagattctaatttgcagcgcaatttgagaaccaactcagtaaacatcaacatgtgtcatgcttcaccagatgatgggctcagatgcaatattgtcttcaactgcctcaatcaaaaaggtaaataaggcaatcaatgctcttaaattttatactctgatcataaatatttttaaaataaaggacatgcttatcattcacagtaatttgggcattcatattggtgactctctggattacttgattgtgttgatacaatgaattgcccaatattgaccgtgggtatcagctgccatccttaagactacttaggaaaactctacctctgcaaacactaagtcagtatattcacgctgacgcaatcagataaccccttgcagccttactctctcactttgtggatcaaacataatgtccttacttcttcagtaatatcaaatattcatctcccattacacacataccactatagtgatttatcacaatcataagtctacgggttttctattttcctactatatttaggcatttatttttcagtacggtctaagctggtttgcactccccagacagtttaatatttggctgtgtcttccactctttccaccctctttcaggatatctcttcctctgatcacttctgatttcaacctcgcctttccctacctttcctggttgtacgtaagatttcctttgaaaatctacatctgttctttctttttcacctaaatatatctatttcttcagtaacttttctgccaaactcctctagtatttaaagtattcatttttacattaaaaaaaaaccatcagtagtctttatagtctacacactgaccttcagactaaccatgcttctaataattctctgtaaaaaaatttaatagggtctttattgccagattcaaggatagcatttcagggctctaaatgctgtaggaaaacagattaaaagcccttattccactcatgcattactttgaacagttatggaatatctactgcgtaggtgtctctttgaaaaataaaattagttacacatcaagagaacaattcagctgtttattgaacagttattgtcagtcagatgctttcccccaaatcacccaatttcatcctcatgacagccatttaaatgaattacctgaagcttagagaagtaacctgcccaatgtcacaaagcaagtaagtggctgagttcaaattcaaactcacatctctgcatctatacttttagtatatgtgtgtgtatatatatatatatacatatatatatacacaccatatatatagtgcatatatatctctcaaatgtggaacgttctctacaattaaggaactcatacattaataataataacatttgatattttgttaacagcttaaagaaatcctgatatatagaccttaagactccaaaatgagagaaagcaatgtcatgcaatagtaatagccatgtgttcatgtgcaaacactaataggcccaatcaacatttagattttgacttgatttcaaaatattagtgtataaattaacagtgtaaaattatgaaattatgagcaatatcaagcaacaggagaatctatattttcttcaaagcataattgtagcccagggtatatcagtttatagtatcccattggcatacttcttttggcaggtatttccctcatgaagacttcacaggaatctttaattgtttgcaaatgaacagtttttagccagaagcacccttctgtatagcaaatagggattgcttagggaaaaaaaataaaatgagtaagtcaatcatgagtaagtaaatcagcatgagaacaaagattatgccttatttgctgttgttttctcagtacataggaaattttatcatagtagaccatatatatttgctatgtagaagaattaattgagaactactgagagaactgaatgatatactattgtaattgctttcaaatatcctttagaccaaaagcagatattgctcttgtggtcacatggcttagagttctttttgatttaatttcctatatgcattattaatgctcagtgaatttagttcaagagacatgtccaaattttccttttttatatgatagatattcaaaagaattactcaaattaatacatccttcaaagtgaaacaaaatattcagtctattatgtagcacatcttaattttatttagatgttgtttgattctaaaataatgttccaaattttttttagcttttcagaacaaatgtattcaccttgttcactttgccttgcaaattatttttaatatgtatgaataactttatgaaattaatttattcagttttggtttcaaggaaggcactatattcaaagaaaaaacaatttgttaaataatttcaaaatctgaaattaaatttaaaaaattgcatatgtccctaagggctattggtttatgtatacacatgaaggtatatatgtgaagactatacacggttatatttataggaagcttagagagatatcagttataacagaaatctgtagttagagaatgacttacttttacagaaataattatattgccctccttttaatgatgactaaacaggtaagtggtagtagagtaaaagtttaacacgattggttgaagccaattagttatagtattttataatacttaagccactatgcctcatttgtgaactctgagagtctttatttctcagagtctattatcatctctgaccagatgataatagaaagttattttatagaagggtttttcagtctcaccaccactgacatatttggctgaataattctttgttgtgaagtagaggctctcctctttgtattaggacattagtggcatctctggtctctacccactagatgccagtagcaactccccaaacacctaaattgtgacaatcaaaaatgtctcgtgatattggcaaagatcccctggaagacaaattcaccggttctcaagaacactgttgagagtgatgaaatatggaaatgaggccatatctccatcattgcagtggaactcctaatttcaaaatcaccagtgaactgctggttacagaggtcattttttggatctcaatttattgttttatcggcagtatttttcagttgatctttctttctttctttctttttattatactttaagtgctggggtacatgtgcagaatgtgcaggtttgtttcataggtatacacgtgccatggaggtttgctgcacccatccacccgtcacctacattagatatttctcctaatgttatcccttccccagtccccaccctccggacgggccctggtgtgtgatgttccccaccctgtgtccatgtgttctcactgttccagtctcacttatgagtgagaacatgcagtgtttggttttctcttcttgtgatagtttgctgagaataatggtttccagcttcatctatgtccctgaaaaggacatgaactcatcctttttatggctgaatagtattccatggtgcatatgtgccacattttctttatccagtttatcattgatgggcatttggattggttccaagtcttcattattgcgaacagtgtcataataaacatacgtgtgcatgtgtctttatagcagaatgatatataatcctttgggtatatacccattaatgggattgctgggtcaaatggtatttctagttctcgatccctgaggaatcaccacactgtcttgcacaatggagtacctctggtataatttggctgtgagtccaactggtcctggactttttttggttgggaggctattaattgctgcctcaatttcagaacttgttggtctattcagggatttgacttcctcctggtttagtcttgggagggtgtatgtgtccatgaacttatccatttcttatagattttctaatttatttgcatagaggtattataatattctctgatggtagtttgtatttctgtggaatcagtggtgatatcccctttatcattttttattgcatctatttgattcttctctcttttcttctttattagtctggttagtggtctatcaatttttttgatctcttcaaaaaaccaactcctggattcattgattttttgaagggtttttcgtgtctctatctcctttagttccggtctgatcttagttatttcttgtcttctgctagcttttaaatttgcttgctcttgcttctctagttcttttaagtgtgatgttagggtgtcagttttagatctttcctgctttctcttgtgggcatttagtgctataaatttccctctccacactgctttaaatgtgtcccagaaattctggtacgttgtgtctttgttctcattggttttaaagaacaactttttttcttcttaatttcattatttacccagtagtcattcaggtgcaggttgttcagtttccatgtgtttgtgcagttttgagtgagtttcttaatcctgagttctaatttgattgcactgtggtctgagagacagtttgttattatttccgttctttcgcatttgctgagaagtgttttatttccaatgatgtggtcaattttagaataagtgcgatgtggtgctgagaagaatgtatattctgttgatttggggtggagagttctgtagatgtctattaggtccgcttggtccaaagctgagttcaactcctggatatccttgttaattttctgtctcgttgatctgtctaatattgacagtgaggcgttaaagtctcccacagttcttgtgtgggagtctaagtctctttgtaggtctctaagaacttgctttatgaatctgcgttctcatgtattgggtgcatatatatttacaaaaattacctcttcttgttgcgttgatccctttaccattatttaatgcccttctttgtctcttttgatctttgctggtttaaagtctgttttatcagagactagggttgcaacccctgcttttttttgctttccatttgcttggtaaatattcctccatccctttattttgagcctctgtgtatgtttgcacatgagatgggtctcctgaataaagcacactgataggtcttgaccctttatccaatttaccagtctgtgtcttttaattggagaatttagcctgtttacatttaaggttaatattgttatgtgtgaatttgatcctgccattgtgatgctagttgattattttgcccattagctgatgcagtttcttcatagcatctatggtctttataatttggtatgtttttgcaatggctggtactggttgtccctttccatgtgtagtgcttccttcaggagctcttgtaaggcatgcctggtggtgacaaaaatctctcagcatttgcttgtctgtaaaggattttatttctcctttgcttatgaagcttagtttggctggatatgaaattctggattgaaaattcttttctttaagagtgttgaatattggcccccagatctttctttctacattgaaataccctcttcagttggcttctgagaaaccacactcttgatttttctcagacttcactggcgtctccatctcagatatttttcttggttccttttcatttccttggcctttaaattagggtgacacacagccttactcatgacaactcatttttcataaatttccttggtgaccctgatcagccgaacctgttcagccccatggcttaaaaaacattatatgcttcccatgtttataacttcagatatcactactaatatatctaacagcttaatggtacttccacttgattatgcaataggtttcttcaagttcatatgtccaaagcagaaatactggtcttcctgcctgcccagctacttcttccacagtctcccaagtcagtaaatggcaatcctcttcttttactttattcaaatgaaacaaacaaaataatccttgacttcactctttaatggtgcatattcaatctatcagtaaatcatgttgactgtatttcaaataaatccagaatcagtttctccccaactccagcatgaccatcctggatatattatcatgtatctctgggattaatttaatatctcccaatttgctgtgttacagttttttttttctgaacagcatttcgagtggtccttctgaaaataaaatgagcttttatcaacactattaattttgagatgcctgtgacaatgctatgttaaaccctccaatggttctctgtctcattagggtctttgctcagcaactgtctgctctctggctttctgcttaactctgacctcttttccactctcttctccagcttcctgttttcaaacatgtgatatgttgcttccacatcaagattaattgcacttgtgtttccttttccctaaggtttttttttttttcctagatatctgcatggctctgtccttcacatttctttcagtgggacctgtcctgtttaaaatcacaagcttccacttttctcttatttatctttcctactttctcccttctccatatcatttattacctatcactatctgatgctcttcactaatattctttttcctctgcttttatattttatggagtgcttgttaagcccaaaacctaggtctatgcctggctaatagtagatgcttattaaaaacttgcaaactgagcaaataaatgtatgaaatgtaaacagcattgagcggctatgtttttttcaagtagacattaagcacttgaaattattttaagaaattagtgcataattttacacagcatattttcttatgtttgggtaattgactgtacattataaataatggatatttttagtatagttgagaagttatttctaataaagcacaaagataattgttagggtgcttttagcagcttatttgtagaaaacagtagagaaaatagactgtttatgatagttccatagacttttaagttgagcttatagatatcaccaagagaagaggaaaagaacaaaataggaaaaggggaaggctagaaagaggaaaaaatatatgaagcaagtagtagcaaataatgttctgaagagcatgtactcgtttgactcagttgtattctggtgacttcttccatgcctggagcataacatgtgctgtgtagtattagttatgtgaataaattatggataaatatcttcagtgacttttaaaccctctgctctctcacccatctggctggccccatgttaactctcatgccactttccaatccttgttcatgtctattattttgttggctaagtacctcattcattaatagaattttacatataagctaaatgtttatttaaagtatttggcctgtttcacattgaagttttgtcttttggagcagtgaggtggtgagcagtgcctgaactcagggttttccatttggaaaattagtgcttttagtttttgattttttaaaccgtattttttgtataagatgctattataaaccagcccaatttcagggataaaaaatgtaaaaaaatggcagctgccagttttaagacaccgttgattatcctcaactcagcaaagtgaaaggtatgtatgtttgaatcaagaaaatacagtagttggcttttctactgcctgcattatgttatccaggatgagagggaactaaaaataatgatcacttactgtttgctaggtatgtgttaagagcttaacttttgtattatttaatttgtaataaaaaatattatcacacttggagataggtgacaaatcagaaattcaggaggtgaaattgaaatccatgtttctctgaatccataacccaaaatctttccactttacaagttacctgaagatacctgaaggacaaaagtatatttggcacctctttcagtttgcctatgattcagtaggaatgtgggagggatgtgtggtctattggacagaaccgatgtatttgtttacttttatgcattaattgttaagttatctgagtagcgtatgcacacagttttaaagacttgaatagtgctcaaaggacataataaaataaaataagtctctgtctctatttcccctcctttgatgcaaccatgatctatttttaaaccattattctggcttttacacatctctatatttctaaatacatgggaaagttgctaactattaattcttcagctagtggcataatattatgtattgacttccttttatcatcatgaggacctggttgttttgttgcatccacacgtttgttgccttgctccatcctccaatttatttagctaatattttcactaaatcaaaaatattaaaaaagaatttatattagtatacctttgtccctattgttcatttttgagcattattgtgtgctctgatccattttccattcttaatctatttcctaaaattaataattaggcaattagttttcatcggcttaatctcctttgcatctattgctacttttcctcacaccttccaataaaactttagttcggttttcaatgaggtcaacagaaggtgtgatttctttattcacattattttcttccgtttgtttgttcaaagcattcctcctaaaataactataccctttctatctttgttgctgtcatgtgactctcattctaagacattctttgtcagtatattatatttcatttgcttatttatattgatggatttttttttctcgtggctgcctcttttttgatttactactttaataggaaagaatagcttccagtagtttcattaccataaaagcatgatgatggcatgcctgctgattgaatcttactgcatcaacctattatgccttagtgtggttgccagcctgggttctcatctcaccaccattttagagacatccttgactattcttttgactgggtcttcagttttctctattttgtggctgctatttacttgctcatattgcttggggacctcttccagcagtcccctgaagaagagtctgttaaacacaaaagtttggagacttttcatgtctaaaaatgctttactcttctcacatacttaattgatgtgtcaataaagtatattctagattttggcagggtaaaaaactctaaattggaaataattttcctttagaagccattggtccattgacatcttccttccagtgttgctgttgagaaagcccaggccatttgatttctttcctttgcaaataagcttatttgcttgctgaaagacagttagattttttctttgttctaattacaatattttgtcttagagttttcaatctgttgtgctgggttctaggtagcccttttaaatttgggaactgatatacttcaattatgattatttagtttataatttgttgccttctgttatctcagtggaatgtatcctgtacttttattcagaaattggacttctggatttgccctctaatttactgatcttttctttcctattttccattgctatctttttgctctactttctggaggtgtaataaaatgtatctgccacctgtgttgtgcaagcaaagacagatggacaagcacacacacagcagacctattggatcagctgccattggggaaaacacagtggcagaataaaagcaagttttgagattcccatttatgactgcattctaaggctgaattggacaccagattttggagagggaccctgattttagagctgtggggcttttaaatgtaatggttggaaaagcactaggtcctcccctattgtgattagagattaggataaactagaaatgtggtgttgtggaacagttgctctatttaaagcctttcaagtcaaccctgttggtgacagacgagcactaggacgtctggaaaaattaggaggctgaggtccaaaaccttttttttatgactgtacaacatctcatatgagcttccagatttgccatattggcattttggtatggaaaagtataaaatatccatccttctcctggtgtaattggggctgaagtccaaatctgttagctgatcaggacttatcaccttaagcaaggagctaaaactgttttccatagagcttctcaggaggccaactcctctggggtcagcctgatgggattgcaggggccaagagaatttttcctccccctctgaaggctagaatctgctgaaatgaactgacagtaaatagattaacaagaaaaaaggtatatatgtttatcaatgtgcacatgaacatgggaatccctctatctgaaacttaaggactagattgttgatgcttaaatagcaccctctttaaagcagagagaacgataggggatggaggcaactgtgaggggtagcaaacaattttcagggaaaataaataagcccaaagaacagaccgtgggctgagacaaagtttttctgaactctgggggaggtggcaggaaattgaggggtggagcttcactgtgaacaaaggttttctcattttattgataaaatctcccagataatttcttgaaactatcatcaggagaatagatacacaatctgtctggttgtggtgacaacttttagtcttttctccagtgcttaatgtttcctggttaatggatgagattcctaaggaaagggtcacaattatttggaagaaactttcttcaggcagataagttccctgtcacctagtataactatacagtattgggaaaaagaggatctaattgaatgagtcatgatgttatttgctatggattactttaagtgcagtgaagctatgcacatcataacactgtttaggtataagctatgtctattaagataaatatgtataacattttccagtaatcttccagaatatttacaactgttaccaacaatatgttctgcaagatttcttgtcttaaatggagttgatggagcatatacactcattcactattatccagtgtgctttgtgctacaagcaactgaaaaccaaattcaaatttaaaagtaaactaatgcatcatctcacagaaggaaatcaaaggtaagatggctccatccggtgcattcagctacttaattatgagactgagcagccggattctttgaacgtctacattctgccattctgtatgacaacttctactgcagacttgactacgtcatattggcaaactcgttcaggtatcatattcaggtacagtaatgtccaggagggtaagaggggctgcctacttcttggtggaagtataaaacttttcccagaagactgtggtgcagaattgggttacatggggacaactgagtcacagagccttttgtaaaacaaaaattggctagagtaaggtaattaccacagctaagttagagtactaatctgagagatgaaagatataagctctaatggagatgttatttaagtttctttttaccttgaatggaaatggttttgtaaaatgaaattcagggaaataactgaaattttgacaaataaaattcttgtgaaaatatgagccattgctgattgtgttaacaaaactcaatcattttgtttggaaaattctcatagccacatcctccaattttacatttaaagagaaataaaagcacttttatatattgaaaatatatcaagaaattgactattaattattacccaacatgtcagctctattagttcatgtgtttctatttcatactagcataacattcagattggcaataattttaaatatggtttttccagaattactttccatggtttctaccagaattattatttctcacagaaatttgggccatatttataaacacatttaacattttttttgtatatttctttttctagtgtagttcattaatttatatgtttcagctgagtaaataacattcagtgatgggcacataaattattttctaagtgccttctgaaaagttgcttgatgcagttatatatcacatttatatgctcagcttcttatctgctttcttacatggttttaaatggatcaccgactaaatgaatctattatatgggcttacagatgaaacatggttgtagaattgaagggctttggctagagtcccttcatatcacagagaaaagtaacctagtaataaggtcttgtcaaattgatcctattaagtgaaatttttcatggtccttatcttccaacaaagtttttgacactgctgtgtttaacattttattgttgttaaaattttaatgaattactttaatgataaatcatattaattgaagatgatggaattgcattaatttattctagtcttatgattttttccttttcaaatgattcctgtaaatgtttagaagataaaaatatctcaaataagagcttccctctagtatatttccttttatccacttttgcatttgttcttttcttttttgaaaacacaatgacattttttagggtatcttttccaaagcaaattggctttctcttaagacaactctttcttatcagtgggactgcagcaaggagcaagctctcacttctcctttctcccaatcttatgcattcttgatatgggcttatttatatttttatttacaggatccaaaagatagattttctgtttaaacacttaaagtaggtgggaaatgaacagagtaattctaggctatgaagtgtaagcagctcttccttcttccaaggctggaagaagagagaaatgcaatcctgtatctaattattgtttttcattcacctctaaaagtctctgtatatgtctctctcaatgacaatataaatcttcaataaatgatactatatatgtatacaaacaattatgaaataataagaataacctttttcagtgacaaaaattcagtaaataggactaaacattgaaggaaaaatagtagagacaatagagatggtctgaagttaaaacctaatgtttttaaggttttcatgataccctattctagaaccttcttcctttatcatgtctgatcctgttatgtctgtagatactatgaaaaataaagaaatgatctgaaaggtgcttggattctagttatctaacatcactcaataaaaagtgactttttaataaaatggtgctcagataattggtcattaaagaaaatataaatttgaaatactattagagtcaaaaccaacactaaaataaatttaagattatttaaaatgttagatattaaaatgtggcatcataaatatcttaatagaaaaatatgagtatttgatttttattactcctaatagagaaggattaccttggcttaaaaccaatagaagagtcatgttagaacagttgaatacatttgaatacatatacatgtattagattttttttgcatcagaatttaggcatattttaaaatgtaacagtatgaaaaataaacatacttaagcccaagtattttagtaaatatttttgtgatttggtgttttaaaaacttttatctcctgtcctttttctgtattttgcctattacctacaatgggcaggagttagttgtatagtcagaaaatacataaaaagtgatacccctttatgaaagaatcaatgatatataggaatgaggtcaggctaaagtgttgtaaagttgataactgagataaattaaaattgtattttagattttaaacagcatatatggaaaaatcaaattttgtccaaagaattaatcaataaaagtaatagggttttcaatttttaaataaaaataatggattttaaaatttattctatcctcctccatattgaattttttaaaagatgaaaaactaagtttgaaatgtaaccacacctattttatatgatatttgattaactcaggttctattatttctttattttccactagatcccatggatgagaaacactcaggaaaaaatgactgtatttatgatttttgttttcactgagcatttttattagcaatttatctacttatttatttgggtatcgcctcaagatatttcagaggtgatgcaatttttctctctgctcagtccatatttgctttagagaagcactcacataaggaagagaaagggaaataagaggctgcatttaggaccaatacaatattttacataagaattacctatatttagtatttggcaaggctatttggggtagctattaccccagaattataatgctggatttttccataatcaaagatgttaattttatgggtgagagaactgaggtgccacaggattaaatgacttaatcaaggtcattctttcgtcaaacaactactgaccactcactaagccatcttctcagcactggaaatctaacattaatatggttcatgaaaatttctactgtcctggaactcatattctaatggaaactccccagtgttcttaaatgccattctgtatacattccattgcttaacactccctcagcatttgaaaattttgttaatatgagtaaacactcatgtctggtattttaaaaaattataaaatgaaatatttctcagatttcttgtaatttaggtcctctccagcaattcgaaatgggccagaaataccaaagattcataaaaaataaactgcaacaataatcagcaaaatcatttgacaatattttgactgatagatctttattgttgcaaatagagaatactggtggttaaaataagtgtttcaaaacttgtctgaaatatatagaatctttgatatgacaataggtttcactttcactgttgaccacttgagtacttttattgtcatatttatgttgttctttttacagaaatatatgttattgttgtacacagcccaaaaaaaggtattaagaaaaaatttcaaagcattcataatctcacaactagaaaataaactatttttaatctttgcgtcatatcttcaccacacacacacactcacacacacttaagtatcctctgttcctagatggccatagaacagtggttctcaactttagcttacatgagaattacattgaggccttacaaattcctgggttgcaccaccagtttctgaacctcctgatttggggtggggctagagatttgcattttcaacaagattccaggtgatgctggcactgcttgtcttggagttcacactttgagaaccactgccttagagggaaaaaaaaatgaaaataagcatatttggacattagctaaaaggtgggatattctttgtatcccttcactgtttgttgctttaggagggttttcacatgtacttttaaaaaatggtctattcttcataggacattgaaaggatatggttgcctttttagctcattaacagatcaaatcggaagtggaatgacacctatagcagcattatgtacactggagaatgaatgtgttttccttcaatcattccattgacaagtgctttattcagcagtcaatcactaaaacttttgttttagtttctggtgaattaaaacagcctaacaattttacacacacacacacacacacacacacacacacacacacgttttatataggacaataaataatatatctaggttgaaaaaaatggtgagacattgtatatgttctgggtttttgatctgccatgaatttccagtacacttccaatatgactcatatagtacactggtggtcagagtgttcataggctgctaagacaggtgaactcactccagtgagatgctgaacagtgagaaagattacaactacttgtgattgaatctaattaaaattattgtcttcccctgatgacaatcccaaattattcttttagatctatgcactttctattaaaaatggtaagactgggaattactttcttcctcccatgtgtgctacgttttaaaaattgaacattgtcatctcttaaaactttccaaatcttttgtatattttgaatgctagtagatataaaggcttaaaacaggacattttctatgtatgcattttcagactttgaagataaatgacaagacaaatggtcttttcacttttcatctagacataatattatgttcaggaaaatttaaatcagtcactaattatatataaatatgtaattattgatgtaatatttaatatattaaacacatattttatatatatatttatatttatatgtgtttgagccaacagcatcttaaaagtattttcttaagttctacttgaactaaaaagtcaagatcagtgttgggatcaatctttttcactttatggatctggaaactctaaatagaactgggaataaggtattgaataatgctgaccaatgcactaagaaaacagtcttattgactgttcattttattaatgaaactgagaaataatccaagctaggaaggtaaatatgctacatagttatatctttttacatgacttttaaggaaatctcctataatggagcaatgtggggaatataataacaactgaaggactgtatgcaacaacataatagaatattctgagtaatggtaaatacgacttttgaagtcctttgaatacttttgataaccttcagaacacaactttagaaagaaaattaaagtttgtgatgcataaattaaaccagcagaaattctttttttattattattatactttaagttttagaaattcttaaagtgacaatcatatttggtaaagccataatatgaataactacccagacagttttcatgctattaaaatgtaacaaaattgaaaaataatagcaaataaaaattaaattgagaaacaagtttattaatatcagtactccttgccatttgccctccagtaacaacgcttccactcccaaatatctagtttttccttcaggaaaatttaaataaaaggtgtacaagtcatcaagcgccacgtgcgatggctcacacctgtaatcccagcattttgggagactgaggcaggcagatcgcctgtagtcaggagttcaagaccagcctggccaaaatggcgaaaccctatctctacaaaaaatacaaaaaaaaactagccaggctcagtgacgcacacctgtagtcccagctactcaggaggctgagacaggagaatcacttgaaccaaggaagcggaggttgcagtgagccaagatcatgccactgcacttcagcctgggcaacagagcaagactctgtctcaaaaaaaaaaaaaaaaaaaaaaaagaaaaaggtgtaaaagttatgaaagttataaggcaaagcataataaatatagcatgcctacaccaacatattaatttttgtagtagttgactgtgcttattttgaagaacaacagattctgtttgaaatttattagctgcctaatactctcaagtgatttttatagcaatttattttgtagttttaaacagagatagaaaattttggacacaaccttactaataggggaaggacttctgagaatgtcccatgaaatgctgtgtccattcattacatgtcctcttgcagcatgaatcacaggcatcatttagaagccaagggaaaacaaaacaagcttctaattactaattatgttagaattaaacccaagttaagtaagataactcgtgtgattaaaaataaaatagattttacttcacttttctctgttaggcagccccagctatctatctgaccacagtaatcaggctctgttctgtaagacatctactactggatatctgctttacaaaagaatgctggacagtgcattcatttcctattgctctgcaacatattgcctcaaatgtcgtggcttcaaacagcacaaatttattatgttacagttccggaagcagaagtctacagctggtctgatgaggctaaactcaagtgctgtgttacatctggggacctgcaggagaaacctcttccttgccttgtccagtttctaggtgctgctggcatcccttggatccaagttccatcactctgacctctgctgccatccttacatctttcatgctgaccctccagccttcctcctaaaatgatcctcctgattacattgggcccacctgaataatccaaatactctgtctatctcaagatccttaatttaaccagtttggaaaaacccatttgcattgtaatataacatattcctggaattaggatgtggacatatttcagaggccattattttgcctactataggcaataatgaaaatgtttatataatgataatatttagtctctgcagtggattgaatggtagtccccaaaaagatacatccatgtcaaatccctcaaacctgggaatgttatcttgattggaagaaaggattttagcagatgacattaaggaccttgagaagaggaggccatccttgattatccaaatccaatggcatgtgtgtatatataagagacacacagatgagacacatgcagaagaaggagaaagtgtgtagatggaggcagagattggagtgaagtggtcacaagccaaggaatgccagggtttacgggcagctatccgaagctaagagagaggtaaagaatggatttgttcccctagcttctgccaaggctttgatttgtggcttctggcctccactactgaataagaatacatctctagtttcaagccacctagcctttggtaatttgttacagtagccaaatgaaagcaatatagtctctaaatttcaaagttcagaaatatccttcaaaggctaaggactttttaaaggagattaaaataaataacttttgatagttatctatttcataaactgtaactgtataatcttaaagaccttaacatgctaagacatgtctttaaaaaaatacacagaactttcatctctagagacatgatttgtcatttatgatatttggcttgtcttctgtgataacaattgaaagataaatgcttggtctctgatatgaaatgttttagaagttgaatgattttctatagcattaaaaagagttgactgtagttctgctattgatgatttaagcaaagtaaatttataaatatcttgtgtttgtattggttgaattcaaatgatttttaagagaagggatagagtggatatgacatcatttatcctaggtgaaaaatacaaaacttttttaaaaattcacatgaaatgtgtctttaaaagaatacttaataagggaggtaggtgattatttattggtgttggtatttgtttctcagtctttacaaattttcttggagagatgctagataaaaaagtaacattcaaatataaatacctgggcttcactaaaactttccagggaaacaaccatatacttacaaatgtcctaaaatattatagaaatacaaatatggaacagatttttcttaggttttgagattcatagtacttatacttcatgggttggtttgttctgtttctcataatttctcttgcagcgttaaaaaaattctattcaagcttttgaaaatgtttaaattgctttcaaatgaaaatagtggcatggtgaaaatgattgagaaaaccatacacaaagactttaaaacagaatggtctacagttaacagagaagtgaagggattaggactgttatctgtatactcccaggtttttgttgttgttgtttggttttggttttttttgtgggggacggagtcttgctctgtcgcccaggctggagtgcaatggcgtgatctcagcccactgcaatctccgcctcccaggttcaagtgattctcctgcctcagcctcccaagtagctgggattacaggtgtgtgccaccacagccagctaatttcacacccagctaatttttgtatttttagtagagatggggtttcaccatgttggccaggctggtcttgaactcctgatctcagttgattcaccgtctcagcctcccaaaatgctgggattctaggtgtcagccaccatgcccagtcctactcctagtttttgatgtcatagtgtagcacattttatctttggttgagttcatttttaaaaagtttatttttaataatttaattcttaatgtgatagagaaagtggcaaaactttagctatggacaatgaaaataaagtaatcctggctatgtcactcaccatgagatcttgttcatgtctcggtgtgtttgtacaattaatttagtaatatttttaaaaaccttgaaccttagatttattcaactaatatacatttagaatatcaggtctattaaggtttgttaatttttgatcaccatttggtctagagtcttgaactctacctaacatcaatataattgcttaacaaaaatagatatgaatgacatctctaagctatttattagtaatatttccctctggaattaagacatcttttaagtaaagatcatattttagtatcttgaagcatattttaatctaaatttttctagtgacatggtttataatacagtattttgtgattcagtcctttgcttgtaattcttatattctgattgactgtaagacaaaactgattttatgtagcatttctagtggagaaattgttagtcataccttgtaaatgtctaactgtcttacttggactgggttttttttaactgccattttttgataattatattgattttacacagatgaatgtgtttagttgcaaactgctggtggaaagatgtttatattaagtacaaaaacatctaaattaaatagtattttttattttaactttcacaaatgacatattaggttaaaatatgggtaatgagtatgagccatcagaaatttttaggcattatatctaatggcttgacttctttgttttctctatattgactttgcctcttattcttatattccatatattacccactagttatgtaaaatatgcttttttccagtaaataaaaaaactccaaatttttatgtctaatttaaatatatttaactttgataattaaaaattaaaacaatctattatttttaaaatatttgatttgcctgggtacagtggctcaagcctgtaatcccagtgttttgggaggctgaggcaggaggattgcttgaggctgggagtttgagaccaggttgggcaacataatgaaaacctctctctacaaaactgagaagctgagcggggaagacggcttgagcccaggaattgaaggctgcagtaagctatgattatgccactgcactccagcctgggtgacagagcaagatcctatctcaaaaaaaatttttttaattaaccttatttttggaaaacataattggaaatatgtttttgccttagagtgttaaatatagatgtcaccaaaacaccctctcatgacaagatagcttccagattttcactgtggagattaaatcaaaaactgtgcaagttgagcataagaaattttagtgcaactttaaataatatatatctcacccttttatgcagtttcaaaactgacagtttttctccttccattatgacaaatttatattttattttttatctaggttctttcactgtgaaatacaagcttctaaatttacgtattctcaagtccataggtttaagtgcatttgctgactacatgttttatgattctacatagcagtttgtgctttaactataatatttttaaaaatatcattgtatttggagtgacaaggaaatgaagaaatattatatctgaaaaaaaaagaaagaaacagaatgtctgaaattacaaaaggaatagaccaaaagtatacaagaaagagattgctcaagcactaaacagaatgggatgaaacagatgaaatagaacactagcaaggagaaactccagtgtcctgtgcctgcctcagtaaatagatgattctggagacagggcaccagataagagtgtgttgccagtaatattccccagggctgtttttagtaagtccagagctagcacattggcacttaagccaggtatctgatactctacagccgtatttctcaaacttggacctccatctgattcatgtaatgggatgcttaaaatgcagtttgctgagccctatcttcacagttacttattcagtagatctggggcaggacttgagaatctgcatttctgaagtctttgtgggtgatgctgattatgcttttacatgtctcaaaggcagtacgttgagaaccactactctgtgtcattctcagtcttgtacctctcctggtgtgtttgtcttaggagatgttgtcagtggccagcagcccctgaatcaagggtatagagcaggaacacagtacactctcagggtcatttctcatcaatgcatttcactccacagtctggtagggtttggaaatggcccaggtgcccacaataatacaataaaccccatccatcaccctggaatcctccattcagggtgggccacgagggagactgttgggaatggatgttcttggtaaacctaacagaagagacaaactgagcaggcagagtggactttaaattccttcatgtagaggggtgattaggaggagaacaaatggcaatactagtttccaaccctttgaatgagaacttttttgcttatctgtggtggcaggtatcacgaaaatgttgcacagaccttttgtttagctcatcagctatcattagtgttagtgtattttatgtgtggcccaagacaattcttcttcttcagatgtggcccagggaagccaaatggttgaacactgtttgtcttctctgggccacagtatatgaacacctccatatgctatacgggaatgggcagtaggcacaagtaagagacagggagataaatattgagaagaagatgaggaccactactttttttgcacaaagtaataaatggtggtgtacccaaaattcatgtggagaaaactaagaagagaggtaagtgatctacagtgttagatgttacagagaggtccagtaagatgaagggtaaaaagcctttgtttggcaataaaagaactaactttgggaagagtttggtgaagtggtcttggtagaagcaaggtggttttgggcttaggaatgaatgagaggaggtgtaaggaaagagtttttcaatgtgcttgagtattcggggaaaaagtgagaaggtctatctaaacaattttgcaatttatgcatggaaaagaagcttgaacaattttatctgctgaaagcaaagatctagtaaagagagagtttgaagaacaagaaggaaagaggtaattaattattggagaggaaggtgataattgattctgcaagttcttttgggaagtgagagaggcccagtgtccagagcaccaagggagctattaaacgtctaatgctgtttcaaaggtcttcctctgactgttgtcacaagtgtatggtaatttattttgataatttcgttatacctcttctataatgggaaaccaaagtttgaagaagtttaggagaatttattttcttctcaactttttcagatctttgctatttatcatcactctatttttgtccacttctataaatgaataattggttaccaattaagaaattttccaggctgtgcatggtggctcacgcctgtaaccccagcactttcggaggccgaggtgagtggatctcctgaggtcaggagctcaagaccagcctggccaacacggtggaaccctgtctctactaaaaatacaaaaattagctgggcgtggtggcaggcgcctgtaatcccagctacctgggaggctgaggcaggagaattgcttgaacccgggaaccagaggttgcagtgagccgagatcatgccattgcacttcagcctgggcgacagagtgagactccatctccaaaaaaaaaaaaagaaaatttccaacaatcttttccccaacaaccttttaggtggcttatttttttttctgtaatataaaaaagtagtttttttctgtaatataagaaagtagtcttggcaatacaactaagtacagaagaaatcagttcgacttgattgtgtatgtgtgtgtgtttttggtatcctgtatttgtcaaagcaaattagtatctgttgacacatatgaggcaaaataaagtactaatacttgattttgagtcaaatcttactactattgttcataaatactttattggaaacctttataacatatctccttttaagcttaattttcccttctaaaatatcaatcaatcagtcaatcaattctcctcacccaattgtctattctattgctggtccataatggtccgagccattcatcaccaggacacgtcctggctgtactttgcagtatgatggtaaagttgccagaagaagagagagggggaatacataggcccaggcacagggcaggtttctttggttttgttttctaccagcaacagtatgagattttgtgagtagggaaaagtgaggggtggaagaggaaccagaggctgaaatggaagttgaagtagggttgaaatgcctggaacagataaaataaaattaaacagattttgctggtgttactgcgtatgtggttttctaaaaggataagttgtgtgctaattaggacttgattgtaaggataaaaggctggcacacttaggtgagctcaggtatagtgggcctgagaagaagaccattgtctattttaaggattttttttttttgtattgcaggggttggaaattcataggtatataagcttatcaatatgttggcaatgaactttttttgtttgtttttttgacagagtttgactcttgttgcccaggctagagtgcaatagcatgatatcggctcactgaaacctctgcctcctggggtcaagcaattatcctgcctcagcctcccaagtagccaggatttcaggtgtgcaccatcacgcccagctatttttttgtatttttagtagagacggggttttgccaagttggccaggctggtctcgaactcctgacctcaggtgatccacccaccttggcctcccaaagtgctgggattacatgtgtgagccacagcgcccggcctacaatgaacttattgtgaggtcttcacagacttgtccagtcagactgtggactgactgaccttaccgtaggtgtcaaacattgtgcttgatgtagggttaggagttaagagtttgggcagactgttgcctcttttaatccaataacaattttcactcttttcttttttaagctgggtgtatagtaacctagaataagtatatattttcaagcctctgttgtggttaggtgtattttgtacctgttattgccaataggatatgagtaaaaataaagtgtgtaacttctggattgtgctcttgaagagaaaggaggtcatgccctccatttcccttttcctttcttccttgcaactgtaaatcggaaataataattgtgggatcatcttagaacatgaaatgaagccaagatgttgaaggtgatagagcaatcagaaacagcatcagtcaccaacactgtcaaactgaactactatttctgcatcctctgagtgatctcctacatgaaagaaagaaatggagggtttttaatttttatttatttatttttttgagacggagtctccctctgctgccggggctggagtccagtggcgcgatcttggctcattgcaagctccgcctcccgggttcacgccattctcctccctcagcctcccgagtagcttgggactacaggcgcccgccaacacgcccggcgaatttttttatatttttagtagagacagggtttcgccgtgttagccaggatggtctcaatctcctgacctcatgatccgcccgcttcagcctcccaaagtgctgggattacaggcgtgagccaccgcgcccggccgggggtgttttttttttttaagcaccgttttatttttgtcttttgtttcagcaatctgagtcctaactaatatacttgttaagatctctaatcaaggtattcaataaacgtttacagagtgctatatgcctggcacttttctagattctaccaagagtgaacagcagtcctctaccccagccaaaaaataaaaataaataaaaataaataaataaataaataaataaataaataaataaaaaatctctgtgctcatacaaagaaccttctaatggaggagctaccccataagaaggataaatacatggaaatatataatttcttaattagtactatggaaaaaatatagtaagcaagggacgaaactaaattttaagtgataagtaaactttaagatagcatgacaagaaaagacttcactaagatagtgactttagaattaaacactgaaataagcaaggaaagcagccatgcagatattgggccgagggaggacattcaagcagaggcccaatgagagccaagaccgcaagaccttattgtgctatagcaaggggagaatacaattggaggtaagtgaaggagaagacagttttaaaagatgaggtcagtgtgataaagggaccgtatatttagagtcatggtaagtattatggctattccacagaggaactgtgaagacaattgagggcttctatctgatgacataattcaatttatgtttcaaaagaggcattcagtttaatttgtagaaaatcaactgaaagtctcaagaaaaaaaaaagataaggcaaacttaatagaaagctgttgcatcatttagatgagagacgatggtaaatgggttacgctgttgacaggatatattttgaaggtacagctgaccaaatggagggtgtgggggagaaaagggcatcaaagatttcattaaagatgtggcatgaggaactagaagaacagactttctgttaactgagatgaaaatatctgactgcatgaaaacctgatgctggctgtggggaacaagaaataagaggggttttagacattctgaatgtgaggttcctattagatatctgagtggagatattgaatagagatgatagacatctctgaagtgtaggggagaatctgagttggagaaataatttaagaagtctcagcatctagactatattttaatcataagaccagatgaagtccctggggagtgacaggttaaaaagaaaacaaattcaaggactagtctgtagccttgggccattcaacattcacaggtcaggaacattaggaggaagcaacaaaagataataggtgggaggaatatatgggggtggtatccagaattcttagtgaagaaaacataccattaagaatgtctttttggggcagggcgtggtggctcaggcctgtaatcccagcactttgggaggccgaggcaggcagatcacgaggtcaggagttcgagaccagcctggccaacatggtgaaaccctgtctgtactaaaaatacaaaaaattagccaggcgtggcagtatgcacctgtagtcccagctacttgggaggctgaggcaggagaatttcttgaacctgggagggtgggaggttgcagcaagtggagatagcaccattgcactccagcctgggtaacagaggaagactcagtcttaaaaaaaaaaaaaaaaaaaaagaaaagaaatgtcttgttggagctgtcttttctgggctcagggaaaagcagaaaatatgactgactgagtactgtagtctgcagacacgccatgtgttaattggactgtcaatctggcagagagtggcagaggtgggtggaacagtatacagtcaaacctagaaccatggaacatcttggtacagacagataatggctattgtaaactatgactgaatccagccaggagtgtagattatctgaatcgctgcagatctacacattttaaccttagcacaactaccagtatattttatgctttttaaaataaatttgcagtgcctagtctggacagcccatgaaatagaaagccacaccaccatcttcaggagaagagctgtgaaagagaatcttaagttataatacttttccttataaaatgatgctggacttctaatgatatatagctactgctgatatcatttattttttattattaacttatatatcattcatatataaaaatcatttataataggctgctttgtatcattgtattgaaatatactttatcactttaaacattattcaacttttctatgttcttgtaattttatttgcctcactcaatgttatgcttcttgaagactaaaatgatactttttaactttctttattctgtcctctgcttgttctacctttttttcccctttcacaacactagtgttactgaggacatgacgtttaatttttttaaataatctctttagctctgaaaactctccgtatttttttttatttaattatttggtaacatagtgtttagtgctagttaccgttattttaaggctggtactactattattttgaataaaagataaagatgtttggtaaagattgcaaaggtgggtaaattttattgagttgattattgttctttagcaccactcatgtgaaaatatcgaaaatttattttataatttagtgttctccagaagttgtaaatgagttagcagtaattatacatttcattaatattcatatatctctttactatatttacttcctcttcaaatggcagctctaagaaatgaaggaagaataacggatatgtataaacatatgtctgtgttgtattatattcatcagaatgggtgatgacttcacaagtacaatgtgacaatgttttcacattacattctagttgtatcatgttcactgaggtattgtaaccctaaacgacttttcctctctatctatagggatgacaaaggtaacttatggccctttacaatttttattgcatagtgcaatataatagcaaaacaaatgtacaattgaaaattattaatgggaggctgaagtgggtggatcacttgaactcaggagttctagaccagcttgggcaacatggcaaaaccccgtctccacagatcaaaaattagccaggcatggtggctcacgcctgtcccagctacttggcaggctgagctagaaggattacttgagcccagggaagccaaatctgtaggctgcagtgagatgtgcttgcaccactgtattctagaccctgtctcaagaaagagagagaaagagagagagagagagaatgagaaaagaaaaagacaacaaaagaaaaaagaaaaaagagaagagaagagaaaagaaaaaagaaaagaaaggaaaagaaaagagggagggagggatggaggaaggaagggagggaggcagggagggaaggttattaatgaaaaacttgaaattatggtttgccatgggtaaattcacaggtttctttttgtatttctttgcagttatctgacattatgtgaatgattgtacattttattcatgatttttatgtatgacacttataatagttttattaaatatagtattaatatgttgaaattacctgaattattatttcataggggatggcttcttagtgcccccaagctgcgaggaggttcaaagcaattatattttgacaaaaatgtttggaacagcaggctatcactgctatgtggttgttctctaagggtgaggaaatggggagctagtagatgaacatgaatcctactgataacatttttccaagattagaaatgaatagtataaaattttgttatgcagtcacataatatgagggattctatcagataaaattttgccttccactatctctttcaatattttcctcttatctcttcctattgcttcctatcacttgatttagctccgaggtaggaaaattaatctcatccacattcactttttttttttttgtttgaaaccagagaagaaatctctacatgaggtactaatggattctgacatctctcatctaatactataacacaaacctcaagggaaaatacaattgaattgctgacacgaagagagatgagaactggctaagagaaatttttatgaggaatttattattgttatccatcctctgatctggaaaaatatgagccatgtccaagaaaagaataaacttctttaacctggagaagtcctgtgtgctaaatgtcaatatcctggaactgctctgatcatttgcttatgaatttatataaattatatattatttaaatatatattagatttaggcatggctatcattttttcatgattgattttaaatagatttaaaaaaacacccaggttagattgttgaacttttcagtgctgttgaatggtttctgggtctgcagaataactatcaaaatccactgaatgataaggagtactagtaatccagtggagttaggcatttttttatattgaaaaaatagacatttggtaatgataaatgtaagtgacttaatcttcattcaaactatgatgttacccaatgttggaattgatttaaatggtaacattgggaagaatagatctttaatctataggttatagattttaaaataacctttctaaaatgaatcttttatttatgcaaagataaccatttttgatgtttaaaaactttttaaaaatgcacttctgttaaaatgaatgaagttataatcatgtaaagtcatatttcctattatatcaaaggttaatatttgttaaaatgtgcagttagcaaattcagccacaaatcctaaattcaaggacaaacaaaaaaatcctcttcattatttcttgacaatgtatgctaacagaaattactaactataatactaagtacaaacactgagtaatcgaattatttatttttccaaagcatttttataatcaatgctagattgtcaagtcattactactttaacatgatagccagaagcatcaatattgttcttgtttacatgaatggtctttaacataagtattaataataactataatgtctaaaattataatatctaaaatttctacaaccttactatgtaccagatatggtggtaggtaatttatatatattagtccatttaatcctcacatcaaccctctaggataaaatactgtcatttccactttatatattagaaaattgaaacacaatgtttttaaataacttgtccaaagcttcatagctagaaagtgatagagcaaggatctaaactaagaaaccctggatccagagtctaactcgtcaaccacataattattgtgcctcttgaaattaggtgtaattttgaaacttgcatttaatatacaaagatatgtatgtgtacattgtttatgacccttatttatagaaacataaaatctaccatgtatgtaatttaagagatacactgctttaacataaaatatttcagtggaagcgatttacccatttttaaatgtagctattttcatcagaaaggggtttattcttttctttctttctttccttttttcttttttggttgaaacctttggggcattagtaagaagaaaaacgattatttgacaggacagtagtgatgatcacacaagatcacatccacatgtcttctgggctcagtcaggtaatgaaaattgttaaatatatgttaacgtgaaatagtgggtagcagagtacccattatgttatagacataacgttctctatttaaatacttcaaatgtgttgtttttctgatatgcatcaaacaaacaagtctatgactgatgtcatccctcagcccttcacttgtggtttatttttgctacataataatgcaagtatttctcatgatggtttaaatgacttcaacagatgttactttggagatgagtattttgttaagagatgatataaacctttgttattcattctgaaaactttagtaacctgttatttattggcagaacttatttttaagggatattataataaaaatcatcaaaagatttctttataagacttggggatgtcaaatcctaaaacatctgctctcatatgtatttattgggaattatttcatatcctcactccatcctttcaccaaagtatatatgattactctctgatcacaccctctatgtgagagattgttgaaatgctgctcttcacctctcttagagcctacattccaacataatcaataggaattttctttctatttaactatagaattgccattacagattatttttgttattctccatagtgaaaaggaaatggtgttcccccccctcccccaccccgccttctagttcagaacttaaaattgcagtgagctagcttttgtatattacagctgttggttcacctttcatgtacttgggaacatgatgaacttcttgattcggcccagatttctaggcatgtagataaattggaagggctgagattggtcactgagagaacagtgagagtctgaaataatcaaagtacaagtaagaagggcttaaaccagcagcggataatagtagaaggggggatgaaaatgggaaagttgatatgggttacatgaaatcccttctcatagatttgctattgacccctgagtatttaggaagaaagtaacaaaatagccaaaagaagccagcatttatgcttcctgatcaacaaatgccaagttttcttttttttcctgtagaaaaaatataacatacttgtaaaacagggcataatgccactttgatgaagcttcttcaagaataactgtacatgaaatatgagcaatttgtctatttaagatttaactgagatggcagctggtgttgagaaggattcattgacatgaattttaaagttgaaaatgctacataagcaatcataaaatatagacacagtcaaaataaatgagaccatctctaaagatatgaactgttcacaaggaccttctgactctataacgtcactgccttttaaaaagattaatatgggtatttctaggtattattaggatgaatttatttaattaagagtgaactttagaggtaggcattctttgaaatcttatggagcagtaaccgaaagaaaagtaaggaaataattacactggatttataagtgattatggagctcctctagtaagaaagcacctaaataagatgtgtgattctcattatgttctataagctataaaattacttccggatctaggttgtttactttttggattaattataatcatacacacatagaaagaaacatcacattcaatacattattgcttagcaaaattcaaacagtctggcaagtaggagagggtgttataatactgaaagaacttttcaagcaggagatcagagctcatatgttggtttgaccaaaaggatctcatgcttctaattataggtcacataatcctgcataccaaacattttatgtaaaagattagtagaaactgaggaaggtgccatttcctctcactgtttttctgctgtgctaccaaagtggagtcagagtcatcctaatttgtatttgtgctgggtttcatggcacagtctgttgggtcttattaagctttgttgcattttagtcagactttgttctcctctgtttcaaagatgcagaatgagactaggtctttccctggaatgtgtgcattgacttccagaaatctctttattccttgcagcctaaccatcagttctcaggataactggagattgcactttgctccccagagcctcccttggattttcaccttctgggagagcccttcccaccctgctgctctgcccccagacctcagttgcttgctgttttgtacttcctgaaagcccagggcatgttctgtccacaatccggcatcgaccctggctttgggcaagttctagcctataactcttcatgaaggtctgtgtactacgtgggtggggggttcccctcacttgattgctctgcctgagccagcctgttgcagctttctgctgctctgtgcactctagggcagatctctcctcactcttgcccgggactcaggcttcctcatatggcccctaggtgctcagtcaaggtcctgtggaaaagaattggtaggcaggtcagaacacattttgtgactagggctcttaagaattctactccctcataccagcccacaagtggcagtttaaattgtgttacatattgtgctgatgttccttttcctcttttttaaatttttatggatatgtaatagtttcacatatttatggggtatatgtgattttttgatacaagcatacaatgtgtaatgatcaaatttgggtaattgaaagatccatcatctcaaaccttcatcatttctttgtgttgggagcattccagtttttctcttgcatttaccatggccccagtgttgaaggcaaccattggtcatttctgtcccaagaagcatttgtctatatctggaattcagtgcctctaattttctctatggtgggatatatatatatacatatacacaaaagtatatatatatatatatatacacacacacacacaaaagtatatatgtatatatacaaaagtatatctatatacaaaagtatatatataaaagtatatatatacttttatatatatacatctatatgtgtatttatgtgtatatatacatatgtatatatactatatgtgtgtatatatacatatgtatatatactatatgtgtgtatatatacatatatactatatacgtatatatactatatgtgtgtatatatacatatatactatatacgtatatatgtgtatatatatacgtatatagtatatatgtatatatatacgtatatagtatatatgtatatatatacaaaactatatatgtataaaagtatatatactcatatatatacttttatatatatatacatatacgtatatatatttgtgtatatatatatatacacaaaagtatatatatacaaaagtgtgtatatatatacttttgtgtatatatatattacaaaagtgtatatatatatacttttgtgtatatatatttacaaaagtatatatataacttttgtaatttatttgacttgctttcatttttcatttcaaagaggaagcaatcatcttttgtaattttctatatcttaactataattggagctacacttattatgtttccaggtttttgccattaaaattaatattgcaaggaattttcttcctcatgccttttggggtgtgtgtatgtgtctgtacacatacagatacctcttgggtatttttataggagtgaaatttctgggacatagagcatgcataagtcattttatttacatatattttgtactccatgagatgttattaaagccttaatatttatttaggttaccacatatttttccttttcattactctttattgcttactgaattttagtgcttttctctgttatcatatcctcctacctgaagaattacttttagtaattgtttctgatgtgagcccactgctgatgaattctctgttttagtttgtttagagatatttatttttcttctgcaatttgaagtgtatggatacagacttctgttctggaagctattttcgttcaggactttaaagatgtttaaaatcattaacttctgttattaacaactttcccctgtcttctggctttcataatttgagttgagaatagttagctcttaattttcattgttgcccctttgaaggcaaccatctcgtatttccctacttcctaacaactgcattttccttttaccttacattttccctttaccttatgctttattgtgcctggttagtttttatatgtttgtttctattccccaacatgaaaatcatatttcttgaatctatagcacatttcactacttttaaaaatacctcaacaattatttcaagtattacagcagtattactttctccttctttctttaattataattatacataagttacccaggaccaatattttatcttatgcttcaattttattttcatttaaaatattattttggtgcttcattctggaaattttgtcctgaaatatatttcaatcagatattcttccttgactaattcttgtgtcattttttttttttttctgtacaaggccagatagcaaatatcttttactttgcgggacatacagccttggttcacagctagacaactctacatttagcataaaagccgccacagataatatgtaaccagatgggcataattgtatttcaaagaaaaatatctctcaaagcaaggaataggccagatttggctcataaacttcagtctcccactctctggttgaatctaatctgttagttgttcgcaatatcaaatattatgtttcccgtagctatataatcttcttataggctccagttccctggtgaaatttaacatatttcctgctattttctaagcatattattttaaattattttaacatagtatctcataattttcatgtgtgcatctgattctattgtttttttttctcttagtcctgtctcttgctatgcctgttaactttccatgaatgctggagtcttagtatgaacactgtagcaactctgaatgagacactatctttagcacatggttaacgtggaaacatagcaccttaccacaacacgggtttgagtcatatcaaggctgagttttagtacccaaaagacctggtctgtttcttgttctgcattactcagagttatttattttcagaaatctcaagtgaaagtctcaggaatttactagaagctctattcattgccaagtcttgtctgtcacactttatctccctgccactctgtgactgctgaaaattacatttaaaggctcactcctccatactggattcctcataatttttttctgtacctgcactgcttataaatttgtgagaattagaggagacacgtgcaagccttcttatttttcctttcttgagggagctcgtatatttaatcttggctgtcttaggatccctgaatttcatctcccagtcctaagaaatgggaagaaactctgttcgggttctctgtctcttcacagcccttctacttagcttatcagcatctttttctcaacttagaaaaaggtatttttacctgttactgagaagtggcatagctattaggttttcgtccatgagtccctcttctccaggattttggctcttcaagtactgactcacttgctagctctccgatgccttcaaatagatgtgtattttctcattgtttgtttgtcgaattgacctctctctcgtttattttagaggagagtttggtctgctataagctagtctggtattcctggagcatgaacattcacctgtgactttttaatctcttgaatacaattaaaaagggaagttttcccctctttctctcactttgcgctggtgattttcagctggctgtttcaactttgttctctgcatatttcttctctgctctgtgcctcagatggtcctataacctcctttagccacactcccttcctgaatggcttcttattgggtttagagagtgggaagcagcaaatgaaggagcaaagcactgcagctgagagaggctgagacattcattccctctcttcatggaaaaagatactcttcacctttgtccatagcccttgtgcggtgggtgatcttccacagatgccgcttcctcttggtgttggtaccattacatcctgcttctttcttgtaccgtaggcctatgggtaggtaatgaggtttactgctgttgcttgaaacttggcatgtatcctgcctttggttgttcctttaatcctgccaacttctcccttaatagacccttaggtaaagtttttatcagttaatcctttgaatgtgccatctatctgctcagacactgactgaaacccattcttattcctattctgataattagatggtgttttaaggctgagtagctgggatagttttttgctgaaaactgtggcctttttacttatgcaaacttgtgtttaattgagagcaaaacctaaaagatagttaatggtaaaaaaaaaaaaattgtaagaagaaccctcctgccatgccaagtgcatactcatataaatgtataatcataaagcacaggattaaaaagcaaaatgttaggttactgtgtagaaaaagatttatagagttgttcaatacgaatctaagtagcaatgtacttcagaaattagtcagtaattaaaatgcagtggtttggactaaagtgagattaaaaaagctcaactggctttagtttgtcactggcattgactttgagtatttttcatactacaacaattggcctaagatttgcacttcttctcttgacatgttgaccttttcacgttgattctttctacctgctgctaagatacaaaatcaatatgatcaagcaggcaaatcacctgatactgaaatagcctgatgataggggaggaaatctagttatccagcgtccttggatatgcttatacaagtatacagacaagcacacaggcctactttcatgtagttcttggtttacacttaacacatctaatatatatgatttttttttttaaaaaagagcacttttgaacagagtccttggagcatatattttagggaaatttttgatggggtctctccttgatgacaccccatggtatttctatctgttttcattctaaggcaattttgtgaggcttcttccaaacctcatttctttcctatttctgcgtttcacctgacatagaactatttgaaaccaggtccataatggaacaattttaaagcagtaatacaaaggaatggtgaagtcttgatgttttcctaccctttcccatcttttccacctcctgttggagacatgacaatcttttggagacatgacagccccctcaatccctatgttttcctgcaagagtcctggatcttacttaggaaaagagtgaacccattgtttctttcatatgggaatgaagtaggtaggcagaccctgacaaaatcccttaaaccataacaagtcagtacctatctagtcataaatatgctttaatacactatttaagcaatttatatttaaaaaactgacaggagttgcatacttgtaacattttagaagagtcatttttagaacactttgctctatttttaaagtgtttatggttacttactgttctatcctctgtgaaagacactcctctaggggattcatatgatttagacattttcagcaaattatattgcactcaggtattatgagctaatagtttttaagagtgataaagcatatatatagatttaagatgctagtatatttcctgttgaatgtttcaccaaactaaagcttcttaaaagttacttcgaggctgggggtgttggctcatgcctgtaatcccagcactttgggaggctggggcaggaggattgcttgagcccaggagttcaagaccagcctgggaaacatagtgacacctcatctctacaaaaaatagaaaaaaatcagccaggcatggtggctcactcatgtagtcccagctacttgggaggctgaggtgagagaatcacctgagcctgagaaatcaaggctgcagtgagtcgtgattatgtcattgcattccagcctgggcaacagtgcaagaccttgtctcaaaaaaaaaaaaagtgctacttttaagctagtggcactatcttttatagtctattgttatgaattcagtcatcaactctggcaacaggatgcttttcaaaatttacaacctgctttggcctttgtcagcaatcttcccataactcaactatgataatgacattgcatattcgcacattaggatgaattaatgttaactagagataagctgagatatttacttttagtatctggttagaaattagtcctaaaaatttttaattgttattttaaaaaattaagcaagtattatgtagaataatgtcttttaatagtttgtttagagtgaataggtcagatggggctaattgtgatcatcctgtcagtgagggcctcattctgtttggctgggattaggtctcatgaaaaaaaaagtgatcactgtgactgttcaaattatgaaaacctttctaggattgtgctgcaattgcaaaatatgttcttgagtccgcgggctttgttatctatcttaatgatcttacttgcatgtttacatttggtatttgcttcagttaagaaatttcaccagtttttagttgtgaatttttttcctcatttaataatttcatataaagtatacatataggctatatatacaaatatatagtctatacatccacatttgaaaatatgtcatttatttcaaaaaagggaaaataaataacacatcaattattttatattaaattatatttctttttttggccctgtaagtgtccagtagcttattatcaaataaaatatattagtatgtcattccaaaatattgtgataactgtgtagcagatccttgatgattatattttcaaaaaaatgaaagaaagtaaacaataaaatctctcaaccagtataataaattatatggtagcattgttagcactgacacactcatcttcattttaggaacattcactagtggttactaatcttatgttgaaaggaattttttttagagatatttaactatattattaaaagtttcctggaatttggggctctattttggaattttttcccccttaagtgtatttattcatttatccataaaatgtttattacttccttactcataataggggttcaatgggtattgtcttatggataaatgattaaatagaacgcaaatgaaggtgatatgcatactttctttgatgaattcttccctatcacctttttgttctttggttcattgatctttcattgattaagaatctgtaatttatcacccctgacactggatttcatactaataagttcagagacaggaatcatatagataagaggtgagaattctttctgcaagtgtgtatttcttaaaaaacgtaaagacatttttgtacccagacccctccatcacctaaaaagaaatgtacatatggtggtgagagtttatttatttctttttctttctttcctctgagaaatagagaaaaagaggccataacctgaggaaagatgggagaggagatatttctgcttcaagaaagaaagatgtggaatactcttgggggaatgggggaaagtgaatgcattataggacaaagggtgttgggtaccattaagctcccacttgagatgagagatcacaaacgatgtcaaagctttcttgcctgagtgcttccctccaactacatgcaactttgtgatttcagaccccaaggagggttagatgtggcttaaagaattatgctttacccaagcaaataccctagagagaggaaggcatcagggagttgtgtgtttacaagtctaaaagaaatgtaagttcaggctagtaaggctagaaagtaagaaatggagttcaggctagtaagacgagaaaggaggacatgggcgtggggtggtaaggaacatagaaaatgcagtagaaagatatgattttatgatggagtatactatttggtttattttcttttttctgaatggaagctttcattgctccttcatatagtattttggtttttctctgttttcttttttcttctttaaggtcttgtttttcattctattttatttttagagcaattttaggttcttagcatatacttttgtatgcttcaagagtttctctttgtaaaacaagtaagaccaagaggtattagaagagttaaactttatttttaatttttgtgggtacatactatatatatatataataaatatatatatttgtaacatatttatatacatatatagttatatttatataaaatatataaatattatattttatataaaatatataaatatattttatataaatatattataactatatatgtatataaatataaatatatatttatcatatatatatttatatatatatttatatataaatatatatttatatattttatataaatatatatataaatatatatttattttattatataatattaatatatattaatatattaatatattaataattattatttataataattaatacttaatttttataataataataaatatataataaataaatattaaatatatattatatactatatataatatatttttatataaatatataatatttatatatatttttatataaatatataatatttatatatatttttatataaatatataatatttatatatatttttatataaatatataatatttatatatatttttatataaatatataatatttatatatatttttatataagtatatatttatatatatttttatataagtatatatttatatatatataaatatatatttataatatttatatatttatatatataatatttataatataaatataaaatatatatatttgtgcggtatatgagatattttgatacagaaatgcaaagtaaaataatcacatcagagtaaatggagtattcatcacctcaaacatgtatcctttgtgtaacaaacaatccaattatactcttcattatttttaaaagtgtagttaaattatttttgactacagttactgttctgtgctagcaaatactgttttctacctgtctttctaactactgtttttacccattaaccatctccactgcttcccccaccccactatgcttcccagcatctagtaaccatccttctactctctctttccatagttcaattgttttaatttttatctcccacaaataagtgagaatatgtgaagtttcatctctctgtgcctggctaattgcacttaacataatgacctctagttccatccatgttgttgcaaatgacagaatctcatcctttttatggctgaatagtatgccattgtgtatatttaccacattttctttatccattcatctgttgatgtacacttagattgcttccaaatgttggcgattgtgaatagtgacgcagtaaacatgagagtggagatatctcttctatatactgatttcctttcttttgggtatgtacctagcagcgggattgctggatcaaatggtagctcaatttttagttttttgaggaacctcccaactgttctccatagtggttatagtaatttacattcccaccaacagtgtacgggggtttccttttctctacatcctcaccagcatttgttattacctatcttttggataaaagccattttaactggggtgagatgatatctcattatagttttgatttgcatttctgtgatgatgaatgatattgagcatatttttatatgcctgtttgccatttgtatgtcttcatttggcaaatgtctattcagaccttttctcatgttttgatcaaattattagatttctatctatagagttgcttgaattccttatacattctagttattgatctcttgtgagaaggaatctttcacttcttttgttaaattaattcctaggtatttaattttatgtgtggctattttaaatggggttactttttaatttctttttcacattgctcactgttggcatatagaaatgccactgatttttgtatgttgattttgtatcctgcaactttaccgaatttgtcctaattatttttttgtgatgtctttaagtttttccaaatataaagttatatcatcagcaaacaaggaatttgactttttcccttacaatctggatgtcctttatatctctctcttgtctggtgacagtgggcatccttaccgtgttcccaatcttagaggaaaggctttctgtttttctttattcaatatgatactagctgtgggtctgtcatacatggattctattatgttgaggtatttttcttctatcaccattttttgcaggtttttatcatgaagggatgtcagattttatgaaatgctttttttggcaacaattgaaatgatcatatggtttttgtccttcattctcttgatataacacattgattgatttgtgtatgttgagccacctttgtatcactggggtaaatcccacttggtcatgactaatgatcttttcaatgtgttgttgaattcggcttgctaatattttgttgaggatttctgtgttaatattcatcaggaatattggcttgtagttttcttttacttatgtatctttgtctggttttggtatcagggtaaaactggcctagtagaatgaatttggaagtattccttttccctctatttattggaatagtttgagtaggatttacattagttctttaaatctttggcagaattcagcagtgaagccagtgggtcctgggcatctattttattgaggactttttattatgactttgattttattagttgttattggtctgttcaggatttggatttcttccttgttcaatcttggtaggttgtattgtctaggaatttatctatttctcctagattttccaatttgttggcataaatttgcttgctcatagtagccactaatgatcctttcaatttctgtggtatcaattgtaatggctccctgttcatctctgattttatttacttgggtcttctgtccctttttttttaattcattggtctgcctaaaggtttgtcaattttatcttttcaaaaaaaaaaaacaactttttgtttcattgatcctttgcattttttctttatttcaattcattttttctgctttaatctttattatttttttcttctaccaattttgagtttagtttgctcttgcttttctaaataaatgatgcattctttaagatacatcattacattatttatttgacatttttcttagtttttgatgtaggcacttatatttataaactttcctcttagtactgcctttgctatatcccatagattttggcatattgtgttttaattatcatttgtttcaataaagttttcaaatttccttcttaactttttaattgacacaatggtcattaaggagcatatttgtttaatttccatgtgtttgcatagtgtccaagactcctcttattattgatttctagttttattgcattgtggtcagagaagatgtttgatattatttcatttttttggaatattttaaaatgttattttaacatgttattctaacatggtctgttcttgagaatgatccatgtgttgaagagaataatgtgtatttccaagctgttggatgaaatgttctgtatatacctataaaggtcattggttatataatgcagattaagtctgatgtttctctgttgattttctatctgggagatctgtccagtgctgaaagtggggtgttaaactctccagctattattgtattggcctctctctttaatctaataatatttgctttatgtatctgggtgctccagtaatgattgcttacatatttacaattgttatatcctcttgctgaattgaccactttatcatgatatgatgtacttctttgtttcttatagtttttgtcatacaatctattttgtcttatataactactcctgctctttttttggtttccattggcatgaaatatcttttttcacccctttatcttcaatctatatgtgtctttacaggtaaagcatgttccttgtaggcaacagatcattgggtctttttttaatttttttaatccattcagccattctatatcttttaattggataatttagtccatttaacatttcaatttagtccatttaacatttcaatgttattattgataaataaggacttgctcctgccattttgtgatttttttttttcctggttgctttgtggtctctcttccttggtttcttccttcctatctttcttttagtgaaggtgattttttctggtggtatgattcgtttttttttttttttttaatttttgtgtatttgttgtaattttttaatttgagattatcatgaggcttgtaattactatattataaatgattattttaaactgaaaacaacttaacactgattgcataaacaaacaaccaaacagaaaactaataaaaccctacacttttaactttgttcctccactgtttaaaattttcttgtttctatttatatcttattgtaccttctctgtcttggaaagttgttgtagttcttatttttgattggttcatcatttagtctttctacttaagataatattagtttacacatcataattatagtgttataatattctgtgatttttttttccttctgactgaaaaactctctagcatttcttgtaggatagatctggttgatgaaatccctcagcttttgtttgtcttagaaagcttttatttctctttcatatttgaaagatattttcactggatattctattctagggtaaaagtttgttgatgttgtttttcttttcttgcttcagcactttaagtatgtcatgctgctctctcctggtttgtagggtttccagtgaaaagtctgctgccagatgttttggagcccaattgtgtgtctttttttttttttctttttgcttgctgcttttgggatcgtttatccttaacccttgggagtttcattattaaatgccttgagataatctttgggttcaatccgcttggtgttctataaccttcttttacttgaacattgatatctttccctaggtttgggaattttctccgttattattcctttcaataaactttctacctctatctttttctttacctcccctttaagggcaataactcttagatttgtcctttgttgtctattttctagatcttgtaggtgtgcttcattcttattctttattcttttgttttctctgacatcttatttttaaatagcctgtcttcaagctcattaattctttcttctccttgctcagttctgttactgagagactctgatacattgttcagtatggcaattgcattttttcaactccagagtttctgctgtttctttttaattacttcgatctcttcattaaatgtacctgatagaattctgaatttcttctgtgttctcttgtatttgcttggatttcctcaaaagagctattttgatttctctgtcagaaatgtcacatatctctatttctccaggattggtttttggtgccttatttagttcgttttgtaaggtcatattttcctggatggtcttgatggctgttgacgtttgttggtgtctgggcattgaagaattaggtgtttattttagtcttcacaaattgggcttgttcgtacctgttcttgtgaagactttttacgtacttgaaaggacttgggtgttgtgctctaagccatatctgcatcagggtccaccaaaagcctagtaatgctgtgattcttgcatactcattgtggtactgccttggtggtcttgggtaagatccaaaatcttctctggattaccaggcaaagatacttgttctcttcccttattttctcccaatcaaatggggtctctgtgatgacctgcctggagttgggcatgaggaggcacaagcaaccctgtggccacaaccagtgggacagcactgggtcagaattgaagctagcacagcactgagtctcaccaaaggcccatggtaaccgctacctggctactgcctatgtttgctcaaggtcctagggctctactatctgcaggtggtgaagccagctaggcttgtgtccttcccttcagagcagtgagtttccccaggcctcaggcagatccagagatgccatctgggagccaggaactgaagtcagaaaccttagaaatctacctggtgtgctattttattgaaggtaagatggtgttgaaactgcaagacaaagtccttcccactcttccctgtcccttccatggacagaggagcctctcactttggcagacacacagggagtactgccaggctagtgctgatgctcccataggctaaaaggctcatcagcgagcttatggtaaatgctgtcaggcctgggattcacccctcagggtagtgggccaccctctggtccagggcagacctagaaataccatccaagagctaaggcctagcatctgagaccccaagggcccacttggtgctctgtcccactgtggccaaactggtctctgaagccagcatttctcaaaaatcttactcaaggtccatggtgtagtacctgggtattgctgttggttcttcagtgaccaagggctctttagtcagcaggtaattcattcttccaggactaggtccttccctttcagggagtgggttcccttctggcccagggtgttccctgatgtgttatctgggagctagtacctggaatgggggcctcatgtccctaccacggggtgggcttatattcaagatgtaagacaaagtcctctttactcttcccccttttcccctcaagcagaaagaaggagtgactttttttttttttttttttttttttctgcaagctatattgcctggtgttggggaggggcagtacaaacacttccttagccgtcctggctggtgtcccacatcccctgtctctgagcctaggacttgcctagcaattacagtccttatggcctagaatgcctttctagtttatttggccatggtggcgaggtttgacataacccacgtttcaaccgctgggatggataattctcctctagctaggagtggtttaaatgctccctttgtgtgtgggcattggctgagtttagcccagttctgattttcaccatgacagagcagtactgagttcagggcaatgagttcagcagcactgggttccacaatcactgtactgtgtctccccagagaacacatattctccacgccatggaggccactgcttgaggatgggggaggagtagtataagcagttcaatactgtcttttttaccatcttcagtgcttcttggtgatatgaagtaaaaccaggtaatgtgattgctcacctgatttttggttcttatgaaggtgctttctttgtgtagatgttaaattgctgttcctgcaggggaagggaggaaactggtgaaggcttctatttagccatgttggtctgccccatctggaatgttctctagaatatttaaactttaggttgttgtctactgaggcctgatctttgtgctttattatgaggtcattccaaataacagctgaaaaaagagatgtcacctgtaatctatcttgttacctgaggtttcaatctgatctccttataaggcttcctcttcccagtctccacttgttctcatttcagcttaggtacacaaataaagtggttatttcaacccacaaggatccaagttatgacactcttgcttatttagattttaggctacaaaaaatgaaaagaaaaaaaaaagtaagagggccaggtgcagtggctcatgcctgtaatcccagcactttgggagcccaaggcgggcagatcacgaggtcaacatggtgaaaccccatctctactaaaaaaaaaaaactcagcctggcatggtggtgcatacctgtagtcccagctactttggaggctgaggcaggggaattgcttgaacctgggaggtggaggttgcagtgagccaagatcgcatcactgcactccagcctggcagcctggtgacagagcaagactctgtctcaaaaaaaaaaaaaaaaaaaagagtaagaattatgaattgaagatactggtgagtcttaggcatttagagaattagcatattgaaggaaacaacctggagagataggagtagtggttggtgaggaggatgtttccattgagttcttaaataaatagcacttattggtaattaacaagcatagatcatagcacttattggtaattagcaagcataatatgatcatgtgagtttctgaggtatgtagagaaccatacattgaagaagaggacaagcagctgagaggccaggactgaaagtcatcagtgtggataatgaaattaccaaggattttgatgagagtggttgtggagaaattatcattaagtcagtctcagggaataagtagggagactaacgagtctaaaaaaggttataattagggagaaagttagtgagtacaacaagaagggtttggagaaccaaagccataaaattttggggaagtgggagggagaaagagcttagaaatgactagcaggccctgtgacagttcttgagaagtcagatggacacctactccatgtctaggcctttgcaggaagaatgtaataaagaaaacagccaccacttaagagaacattagggaaagcagtatccttagtacagagccagtttcaattagtgaaaaatattaatgagaatgtcgagactaaagatgtaggaagtttcaccaaaactgaccatgagtttcaatgaattaccatgcatgggttccaggatatatataggggtgttatataactgaatgaaatttgagagtgatggtaacacatttggggtttaaatcctagaaactcattatgcaaacataagaaactagaaagatttgtataacactctctatttcacagaaatatattctagaatgtgcaagtgattacttgtttgggaataattggatttgggaatataatgatttgattgatggtattttgcttaactgagattatctacttataaattaaccaacatttaaataattagcatacaataaaatagaatcatcaaaactcttttaagaatattttaatatttttattctatgtaaatccattgcttttcagttgatattttatatcctaattatttgtgcatatttttaatgcagaagggataagatgggagggtgagattgactctacattgattaataaatataagaaataattttctgagagagaatgagggttgtgtgtgtgtgtgtgtgagagagagagaatgtgggtgtgtgtgtgtgagagagagagagagacagagagaaagaaagagagaagagagagagagagagacagagacagacacagaaaggaaagtggaagagataccttcaggatgtttttgattactgagctaagcaagcagtgagtcacttttagtaacagaaaagagaaagctggcagctactgaatagagtcagctggttaggtcagtcagtcagagaaagagaggacgtctaacaatagctgcctatgttacatggcatttgaaattactgagataagaggccttggcaaattacaccttggttgctttatttattgatggaaataaaatattttataggaagtaaattgatagtgagagtttggtattcattacttttaaaaaggatagacatgtcttagtgatccaagcttaattcacatcaaatgtgagaataaataacttctgaacatattataaataaaaagtgaagcctaagtgatgttagttattgtgatagctcagaccaaattgtacataattgtcatgaagaaagaaattaatgtgtcaaattatacttcaattttgaaaagctcttcaatgctttaccaagatgcgtttgaatagtaatatcagtttttctgtgaagtaataggttaatcattcaaaaagggaaacttgagcagagaaaaggaaaaattacagacagtgacagacatgattcaaactgaagtccattaaatgccaacccagtgttcttttaaaattttttaaaaagtataaaaaataacaaattttaaataactactgcttatgtacctggtggtttcagaaagtaatgaaatgaagaaattatgattaagagaaactttgcatttattatgtaaacgtgaaagatacgcataaagtatagctttgggtatatgccaccaatttctgagcctttacagaaatttgtgtgtcaaatatgcttgtttttcattatctccaacttttgcaggtattaaatttcacgtacctctgatctaagttatttgtcacatgtgcatctaattttcaacaagaaaagattattttgatatatcaaaatgatcattatatttttccttgtgtattcatattttgtgcctttacagccacttcagtaggaaatcaggaattatatatgctgttagatctgctatatttaattccaatattttaaaatatataaataacttaaaatcataaaactactaaaaaatgaagaaaatgttaaaatcttgcagttttatgcttttaatacattaaccgagattcacaaatataattgtatatattaactataaaaagtataatacaaatgaatgggaaaaatctcgagaaagaatcaaaaacaactattatatttttattcatttactacataatgattctacacatcctatgtgacagacttactgtacttggtgccctggagcatatgaagatggattagatgctgatcccttccttctaggtgcataaattccaataaagtaaataattcataagataaataagcataagcttgttagataaggagccatacatcagaaagtgatagataaaatgttacaggcattttgaaaaaaaaggcatagtttcttctggggaatctggagaggctttttggaatatttggcatgaagatgcttatcaaaggttagatagtttttggagttgaagacagtatcaaagagtgagagttaacccaccaacaaagagatgataaagcgagttaattaaaatgctgggaacagaaaaataagctgagtgggagaatcagagatgtgaaacagaaaaaaaaacaaggttggaaaatcgttggactttgttctgtaggtgatgagaatctttgaagattttaaacaaggctgtgagacaataagagctgtacatcaagattagttctgtaaatatggaatactttcctaagtggggcattatttttgaaaattttaaaagtaaaaagaaggaatttaaataaataatagatagattagatggagagatagatagtttatatctccttacctgcagcagaagccactgagtcacaaagttctaggaacatttaaaaattaatcaagaaaaattgttggagagtgaatgaagactaggcagagattgggcaagccctataagtctgcagtcttagcaggaagaacccactttattctgtgtttcatctctggaatttccagcaggttctcatagtaaatctctgagaaagattccttcttggttctagcaggtggaggggaagagtaatcatggctaaaaacacttagaatattctccacaacaagacttagtttccagtagaaaagaccttataagagttgcgtcacaggtctgggataaaggcattcctgccgctaatagatactctaggttttctgtcacacctaagataaggtgttaggaaggaagctataccacaggggacacatttatgaaggtcacaggccagagacacaagcacactaaaagattaaggttaattatgcattatttagtttgctgtttttgtgttaatttgcttagaataatgggccccagctgcatccatgttgctgcaaatgacatgatttgattcttttctatggctgcatggtattccatagtgtatatgtatcacattttctttttccattccaccactgatgatcaccaacattgattccatggctttactattgtgaatagtgttgtgatgacatgagtgtgcatgtctttttggtgaaatgatttgttttcttttgggtatatacccaataatgagatttctgggtcaataggctcactacctaggtaacaggaacaattgtaccccaagcctcagcatcatgcaatatatcaatgtaagaaataacaaatctgcacatgtaccccttgaattaaaaattaaagttgaaattaaaaaaaattaattgtaaggtggcagatagcttctactccacacatcttaccatgacacccataagactccagtagaataataatagtagattacagtgaaaagcaatgtaagacacagatttttttctgaggagcagtattaacagaagcctaatgtcaagaaaagagaaaaaaaaatgaagatactagagaagatttactgatataccaagacaggtaataaaatgaatcatataaaatactcaaaacttgagaatataagttctcaaataaaactgagaaggcagaaaacaagaggtttaaagaaaaatgacatgaacaaatagaaagcagttatttaaatgttagatattaacccaaagcccaactatatggtggttcctagaaactcaaatataaatatatagataggttaaaagtaaaggaattaaaaaacacatgacatgctaactctaatgaaaataaaataagagtaactatatattaattttagataaagtcaccttcagaataaataaaattattagggatagaggggggcattacacaatgataaagagatcaattttctaagaagacataacaatactaaacatgtatgtaccacacaacagtgtcaaaacatgtaaggcaaaaactgatggaactgaaaagagaaatagatgtatccattactatagttgaagatttcaaccttcctctttcagtaattgatatatcaagcaggcagaaaatcaatgaaaatacaaatgaatgtacaatagtattaatcaacttgatgtaatttacatatttagaatactacatcaaggaacagcaaaaaaacacattcttctcaagctcatatggaatactcatgacaacagactatactctggactaaaaaacacaacttatcatacatttaaaaaataaaaataattgaaaatatgttctcagagtataacagaatttattataaatcagtaacagacagttagttggaaaaatccccaaatattgagggactaaagaacacacttctaaatcacatatgggtcaaaggagaagtatcaagatgtttaaaaaataattagatctaaattaaaaaatgaagttacaacttacccaaatttgtaggatgcagcaaaagaaatgcttatagggaaagtgatcatgctgaatatctatgtcatcaaagataattctaaattcaagaatctaagtttacaccttagaaaaattcgagaaagtattgtattctattctctgactaatcctaaagtaagcagtagaaaaaaataacaactgcttttaaaataaagtttattaaaatatagtttgcgggattttgattttgattgcactgaacctgcagacaaaaatgacaataattggcatctgaatgatattgaagcttcctatctatgtacatgaaatatctctccatttattcaggtctttttatggtgttcttcagagatttatagttttgcacatagaaagccaatagctattttgttagatttatgcctaagtattccattggttgataatattgcaattggttttttttctttagaatcaaattcttattgttccttgaaagtatacaagaaagccagtaacatttgtatattatccttgtatgctgtgtttccttgcattcttgcttattagtaccaggaatttttatttcattgcatttactaataaaacagtcatgcttgttctttctttttagaaggtcattaattattaaaataattatacacataagtgcacatatatatatatatattcagatttttaaatttcctcatgcaagtttgggaggtttatgtcattcacagaactgaatcattttgactaagttataaattttgtgagtacagagtccttcatactatttgtttattatccttttgatgtccatgggtgagtagtaattgattcctcttatattttgatattggtaacttcttctttctctctctctttagttactatggctacaattttatttttcaaataacatttaggtgttaattttatctactgtttccattttgaatttcatttctgctctaatttttgtaatttgtttctactgcttgccttaggattagtcagagaatagaatacaatattttctctggttttcctaaggtgtaaatttagattattgaatttagaattatctttgatgacattactgttattcaatatcctactggtacaataagacaaaataatagaataaaaaaagaagtgaaagttatgtagattcacaaggaagaattaaaaccatctgtgatggttcattttatgtgtcagcttgactaggccagagggttcccagatatttggttaatcattattctaggtgtgtctgttagggtgtttctgaataagattaacatttgcatgataaactgagtaaagcagattgccctcctcaatgtgggtgggccttatctagtttgttgaatacctgaatagaattaaaggctgagtaagaaagaatgccttcctctgactgactgtcttcgagctgagagtggtctttctctgccttcaaacttggattcagactggaacttataccattgtcccactcagactcaaactgcatcaataccatcgggtcttctgggtctgaacttctaaggtccataatcacgtgagccaattccttagaataatctctttctctctgtgtctttctctatgtacattattctggagaaccccgaataatacattatttttgttattctatgacaatgtcttgtatatagaaaatacatatgaatctaataacagtaatgagagaagacataatttactttgtttctgatcttaaaaggaaagtgtctagtttcacatcattaagtataatactaactctcgcgttcctgtggatattatttatcaagttaaaatgttgacttctattcctagtttgctcataatgagcaaattcacattatgaatataatggctggctttgtcaaatatttattcagcattaattgatatgattgttagatttttttctctttactttttgatatgggtggattacatggattgatgtatgaattttgaacaagcttgtatacccagaataaatttcattttgccagggtatatacttattttatatgttgttgatttttacttgataatatttagttgagtgattttacacatatgtttattagtgtgtatgtgtaaatttattaatacaatgaaaagagctcaacagtgagcaggaagaaaataatgtgtgtatattatattttaaaaatatttttacatttttgctcatgcagtacctcagctgatagtcctctgtcttcttataatttttctgaattattgtatttttaattttaataaatggtctcctttcacatgtattgtcacatgtattatacttgatattaaatacaaaatatttgcagggagtttaaatttacctctattttatatttaccaaaaatctgttactgaaagttaagtcactgtggcagatgcagtttaagaaaactatggatttattctagcccaagaattcttagtctatttactctgtacatgcatgctataatatgaggtaaaggcacataagtttggaagaaatcagaatgggcttaatagaagagtcatcatttgacatagaccaaagattgcatattgagtttcctcaaggatctagaaccagaaataccatttgacccagcaatcccattactgggtatgtacccaaaggattataaatcgttctactataaagacacacacacacttatgtttattgcagcactgtttgcaatagcaaagacttggaaccaacccaaatgcctatcaataatagactggaaaaacaaaatgtggcacatatacaccatgaaatactatgcagccattagaaaaggatgagttaatgtcctttgcaggaacatggatgaagctggaaaccatcattctcagcaaactaacacaggaacagaaaaccaaacaccatatgttctcactcataagtgggagttgaacaatgagaacacatgaacacagggatgggaacatcatgcaccggggcctgtcaggggatggggggttaggggagagagagcattaggagaaatacataatgtagatgacgggttgatgggtacagcaagccaccatggcacatgtatacctatgtaacaaacctgcatgttctgcacatgtatcctgaacttaaaataaaaaaagactcataaaattaagggatatattctgttaattggttatcaatatgtattgattattggggaattgagtaattccccaagcaaacaaaaggattctaagatttgcaatgtaattatggtgcaatatggcatgtgcaataaataaaagtaaataacagcagtagtgcattgtaatggaggcaacatctccaagttgcaagaattaaagtgggtgatgttgataataagaaaatactaaaatgactgaaaagaattaaaattaaccacttaatcattcaaaattattcagaatttctctatcattttcattatataatattttatagaacttacaaagtatttggcaaaaggaaaaatgaaatgcatagacaaatgaaaaactcgctattatttatttgacattataggaagtataaaaagtgacaaggtggaacacattttgcatcagggaaattttcagagttggtgagtgtaataattttgggagcttgtttaatttttcattcaagcctttgaatggaaaattttctctattattcttcactgttggacattttacagcttctcagcattttcctcagtatgtggagaaattaagttaaaaggacatagactttgccactgtgtagaacagaatagaaagtttacaaattactgatcaagacatggaaagatctgtctaaaattcatatttcggatattctggtaatttatattctccaagttatcattgttctcaatttctacgaagaatgtagagttacctaaataaaaggaagatcaaaagcaaatcactgcaagtttcaaatacattttatcaaatcagatcaatgcaataattcagaggagagagaactgaaagaaaggcactaagataaaataagaatgcttgccaggagcgtgtgaggtgatcagggagcaggttgggacccttcgttacagaaggaaatcaggagacaacccagaaggcacatcaaagaggatttgtttatgtttgtgatactaatggggaaatcccttggactagagattaacgttttctgggtcagaatgcactgttcctcacggcacagtccctcacagcttcccttggctaggagagggagttccccgaccccttgtgcttcctgggtgaggcgacaccccaccctacttcagcttgccctctgtgtgctgcacccactgtctaaccagtcccagtgagatgagctgggtacctcagttggaaatgcagaaatcacccaccttctgcattgatctctctgggagctacagaccagagctgttcctattccgccatcttgccagccaacccctggtggaaggaggagcaggcacttattttcacaaggcagcaggaaagacagagatattttttattcataatatccattttttcacttactgccttaccattgtcattgcaggggaagaaaaacttacataatttcattttgaatattatttggcaaaaatatagattataaattattgttcataggacataaggatttagaaagtgagtagagggagaaatgattcatggggattttccactttctttatcccttaggatttcattatttggccacagtattacaaaaattaaaccttttctattattctccaggattcattagaatgcacatttgtttctgatgatgacactgcatatgacatgtaaaaagttgtgtccaacacggtattaaataaattatatcctaatgagggagcagcaattttcatattttaaattatatatgaagagatacagtattaacatttaaatatcaatatataatctagagagtgattttacatatttttaaaaacctgctgatattatcaccatttgcaaatgaggaaattaagctttgagagtgaatataactttgtcacataattaataatttgtagtgtcgtaattccatgctgatcttcaaaatctctgatcctacatatattgaacagttcattatgaaataataatgtagcatgttattagtacttgtaatcagttcattgttaataatatgctatttttgttataccatgtaggtatttaaatatttcaaagtcctttaaaataagtgaaatataattttttatttggtgtctaagcccaaaggtggtcagagaggcatccagggctagctgttaggggacaacttgcagtagttcagtgtgaaatgctttaaactatgatgtttctgttgtacttagctatcattaagtatttggccaagtctgcactaataggatgtagccatagcaatgaaaatatttttatttgattataattggatcattttgattacttgttaaacttttaaagacagtatgtcctgatttctacttagctctctcaatttcttagatctgcattatttgttggaacaatgtaatgttagttaatattggttaattttgttctttaagccattcaactatacttggaaaaaaaaaacaggttagtaaaatagttttcaaaatattcatgtcagctgagctcggtggctcatgcctgtaatcccagcactttgggaggacgaggtgggtggatcacctgaggccaggagtttgacaccagcctgaccaacatggagaaaccccatctctactaaaaatacaaaattagctgggcatggtggtgcatgcctgtaatcccagctacttgggaggctgaggcaggagaatcacttgaacctgggaggcggaggttgtggtgagccgagatctcgccattgcaatccagcctaggcagcaagagcaaaactctgtctcaaaaaaaaaaaataaatccatatctactactgttgcctcagaaattaaaaatattacatgctaaaaatatttagagacttcaccaaagagggcataaaaatggccaatcagcacatgaaaagttgatcaacatcattagtcactgtgtaaatgcaaattaaaaccaaaatgaaataccactatacattattagaatgacccaaaaaatggggtgaaaagaaaaaaaaagacaatgccaagtgctgatgagggtgcagagcaattgtaatttttacacattacccctgggaatgtaaaatggtacaaccaatttgggaagcaatttggcagtttcttacagttaaacctacacataccgtatgactcagcagtcctactcataagtatttatgcataagaaataaaaacatatgtccacacaaaacttgttataaatatgcatagcactttggttcgtaattaccccatactgaaaactacccaaatgtgcagctgccgaaaggatacccaaattgttgtacatacagacaatggaatattactcagcaataaaaaaaaacccagactactgaacattaccacaatatggattaatccatactacgggaaagagcaaggattgaaaagctgtgtactccattattccatttgtataacatttgaaaaagacaaatcactgggggaagaaaacagatcagttttcacaaaggcctgaagatagaggatttactataaagggatatgaaagaactttctcaggtgatggaactgttctatatcttgtttgtggtgatatttacatgactgtatatatttgatacaacccactgatgtgtacatctaaagggagaaatatgacatgcataaattagacctcccataaaattgacataaatttaaaacatatatcatttttttaaaagtctgatttgtggggttaaaaattccccaatatactggatatgtgtattttgggctgaagctgtcaaggccttaactttagattttgtataaaagccatataaattttcaaaagtaaccaatcacagaataaagagtgtacaattgtcatatcagtgcacgggctaaaagaattagaaaacagagcaaaaactgatatttttaaaattcagggaaaaaattagaaaattaaatttaaagagtaagatagaatatcttaactcatgccacttcctctgggaagccatctctggacatactatgtgaaattgctacatcctagacattcttagtcttctgtattttcttgtagtttttgtttgtttggtcggttgttgtttttttattaacagttgtattatctcaaatggcatgtagaaatacatgtatttatatatatatgtacacacacatatatataaacttatttttaatctttattttaagttacatatcagatttgtctattgtttttcatttatagaataccagcacctcataactaagtgcagtttcaatatgtatatgctgacctaatgaattgatgaattattgaacataacaaataagcttggtttttgacatatgcaataaccacatctatgatgaagaatgattgattagttctttattgtatgggaacatatgtgaatgactaaaaataaaccaagtatttacaacttgtttagtacaattacaaggtaggattcatcatcgaatgtaggtactagctactataaaatggatttttttatagtatacaaagttttaatacttgcattggccttaaaaatgagcagccaggcatggtggctcacgcctgtaatcccagcactttgggaggcccaggagggccgatcacgaagtcaagagattgagaccatcctggccaaggaggtgaaatcccatctctactaaaaatacaaaagttagctgggcatggtggcacacacctgtagtcttagctactcgggaggctgaggcaggagaattgctctaacctgggaggcggtggttgtagtgaaccaagatcatgccacagcactccagcctggtgaccaagtgagattccatctcaaaaaaaaaaaaaaaaaaaaaagttttcataggtgttatttgcaagacaacctacactttctccatgtttggaaacagaaagtaattcaagactggtggccttgcacaccaggtttctgagaaaagattaaaaccctaatgcagtgattctcagtgtggtactgaccacaatggcatcagcatcatctgaaaccttatcagaaatgcaaattctgaggtttaacccaagaccagcttactgcacctctgaaggttgagcccagaagtttatgttataacaaatttctatgtaaccagaaatccatgttatagaaggcatctattgtatgttaacttttctcctatgcatctagaatagtacttgttatatatcatcctgcggaaaaattaagaaaagagccatctttacttttgcttctaagattttttttttcaggaataatttctcttatttctgatagacacagctcataaactctcttagtgtcagtatattggtggtatatgttatcagcgtttgcttatctactaccatctttttctggttccataaaaacaacagctaaaaaaaatctatacctacatcattgattttattaagcacaattctgatagctaaaggcagaaggcttttatttagattataaataaatgatgttttgaaacaatgtgtaccagaattctatcctgatagtccattttagctccctagtatgtgggaagtaaatgaaacatgaggaaatgaaatatcttccatgtcaataatggtgtttactttatatgtgataacttgaaataaattcaataactttaggcgatttactgcaggagcaatctcagatagcatgtactcaccatcaaacagttctaaatgactctgaacgattcctaacatctatcttatggtgaaatgttgtaagaattgtttaagcacctaggaggaaaaggaacagatatgttctggggataagatttgtggaaaagtatgctctgttgtcactagtataagaaaaagtaaattttctatcagtggttcttactgtaacgtcaatatatttgttacaaatgtcagaataattgcgttctgtatttcaagagagtagtgatgacacatgttttgaaattctacatcataatatgatagttaggaaagcagaaactgaggattctctgcctagtttcaaattctggctctgaaatttataagctctgtggtcttgggcatgttctttatggaacagctatgtttcagttttctcacttatagaaaagaagttatagtaacaactgtacctcatagagttatgattattaaatgagtaaaaaattttaagttactacaaacactgcctggtacagagtaagcattatctaagaaataaaattatttgccgacaaattatttagatcattttgttcaaagaaatatgttttgtttatattcttatagatccaggtaggccaagtactatagtctgctattcctgcatcatgattgctatctgggcggtctactcattaatattcattgtcaagtccctaaactacctttacttatccatttctgaagatggtgaaaaaatactatacttgaaaaagtttaaatttgtaatctcattaattcaatgatcaaatatttctcagtcaactgttttgtgcgttgtgctaaaggctgtagaggctatataaagaatgagccttggttgtttttagggagcttttggctctgttgagtaaagtagatatttatataatatagcagaagtagaaagtgaatattttcatctgaaacagggaaaaatacaatgacagtttaatgacccttcctctgggcttggaagaataaaagtgttgattgtagcaaaaatgctgtgaaataaacattatcattattcccatttaacagttgtaaacagaacaaatctgaaatttcaaggtaactttcctcaagccacagagcccgtcagttagcagaacccagaaccatgttcagactcatctgattccaaagccagatcctttttagtctacttcttaggtaaagggatgacagaaataagatctatctgaacttccactatcagcatccttttgttttaacttctcttgtgtttgagctattgatcgttagtgagtggacagtatgttagtctcactttaataaatggattttattatatgaagctatgatgtaattaaaatgtggttcattttgcaataacaaaacaaggactaaaattaatgtcttctgatgaactattatagttaagtatattatttcccacagattttcagaaaacattaaaatcaataagctaagtaaaatttcgctattttattatcaaataattttatttttatgacatttaaaaagcttatttgttgaaaaatggttgaaacagataaagaacataaccccatgaatacattagtgaagaactgtaaaaagaaagtttccaccgataatttactttctcatagcctagtaggtcaaatatcttattctgttcttcccacatcaccattgtaatctgggtagtttatcccaacaatggatgtttattattaagtacccataatatatcatgtgctgtgtttgacataaatacctatatcataatgagatgtcatttctgttctgggaacttaaactgaatacaaatatatattacttctactttgaggtggtatggacttaccatcttgccaaataagttgccatctgtacagggccttataaaaatggactgtatttccccaagtaaaaatgatgaaggaaagttttacagaaactcagtatagcacagcatgaaaatccagtcattcctagaatgtatatttagaatgattctcttctcttttggctatgacacatcttccatcatgacgctagattcctcttttcaaacgatgaatttcgccacatggctctccctcattaaaagaaaaattacctcccattgaaaggaaggaagcagatatttcaaatgagtattgtttgattccaaagtcaccaaattcatgacctcttaaaaatggtcatggaaagaacattgaaactggagacagaggtcctggaataaatttaactttcattttttaacaaccaatatgacctttctgggcacctgccagagatcagtccaatttgataagcaatttaatagctaaggaaaaaagtctgtttgggcatttttttttctctcttttcattttttctctgctctataaagtcttttcccttccaagataagcatctcaaattcctatagtcattcctcaaaggacatttgtgttttttttttttttctagattcaactatcagacaagggaggaatgaactggggttattacttcctttgatcccaacattttgcttgcctgaattagatgacattagagtttttatccagatcactattaactgtgtcaaatggtttgctcatataagcttccagtcaagtgaacccatcaccctggatccctctggacaaaagtagagggaagggatcaaaaacagattcttcaattaataagcctcccactgtcaaactgaatttccaggggctgtttgtacctacaagactttttattatataatgggtttctatgtatgattgctctcatttttaatatatttataaatcacattgtcgtctaatttaaccttttaatgtgaaacttaaaaatattattcttgatggttattaataatcaatgtgtagtttatatttactttcattctaactttcaccaaagacaccaagatgtaaattgaactcttaggagggtgggcacctcagatacctaagctcctttagtgtggatccctcccagacttcccacttcctatgataggaaatttagaataatttcaagaccgaaggcagtactagtcatcactatgaccttttcggctacactccacatacataagggctgttgcaaaagcagctgtcaagacaatgtttctggactatgcaagttctatctagatttccattgacatcagtgtatttgccttggggctgtgcagtgacattgagtatcaatggtgaacttattctcagagaagaaaaaatataaaagagagaaatatacagaaaaggaaaatattgcagagaaactgaacttaaaaaaagaaaaaatatgcaatagtttcttatggtagaaccaatgttattatgtacatttcctgtttggaggttgacagagattatgatttccagcatattcaggcaatgatcaactatatcattttttctggttcacattttctcatgatatggcctatatcttttaataacttttaatatataataaattgagagacctaatattaggtgctcttgtacatgtatgttagcaacacatattctcataaaccatgaaatttgagactaattattatactgtgcttatcctcttaagtttcaaacattgcaaaccaaggattattctccatattttacatgaccttgaaaaacacctgacctttctgctaaatagtcacccaagttactgacatttcatatcaataaaaagttttcagttagcctacccaggcgatgtaccattatttaacattttgtgatcttggtagaaaaatgtaacataacaatttaggtttaaaagccctgaagctaaagaaactaatttctaagacttcagtgttataactgatgttcaggaactatgaacaaagaaaattaataacttgtataagtttctataatcctctcttgttatccctatctttctgaaattcatataaattttatcaatgggtttcacatcattcatgcagactcaatactctgctgaatgatataacctagtttgaccacagcatttcaagtagacaattatactagcaaaagtcctaaactaagcctgcccctgaaagtaagtataaaatgaacctgaaatgaaaggtcatacttagttgtctaaacaaaatgacaatacagtccttcacacagcggagcagtctgcatggagataccaggttgtacactcagctatattgtagatagaagcactgggaaaggaaaggccacgtcagtgggcttcatccagccacagggacacttagagttgagcaagttgaattcgttattcactgcagcaagagagaatgcacatggtggggaactgtggggcatctcagtaggagcagatgacaacctgacacaggatttgggcttggttggaggaatcttagggaaagtctgaggaagtagaggtttgctttgggttgggtgtcgacagaaattttgtggcaattctatgactagctatctcaatacatcttgtctgtaggaagaacagcctagggcaaccataaagctgtaattagttaagaagtaccactcattcattgtgtgaggggggctctttggtattttgaagtttttacaacgacgttgtctgaaatgaatgttctttaagattgttaatatccgacaggagaacattatggcttatctgtgaacccaagaattataaaatcacaatgggcctgagctgtgaagtcagatcagtttccggtatcacggttggcctttctctctctctctctttctctctctctcatacccattctctctctttattactctctcacccctccctcttcccttccttccctccctctgtcttccctccctccctctgtcctctctctgccccttccttcccttccctccctccctccctccctcccttccttccttccttcctggaagaaaaacctccaacatggcagtcttttgagatttgtgttacaactaagaactgaacaaagatcaaggaaggctgtaggtccctgaccccacaacctcaccaagacatgagaataagaaaatcttagtctaaattcatccaacttcattttagtaaacaagcataaaacagtcatattgcctgctcgtatgtccttgagtatctttccacagatattcctcataactatgaaactctgttgttgaagtccccaaagcagtcacggacaatatgtaaacaaattacaacacaactttatttacaaacagacaatggccagttttggcctgccagcagtagtttacaaaactcccatgtaaaggcaaaaccaactgatcttctggtcatattgggcaacttctgtaaaagatttggcataaaaccaaacagatcacacaaggggtttgaggctcacactttttctatccaaccatatgactaacttatactacataattaactacctttcttgtgcagatttctatgacatgaatattgattcctgactaggggatttcaaatgctaattaatcaagtgctaagcaccttttaaacataagttgcacacatgtgcttcaaactcttcataccaaagtatttaaagaaaattatcactcagatgatgtatttgtgagatttgggtttgtcagaacagagattcacttgggtaccctaagtattggatattgagtgtgaggatgcatgtgttgataagagacatgcatgaagaattcatgggaggaacaaaactgtactacagcttgacattaggaaggctggaatgaaatgccattcaggagatgagacagaagttggccagttcttttggtttcctcctgtatcttaataagactcacttctgctttccctactcctattaccttatccattctgtatctatatattttctccttcacaatttcatattagctgtagattttgcttagccatcccttgactttctcctatttttggctccctccttgcctctctctttcccaaggtatttccacctgctgatgttgctactgaatcgttagtcattcacagagttcccatttgaattctccagacagagattttaatgacaacttaatcctgttgtaaaagtatttttccatccttggttttgcttttcctttttggtggggttgtggcagaaatatctaaattgtgtgtcagtattgtctttatttcatattaactacacatgaacataatatgcatgagtgagtgagtgagtatatgaatggagagttgactctctacaatgttaacaggagagccactgactttttttccttttaatattatttcatagtaaaaaaagaagacatcaacactttatttactgaaagtgtgttaaatgccagcaattgtgcttggtgtatttatgtgttccatgtagtaatatcttcaaagcccagcaaaggtgatattattcacagtttttcagttgaataaattgaagctaaaagtatataattttttcagtgaccttcaccagttagttgttgagctagaacttttacctgtctgtattatttctagattttctgctatgccatgctgcctcaaaagccagcataagagcaaaaacagggatttatcaggtgagcttcaaagaagcattctttgaagaatataggatatcatcatcaagaatataggacatctgtaattccagctactcgggaggctgaggtaggagaatcacttgaacccaggaggaggaggttgcagtgagacgagatcgtgccattgcactccagcctgggcaacaagagcaaaactccatctcaaaaaaaaaaaaaaaaaaagaaagaaagagaatataggacagaatcatcaagataagacaagaagttggcatagaaaatggtaatctcaaggtctccttttgacttgtggtgggtgtgcctcctcccagcctccttgcaagagataatctaacatgccatttatttttctatctcgggtaggtagaggtagatagtatgactaccatcaaaatctgagttaaaattgcatggcctctgttgcttttgtcattccacttactcttctaaatctcactcttaacctaattcctcaaggtgccccctagatttttaaacactctgtttagacgtcactcctagagctctgctttcctaaaatggaatatgatcttaaatgattctttgtcctttctatttcctttgggtggagatgagagaaaggctcattcccgttaataagagcacagtactgctcaagattgctgtgatttcttgttaggaatgactgattgtatgttctcaggtaatgtttgcaatataaaaggaaagttaatcaatcaaaataactaattgttgggacaattggaaacttgtttgcaagtggcattccttagtatcaactgaccttcttatgccttctcacttcctcagccactagtgcaacagaacataagtcagacaatactgatggcaaattgtctcttcacctgcaaggtgaactatcttagagagtaagcagttgaatattagggacatatagagttctaaggccaaaatccatgaaaagtactcaagtttggaaaatggtgggagtggagaacatctgttaaaggcaaatttgccatctatgcattttgcaagaactctgcttggtgagagattacctcctccccccagatagcagattctctcaacttcctctttgtagggattttaaactctactcactgctttttcaactgtctaaatccttttatctttatagcacatatggcctcccaccctgaaactggtaggcacagtttctgatctaatttaatacccacattagagtatgttttaaatatcatatcaccaagtccataaacaactatgctaatgtatgaagtagctcagcactgctcaaaacacattacagttgccaacaccataaaatcccatttactttttcttaaaagtgtttgatatcgaatttgctttccctgaactgtaattaacaacattctgaactgcttacaagattcaattgactggcattattaatcacacattcacagagaagttgaccattacatttgatttttttttctttcttatgtgtttttggcatctaatcactgatgaaaactaaggaaatggcccttttcaccatgttccatgaacatttattttcttggtgtatttagtctataaagatttatccccatttctattggatgctgattctaaatttctatagacatggaattaaaccaagaaacagtatttcttgtcaagaggaacagtttattccagataattaaacccagaaatgttcaaagaaaacacagcaaggagcataaattagattctatcaagggatataggttgttcctcatgaatggatactgacaaaacaattttgtgggaagctttgaaaagtcattaatagttttgaaagttttgaagactagcacattttgaagaggaaagaaataaggtttagttctgtgttttaaaaatgtacttcagatattcacagatgtttcaatgttttgttttcttatatttgacagtatctttgaatatgaatctaagatttctgtgcatatacctttataaatgctagagactttttttttttcatttgcccaaatgccatttggagatgcaaagaataaaatgtaaacatctaaatagaataaatttagaaaaactgagatctttccagtgattgtaaaactgctctcctatttataaaaattatatagaactgtattgagtacaaagccccagagtcagactctaagctccaggcatacagggagcactttagcttttgcctagagctgcaatataagacgactgtaagtatctgctgagtaaatcaataagcaataataatttaggttaggattcctaaattattttccgtagcagattgctacttgcacttggaaattaaataataaaattaaatattagaaaattgaagcataataaaattaacctcttctcatctgtaaattgaggtaaaggatgatacctgcatcatagggtgattatgggttattattattattattattcaaagaaaacttaatacctgaactctctctaggtattaaggactcatgaaaatatgttaatttgttgatttttccagaatgcatacatcaaccttaaaacacttaggcttgctttgaatctggaaataaataagaaatatatatcttgcaaaaccaactctgattatgagtttgcctatctatttcaccttagacaacttaccttttgctgtactacctaccgtccccattccttcccaacattccagatccctctgcaaacacacacacacacacacacacacacacacacacacacacacacacacacacacacacacagagttatgacctggatacacataggtatacatttacctattacataggtaataaacattatgacctgataatacagagtttctgatctgatagtgcctgtagtttctagatttctttatacttccttgcatctccatctttttgttagtacttctgcatgaaacatcttacctaagccacagctctcatggcatgcattctgaccctgatcatgtcaaactaaggaaggtttaacattttgtattaatacgtagctacattatgttgctaccatgactctctatagaatgtaaattacatgagagcagagactatgtttatgcattttcatcttccagtggttacaggctaccatggtatggcataaaggtgttaaaggaataatttgttaaattaaagccacgtttcctctccatgttgcctcctttttcttttcttccttctttccttccacctttctttcctctcttatatttatgaatggactcacctgcaggtaataagtgcaataaataatgaaattaaatatacaaaatacattacaatggttaccaatagtaatattttcttctataatattcaaaacttacataactttgggccatattaaggtgcaaatgaggagtacagagcatcgataaaatgaattatttgttaaatattagtattgggccacattagaaaatcattctttttcttttattcaaaagaaggaacagggaagcagaattttatgtcttagatgtttgaagcaactttctttttttctaacttaaaacacatgtaatatagagattgtctttctgtacacaggattattctaaagggaatcttgttctcttaaaaatgttctggtagtttgagctaagatgcaattagataagaacatcttgtgcatttccttgagtttcatttctacacttttcatttgggctatagcttttttttctgttatgggtgagagaacattagtgcaaaatagtaggcaatgcaggattatttgtctctaaagaattttgatgtgtgtgtgtgtgtgtgtatgtagaatgattatcctttgaaaacttatctctctatatttaatgaaattattatccttttaaaactgacattttcaaatcataaaataaatactgaaggaatcccattattttagatgcatatattatgtagagtcacttaatataaaatgaaatgagaaatcttctggtgcctttcatctgtacaattttttgcttcttattttgatctcaattgacatattttaatgcaatgtctaaaatatcaactcaattccatgcatagttttacacataagtctcagattgccagatattcattttaatctcatgtgcagacttgactgaattatagtaaacgtatatttattggtatgtttctaaaaggatgtaaaaatcgcaagctaagttattaaaagaatatataaaatttaaaatgtttctaatttttaccttttgatggctcaaatcacatcttttttattttcttgttatacattattgtctattatattggctaatgcaaaaaatagtttcacagtgggtcataagcctaatcaattagtggacacctaagaaaataggcagtttgtacagttttttaaaattgtttattttgtagattatcattataagggatatttgtgaacatacagagtataatttttacattggtttccattgcatagagtgtaagcattatttaaaatcttctactgtgtgtagttcattataattagagatgtaaattcaaactatataatattagctatgttataaaatttttctgtgatttattttttaatataatagacttttcttttttttagaacagttttaggttcctagcaatatcgagcaagcagaaggtacagagttttcccacatactctctgcctccagtactcaagtctcccatgatcaacatccctaccagagtgatcacactttgttacaattgctaaaccttctggacatatcattagcctccaaaatctatagtttacattatggttcactgttgatattgttcattctactggtttggacaaaagtataatggcatgtatccaccattatagtatggcactaaatagtttccctgttccccaaatcctctgggctctgcctcattcttctccccacccaaaccctggcaaccattgatcttttcatgcctccatagttttaccttttccagaatgccatacagttggaataatacagtatacagccttcatagagtaacttcttttgcttagtaatatgacattaaaatatatttccctcaatgtattttaatggcttggtatctcttttctcgttagtgctgtgattcattttaatgtaagtttttaaatgtgcaaacatatttatcttccatggctacatttgttgatagctgcttgatgggcgtagattaatgtaagagagaagaacacatatatatcctaattcacatacaaaatagaagtaaaatattgaccaggtgtggtggtgtgcacttgtagtcctagctactttcaaggctgaggtgggaagatttcttgatcccaggaagtcaaggttgcagggagctgtggtcatgctactgaattccagcctgggcatacagtaagacttcatttctaaaacacagaaagaaaaaagcaaaatattgttattgtttttatctccctttaccataagcaaaaatgatttaagtgtacttttcccagctatcaaattaactgaaatattcacagccttttggagatgtgacattttattattggttgaattcgtagatttttatcagaaattgcaaactttgaggcagcaagtctgggagacacatctctaactgcatttctctatgtcatagagatcagtgtggctcaaagaatggtccacagattggtgctgctctgtaacccgagtaggatgggtgcagaaattgagtgtcagcattggaaaagctttcacagcaacttgacggaaaaattatatattgattaattctaaaagcaatgaatttgcctttgtattttgcatgtctttttttcatttcaatttttaagtggttaattttcttgtattttgtaaaaggtttgttccataatccattggaaaaaaaaaataaaactggttcctcctgacaaatagctttagaagtgctgccaaatagtacgggcatacacaacaaagtttactgaatttgaaattaaacaaaatgagtgcacagtagggcgactttagttaacagtaacttattgtttatttcaaaataactaagagtggaaatggaatgttcctaaaccaaaaatgatacatgcttgaggtgatggatatttcaatttccctgatttgatcgttacacattgtaaatttgtatcaaaacattgtacgtactctatgtataactattatgtatccatgaaaattttttaaaggaaatgagtgagatttgacctctctttctttgaaaatcctgacaatagaaaaactgaagtactgttttgtcaaatgagaaaaagagtttccagagattttccagcaactcctcgccctccctctgtggaagagaacctctaaaatggctgccatgatccctacattctggtattcatgcttttgtgctcaaatttgggctagtgactcacttctccaaaaacaatgctatagcgataggatgtcattttgaaatcagctttaaaaagaccacactctatattacccatcctctcacgctctcttggagttcccacagtaggggaagccataatgtgagttgccctgtggagaggcccatgtggcaaggaacttgaactgagccagtgagaaactgaaggcctcagttcaaaacttagcaaggaacaaatcctgcccccaaatacgtgaagtattggtcaagacttcagaagagtaggcagccttggttgacaccttagtttcagccacgtggaagagttgcaggcagcagcgttcaactaaaccatgcccagatttctgatactcagaaagtgtaagataaatgtctgttgttctaagctgctaaattttggcataatttattttgtagctatacacaagtgataaatctttactgaaaaagggggtgagtcacgtactgccactgcaaactcaagtggattcctggggaactgttgttagctactatcttccacataaccctttactgattattataattctgttttagctttcaagtaaactagctattttttttttttttagaaagtgtgttgattatttggcagtattattttagtgttttgaaaaaagtgaaatctaaaactaaatattgggacaaactccaagatatacacattatactaaatttttgagtagtgcaaagggtgttttgaaagtcttatgtttatataattttaaagagataataaaggatataatagtcacaaagcaaatcttttagataagaatgaatcatattttagttcaaagattttagaagccatgaactatgaatgtaacactgttactacaggtaatagcaactatgcatcagattctcaatttatacatgtagaaaccaaataacaacaatgaaataaattaaaaatagcatcttaaaaacaaaaatcaaaactcagtgggaacaaaacagctttcagtttgtgtctaaaaacagatatgttcaaagaaggtattcacaggtattaatcacaataaaggactcaaagggaaataattaaagttcagttataaatacatcctccctaatacctaaccagtatacaatatgaaagagcttatttttgctactagaggggaaaaaaagcacagaaatacattcttgactcaataatgaaacaatgaatgcaccatttttcaggatagtactttcttaaaaagataactattattttactttcatttatgatgaccgttatttattttatacagtatttagttgaaattttgaacagcactgtatttttgttgactctatatgaaaatatttaatcagacggacatgcatttaacatttttatgttatataaatgtatgtatttatatttgatgatataattaaacagtcttataaactatattcaatatttagcattatagatgatttaaaattatgaattatgaacactaagataatgttataaatatcaaatgtaaaattatggaaataccataaatatttttacattattaatatgatacaaatgtattaatatttattgcacatatggaaacataaatttttacaaagaatgcaaaataaatatggaaatattggtattgttattttgcttaagcagtaaacaatatctaaagttttgatttactaacctaagaagcattctaggattagaagcacatttttagtacttagaggcacttgaccttaatttagcctttgattttcattttaaattgaggatcatgaaaatgtggaatagatatttgcaacctgtgtctaaaattttttctatatagtacatcataaagctttttataatcttattttccttggcttcagaatacatatcgtgattactttttctaaaaatatgataaattcatctgtagattgtctccaaagctagatgagatactgatggtcagaaaagaaaaaataaaagtacttagaaaatttggagacattaagatttgagaatagaattatgcaaattctattaacgttcttaaaattaatgttctttaagaacaataaatgtcttctccatctcaacaaaagatttattgtttcctacatggaaatagagaagtattccattaaatattgctttctcatttttttaagccttcttttgtgggtgaagtataggatggtataagatagtgtagtaaaagaccagatactgaatattttaagcttttcgggccttatggcctcagtcataactactgaactctgctgtggtaagcactaaagcagttataacatgtaaaaaaaaggggtgtggctaataaaactttatttacaaaaacaacttgtgggcctggcccataggccatcatggctgctgacctgtggtatgctggaatggtttcaaatgaaggctttggggctatacttctggggttctaatttcaagagtacttctaaatagttgtgtaaactttagcagatcatgtaatctctctttgcttcactttcccatctgtacaatgggagtgatagaatcacttacctcttgcagatattgagagtaaagtgttcagaacagttcctggtacagggtgagtgagtaataaattcaagccactatttttattaaatgtttttacatgtgttaatgtctttatagttacaatgaaaattcttaatatttaaaagttcttaccacaatgagataccatctcacaccagttagaatggcgatcattaaaaagtcaggaaacaacagatgctggagaggatgtggagaaataggaacccctttacactgttggtgggagtgtaaattagttcaaccattgtggaagacagtgtggctattcctcagggatctagaactagaaataccatttgacccagcgatcccattactgggtatatatccaaaggattataaatcatgctactataaagacacatgcacacctatgtttattgcggcactattcacaatatcaaagacttgggaccaacccaactggattaagaaaatgtggcacatatacaccatggaatactatgcagccataaaacaagatgagttcatgtcctttgcagggacatggatgaaactggaaaccatcattctcagcaaactatcagaaggacagaaaaccaagcaccgcatgttctcactcataggtgggaattgaacaatgagaacacatgaacacagggtggggaacatcacacaccggtgcctgtcagggggtggggggctaggggagggatagcattaggagaaacacctaatgtagacgacgagttgatgggtgcagcaaaccaacatggcacatgtatacctatgtaacaaacctgcacgttgtgcacatgtaccttagaacttaaagtataataaaacaaacaaaagattcttaatttatttattgaggcaaagtatttctttgtgtctttctctgacataaatgaattttaagttttgcatatcaatttaaaactaaccagtacacagtctctatatattcagagggattctaacctcaattttcagagactttcagagacaaatgaggaattgtcccaatggcactgtccttttgacactatttattttatttatgtttttaatctgtggtaagtcagggggcataaaatgctctgtaaaaaataaaaggctcaccaaagtgttataaatgaattctttcaggattctaagacacaacatggaaaatgagtgctacctgggtaataaatgtgacacttgggggcttgaagcagatagtttgtctcatatagataattcctttatacccagacaaagctttacctaatctattttgtgatcaaatcatgtattaagtatttctacacaggaaagtttcctcttttgtgaaatttattggcttaactgttatgctagccattcttcccctaataagatgagatgtgtaaatgagatcatatatatgccataatatataacctatttcagaataaaacagattgccattgctattttttagctttagaactagcaataccttatgatttatccaagctatcaaaatacaggaagcaataaaagttaattataataggaaaattctaaagtttggtttgagagggtttgggagattataatcacgtaatacagaaatcatagaaaatttccctcccaactccttagcatagagttacaaaatcattatattatttatatttctgtatagatatataaagattaacaaagtatttgtcaataagtggaacaatagcatattaaactttgctttgattatggagatttgaatgaaaataaaatggttgtagaaaggttaaaaatcaggggtctccctgccatttatgcttcccacaactataaatatttggctggttgacctactccttgggaaaaagtaggatctttcagtgtgggacttctggcccaatcttttctttcctggagaagactaggggcccaaaatactttctgtaatttttgttgtgtttgtaattatgttctatttgggtggaatttgagactaggacctatttttccacttactggcttgtggaaaaaataattcaacagtgatggttgttgctttcaagcgagacttaatagaaaccagtgggtcaagattggggagttagtcaggaaagtaagtttggattcagaataactgatgagcagtagggaatgaatgaaaaatccagaagggaaaacaagccagtgggtaagaaggaaaaactcagagaaatatggatggaatacagattaacattcatatgcagagccaagttgctacatgattcctcaggattttctctaagattcttctacagggttacataaccattttctaaggctaaagccagcatttagcatcaggtactcagtaggggaatgacattggaaggatttgcgtgattaattacagcaaaatcctgtgaacaagggattgtttggaggttctgtatctgtgtatccgaagatgcactgttatgaaagacatgcttgacctgactcaagatcttgtatattttatttcatcttaaccattgactaattgtatggcctggagaccttccatctagtcgttgttctgcaacaaacccgcccgctacgaaccagcccaaaatgtagtggcttaaaaccacagtttattatttttatcttatgatatcatgttctgactttcctagctggctgcttctcactttgagtctctaaagtgatggcagtaaaatggatgctgagttttgagtcagttaaaagttcaaaatggttctctcacatggttggcaattgattttggatgtcatctggtagccctgctggggatatagacaaatggcttctctatgtggcttgggtttctcttatggtggttggctgaaaggtttctcatgaactagcacgagaatgtcctgaaagccattctgccacatattattagtcacgcaagtcataaaaccatatgctattcaaagggaggaggatgaaaattcatcttttgttatgagtaagtagcaggatgaatatgcagtgaggaaagccattgataaaggccatctttggagatcatctatgcctatacaacagaagctttggattctttatctctaggaagaactaggtgatacttcagataccttgggaaattaaatttttgggttcctatgtcctatatcaacatgtttataagttaggttcaccatgaagacttctcactagcaacatttcagatttatttgttttctcttcttgctcccatcatgctttgaataggtttctctttacatacttagtccattctgaatgcatctggctttcacattagattctgagctccttgaagtcacaagctgtgtaccactcaattttctttttctgtagaatctactggagcacaataaatatttactggaacagttgaaaaaaataaaatcataagtctgatatgacactggaagattaataaggtcataatttatatgcatttggcatcagaagtcaagggtcaggggtcacaatggaatgatcaaaaatctgctttctaaccacctattccatatattataatcttcctaaaatataccatatattttattcaaaatttttatttttacatgatataatttaataaatatattcatttgtagcataatgattgatgacaattactagaatgttttcctggctataaaaataattagtgccatttttaaaggcatattatgaactagaactatattaatagtttgtatacattaatatttacaaagcttaacaacattattattagtttcaattttcagaaaataaaattggaagtcagagttgaaatcagagtaaatggtagatatagggttcaagtttagacttttcttcttctaaaagcttggtcttttccctgatgttctattattccttactgtttgctttctttgatatttatttttcattctaatatattaattgaaactgttaagctaaaatttgaaaatttgttccaggacaaattcatccttagatcttcataattattctttttagcattttattaaatttttattttttcatcctaatttaattgaaattggagccaattgttatgtgaacaagatcactcattaaacagtgaggtattcattttggggacaagaagaaaaatgacattttaaacattttaaacagtgatacattaatgaaatacaactaataagtattaacataataaaatgtaattctgaatgccttagagtaaacaatgtaacatcaattgggaccctgtgaattaaaaagaaaaaagtaagacagtactattgtaaaagcctgtctcctttttgggtgtagtatagcattgatgctattactttaagggagaatattgctaagatgttcattttaataataaagtgtcagtaaatatagttggcagtaccatagctgaatctaatgttggtttttatgtatttcaattggatgactctatacagaggtcttatatgaaatcctggatagtttgacatcagacttcaggtaagaaagtgaaatgctataggaatattatcagctaaactcttttcatatagattgaccagaatattctataccccacccagaactggactgtcatatttgcttagaatatgggcatagagtaacaaaaatagttaccattgataatcatcactttgacattcatttcatatttgaagtgtgtcttcaaaagcattatcctctgtgtctcactttataatgatgtgatctttttatagcagttaacgtaaattgcaaaatagttgtgaaaatatacaacaaaattgtgttcagtagacttcaatagtgtctctgtttagtaatatttaaaagtgtggtgctttgtaaactttttttaaacatagattttagtaagattttattgccgaaaccactcttcatagccactgggatgacttaaatggcttaataatggctaacataatgcctgagtattactctttttatgttcatcggtaggcatttatggagcttttgggcatcaagatctcctattcccaactgattctgtatcaaactctgtgaggatgcttaagcaatctctgacctagttctgtgccaatccaaattattccttcagacaatgggagagtttatcagtacagatgtagctgtgtggacacaaatgaaccaaacagttgacctttccgtgtaagcttatccttccgacccacctcacctgtacaaagcctagttgtaaccagttattggaacaggaaactagcttctccatactgggtgtggtgtttatttacactgatcacctttctgaacttatagttatattctgtatttataagaaaatagaaatttagtcagatatatttgtatgttatttattatagctaaatatgataagtaatataaaggcatagagcatggacatatgacagcatagttatataaatgacagtaagtcgataccaaagagtattatatagccattaaatattttggagaaaaaaacccatacagttgtaaagtgttcttaataaaatattacacaaaaatctgcatttaaaattgaatgtttaatatactttcaatattatatttgtggagaaaatctgttactagtagcagtactttgttgtaagatattttgattcatttgtctttatttaccaacaactctacatcagctgtattcaaatgagtgaatttttcttccagaggatatttggcaataacttgttacacttcccttttgtcacaccttgtagtagtatccccaccggtatctcatgagtagaagcagaggatggtactaaatagcgagcaatgcacacaatagtctccctacccctaacacaacgaagaattatctggctcaaaatatcaataatgccaaggctgagaaactatgctctacaatacataggtgtgctcaataaagtgcacatatattttatttaaaattagagaaaaaatgcaacattaaaaccacaaggaaaaagacagtttaaacaataaaacacataaacccaatttttatgtagactttattttgtggaaaacttatagttattatttctgtaagtacaagaagtaggcagtggtttaatattaaattctaatggtgtctgtaactcactccataagtttttgaacatatgtgacaataatccaactttgcctcttgaaacattcaggattggtttcagtcgtttaaacccagaatttctccaattgagggcaactcttgtagttgttttctaaatccctggttggcttattttggatataaattgaagcctgagaacaaccaatattcacacaaatgttttgaaacaaaagaaattgcgcctgaatgaacacttatgtgaaaatacttttatttctcatcctggcaaaattcctaagatttaatgaggtgaaactatttttttgtttttttgtttgtttgttttaatttaaagaaaacaagtctagtgatgtgagaacacaaagaatatgtctaaaaatgggttagtagtgggactactttgcatttccatcatatatatgtctgatccccacagtggccaggcttcgagattgcccttgacataaccaggaaaaccaagttcatgttttacaattgtgattatagatttttatatagctgtggtcccaaacgaaccaagcttgaccatattattctgaaggaagatcattaaatgtggttgaggttagattttaaaattatattctttttaaatatacattcccctaattcctgctcatctctgcaggtgttcagtgttgcaaacactatgtgctatgtgaaacatgctgctttgacatcatctgacttcagtgctaacaatgtcagttctacacggtttccaccttcttgggctctgtgatgtttacatgaatggactcactattaacaataaaaacttggccacatccttttgggtgttgccactggtagctgtaccatgtcagtacagtctgagatgacagcaaaaacattttttcttcttgcatttactatagcaataaatgtaggtatttaaaaatttgctgcgtttgactttttttttttttttttttttttggagagggcattggatttgaaaataggaggaggaggagtttatggctgtttgtaagaaatcagaaaaacaaaggatttggtgagcagtaatgacagcttgtccgtggtgttgcccaaagacactgacagacataaacttgacccttatgagtagctattaagatttagcacctcctttattccagatactgtgctggcattttacacatttgataactaatcccaatatctccccctcaaataggtagatattatttttccaactttcatcacaggactctgaggatagtctaggccatcatcttttctaaagtgatgcagctaataagtggtagagccagacttaaaattctggtttgcccgtctccaaatccatcactcacgtgtgcatgtctagctttctgttctgcttcaggagaggcctaaaactgtagctgcccaattcctccccatgcttggaatgaatcatagtcatcatcctcaaatagtaagatacatttttaaaaataaaagatattaaatgagtatgttacgttgctcagctcaagttttgagacatttagtggagtaatttaatttgaaagtctaattttccaagaattgtatcatgctataattgtatttaaaaatattttaaagacaatacataatcagtgtttattaattatccagtagcattatcctttcttaatctaatcctagataatttagtggaaaatctatgtgtatagattgctataatttgccctcctcttaatataaccctatctggacataaatatatcaactacagtgatgtcatttttttctttttgtttcattttttaaaaaatttgaaattggtggggtgcaattacagaaggtagtgattaactgttagtcacattaaaaaaacttctgaaacttaatttaaaattttcataaataaattaaaggattgcatttatttctatgattgaagtcagtgctacattttcttccttatacagtggagacactaaaaaagaggctagaaagaagattcaaaaaaggaagataagtcattatataaaactgataattgcactcatatgtttatcacagcactattcagaaccgtaaatatattagatttaatctaactgcccatcaacagttgattggataaaggaaatgaaatactattcagccataaaagggaatgaaattatgtcttttgcctcaacgtgggtggaactgaaggccattattttaagtgaaacaactcagaaagagaaagtcaaatacctcatgttctcacttgtaagtaggagctaaataatgtgtacacattgacatagagtatgaaataatacacgagatacttggaagggtgggacggtgtgaggggtgaaagctgagaaattacttaatgggaacaatgtacgctattcaggtgatggttacactacaagctgagacttcaccactatgtgatattcatgtagcaaaaccgcatttataccccttacattgatacaaagagaaagaatctctgctgaccccttttgaattctgtaacttctgtagctttccaattaactgacttgagtgggtctaacagtttagagcttggaaatgttacagcttcaccatgatgtgctactctcttttggcaggttaccatagtgacaacagtatgttaatttcaacagtgatatctttttaatttataataaaatatgatattaatgaggaattttataaggcttttagagtggtaaaaacggtaaatagacatagtctatttggccttacttttaaaaattcttttcagtatacgttgccctacatttgtgctgtactgtcatatttactaagtatatcgtaaatatattgcattgattcttttccatattaaagaattaaactttaggcaggacttaattaggtgtgcattcttttcaacctctagattgcattttgatgaacttcttagatattcgattagcaagagaatgatttgcataaagcatatttacactccatgggccactgcagaatcacttggtattttccctgctaaattaatagttccacttattgttgtactaggggacaatgaagttgtataattggaaactggtaagatactttatagcttattagctttaggtaattatctgcatgttatattatgcactgaattgtaattgaaaatattgcattgtaatatttaggagaagtggcaaccaaaaatagttaaattgttatagtaaccattgacttgcaatgaaaatgaacaggtttattgaaagacatttctgtaacttgaaaacagtgtgttcctttttgataactattctttttctcttgtttcttttttatttttatttatttattttataatttgctgcttgccattgcaggaagtagaggtttgtatacagcttctgtgtttcatatttaattttagattttatatgaacccttgcgttttaattacttgtatacactcaattcacattattttcccccttaggatgattatttccgcacttggagtccaggaaaacccttcgatcagggtaagaatctaactattttaaaataaaaacctttacatgttcataatcattgtacttttagaaatgatatttactgtctggttaggcttgaaaatactaaatagaagagcttacatgaatggaaaaatttgtgcaataattacttacatttcagcataatatttttagaagtaagctaattagttatcatgattatgtcaggatgtcttttatttttagatacatgttttagatgactgatttgggcttctgaaccttaccaggtttatttttatcagtagatacaagtcacttcatccagttttcaagtacattcactgggcaatagatttatttgtacaaacttttaaaacaaatggctttttttgcctcttttccaattaataaaaggtttcctttaagactagtaaattagtaattagactcagctggggtcttaacaagccccaaaaggaaacgtgttatacaaaattagggcttccccacctcctttcaaacagtttgcaattctgattaacttacctttaaaaggaaaacaagaaatagggatgaaaatgaaaatacttctacatgtgcaatgagaatggacacatcaagccccaagcaatcatagttacataaatgactaaagagatttgtttactaaagttcacatttaaaaagtatcttacttttaaagtttctttttgtaactttctgtagtctctgcaaagtagaaaaaaaatttcttctttacatagagtatatagtaaccgtgcaaaagataatactttgtgaagtagtcagacttaaaaatagaagtttttgtaagagtgtttagtaagtgattagatgatgaagacacaatatgttatttaaaggagctcagagtattttgctatgttaccagatttttacttaatatttggggtgactgctacaacaaccaagctgtatgagtgagaaaccacctgtgtggacctagacatagaccatcatcaacattggtattaacatggagtctgaaacagtcattcaaatctaatatcttcttaaaacaacttttttcttatatatttcatttgatttcactattatccagtgtttgtttgtgagatcagcattttaaaattctaaaagaattaattttgaatttgttactaataagtcaagccaatgctctaaaacacaggcaataaaaaaataatgacatgcagacagagatgttatttactggctttcttgggaaatgaatttttatgatagaatcacaaaccttgtaaaatgggtgttagctatggaatttgtcatacttggtgcatccagttataataaagatgtttttattttcctttatgtgtgcatgacaatgtgttgaattgcaatttatctctcataaaaaaaagaatgctatttgagagtcttccaaacaattaatgatacaagattgatttgctttaatattaagagaggtttttaacctactaacttaaaaatattatgtttatcagacagggataagcttatgacatgataatagctaatgtttatgaagaatgtcctattttgagtcactactccaagtgtttgatatatattacttaatttagttgttataaccctgcaaggtagatgaagaagttaagatattgaaagcagttagttaagctcctgctcaggttatattcccacagtgtggcagagtggagatttacattcagtcagtctgaacccccaaacctgtttcctaactgctatgcaatattaccactcatatgataacactatcaagaaataatggcatcccgatgatattttgaagtttatgctttaaaaatgcacatttacttgaacaaagctttatttctatatgttaaaacagtattttttagactatctgatctcaagttttgatttcttgaacatatatagttgataaacatgtaagaaagttttgtatcaaaaaaataaaaatcgaacaaaaattagattgagatatgtgtatttgtttttcgctttgagtcaaattgaccaacctagttgtagaccacactgaggagtgagcaaaataatcctatttccatctaaatagtgtccatcatctacatagaaaagacatgagatatgttcatttctagtatgtttcttgcttttcttggtgacagactcttccttcaagtattattttcttttttgtttgttttttcttttttttttttctgtgcctggtttattttacttaacataatgacctccagttccatccatgttgcaaatgacaggatatcattctttttatggctgaatagtactccattgtgttcaagtccttcattttctttctttttttattttattattattatactttaagttttagggtacgtgtacacaatgtgcaggttagttacatatgtatacatgtgccatgctggtgtgctgcacccattaactcgtcatttagcattaggtatatctcctaaagctatccctccccactccccccaccccacaacagtcccagagtgagatgttccccttcctgtgtccatgtgttcgcattgttcaattcccacctatgagtgagaatatgcggtgtttggttttttgttcttgcgatagtttactgagaatgatgatttccaatttcatccatgtcgctataaaggacatgaactcatcattttttatggctgcatagtattccatggtgtatatgtgccacattttcttaatccagtctatcattgttggacatttgggtttgttccaagtctttcatattgtgaatagtgccgcaataaacataggtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaacaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcatgaatgtcttcttttgagaagtgtctgttcatgtcctttgcccactttttgatggggttgtttgtttttttcttgtaaatttgtttgaggtctttgtagattctggatattagccctttgtcagaagagcaggttgcgaaaattttctcccattttgtaggttgcctgttcactctgatggtagtttcttttgctgtgcagaagctctttagtttaattagatcccatttgtcaattttggcttttgttgccactgcttttggtgttttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctggccagttttcccagcaccatttattaagtagggaatcctttccccattgcttgtttttctcaggtttgtcaaagaccaggtagttgtagatacatggcgttatttctgagggctgtgttctgttccattgatctatatctctgttttggtaccagtaccatgctgttttggttactgtagccttgtagtatagtttgaagtcaggtagagtgatgcctccagctttgttcatttggcttaggattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccacaagcatggaatgttcttccatttgtttgtatcctcttttatttcattgagcagtggtttgtagttctccttgaagaggtccttcacatcccttgtaagttggattcctaggtattttattctctttgaagcacttatgaatgggagttcactaatgatttggctttctgtttgcctgttattggtgtaaaagaatgcttgtgatttttgtacattgattttgtatcctgagactttgctgaagttgcttatcagcttaaggagattttcagctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtctgagagacagtttgttaaaattccgatcttttacatttgctgaggagagctttacttcaaagtatgtggtcaattttggaataggtgtggtgtggtgctgaaaaaaatgtatattctgttgatttggggtggagagttctgtagatgtctattaggtcctcttggtgcagagctgagtttaactcctgggtatccttgttaactttctgtcttgttgatctgtctaatgttgacagtggggtgttaaaggctcccattattattgtgtgggagtctaagtctctttgtacgtcactcaggacttgctttatgaatctgggtgctcctgtattggatgcatatatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctgcattcttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgaagttagctggttattttgctcgttagttgatgcagtttcttcctagcctcgatggtctttacaatttggcatgattttgcagtggctggtaccagttgttcctttccatgtttagtgcttccttgaggagctcttttagggcaggcctggtggtgacaaaatcgctgagcatttgcttgtctgtaaagtattttatttctccttcacttatgaagcttagtttggctggatatgaaatcctgggttgaaaattcttttctttaagaatgttgaatattggcccccactctcttctggcttgtagagtttctgccgagagatccgctgttagtctgatgggcttccctttgtgggtaacctgacctttctctctggatgcccttaacattttttccttcatttcaactttggtgaacctgacaattatgtgacttggagttgctcttctcgaggagtatctttgtggtgttctctgtatttcctgaatctgaatgttggcctgccttgctagattggggaagttctcctggataatatcctgcagagtgttttccaacttggttctattctccccgtcacttttaggtacagcaatcaggcgtagatttggtcttttcacatagtcccgtatttcttggaggctttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctccatcagctcctttaagtacttctctgtattggttattctagttatacattcatctaaatttttttcaaagttttcaacttctttgcctttggtttgaatgtcctcccatagctcagagtagtttgatcgtctgaagccttcttctctcagctcgtcaaagtcattctccatccagctttgttccattgctggtgaggagctgcgttcctttggaggagaagaggcactctgctttttagtgtttccagtttttctgctctgttttttccccatctttgtggttttatctacttttggtctttgatgatggtgatgtacagatgggtttctgtttgttagttttccttctaacaggcaggaccctcagctgcagatctgttggagtttgctagaggtccactccagaccccgtttgcctgggtaccagcagcggtggctgcagaacagcggatttttgtgaaccgcgaatgctgctgtctgatcgttcctctggaagttttgtctcagaggagtatctgtccatgtgaggtgtcagtctgcccctactggggggtgcctcccagtttggctgcttgggggtctgctgtcagggacccacttcaggaggcagtctgcccgttctcagatctccagcttcgtgctgggagaaccactgctctcttcaaagctgtcagacagggacatttaagtctgcagaggttagtgctgtctttttgtttgtctgtgccctgcccccagaggtggagcctacagaggcaggcaggcctccttgagctgtggtgggctccacccagttcaagcttcctggctgctttgtttatctaagcaagcctgggcaatggcgggctccctcccccagcctcgctgcagccttgcagtttgatctcagactgctgtgctagcaatcagtgagactccgtgggcgtaggaccctctgagccaggtgcgggatataatctcctggtgcaccgtattttaagcccgttggaaaagcgcagtattcaggtgagagtgacccgattttccaggtgctgtctgtcacccctttctttgactaggaaagggaactccctgaccccttgggcttcccatgtgaggcaatgcctcaccctgctttggctcgcgcacggtgtgctgcacccactgtcctgcgcccactgtctggcactccctagtgagatgaacccagtacctcagatggaaatgcagaaatcacccatcttctgcgttgctcacgctgggagctgtagaccggagctgttcctatttggccatcttggctcccctctctagtattattttcaaaagcttattaatgtattgaacttaaaatcatttaaaagactttttgtgagcatttttagtttttaatttaccatatttttcactgaattatggacatccatattagatcactataagttgattttcccctttttcatttataagaggtttgcatgttttctaaaaaaagtgaagaaaaacttacattgtcattatatttttatactgatatttatattgttttaactattaatatatccatttaaagttatcttttacttcaatttccatagaatgcaccataaagcatgcagaaattaaggtatcaccaatgaaaatgttaatcaatattttataatatgaatggtgtaaattctcagcacaaaactcctttctatatatgcataccaatacatacatacatacataaacatatcgattacatattttcacttggacagacacatttacacttgcaaatttgcttctagataaaatcaactaattgttcgtgtacacctgatctaccttttggtttaactatgacatatttttcatctcatttaagtttcttttaatcaatcatttttccagtttctttatgttttaccactaaaacagtaagagttttggggaaataaaatgttttcaaatgagcttaagtaaaaactattttgatgatggtaatctgctgcaaaatgagctaaagcatgccaataccaacaatatattggtctgggcatctccacactgatttttctgtgatattacttctcttcattagtgcagttaatcatgagttgacatgacagaaattacctgaaaaattgttttgatgaggacatacatcttgaataaggcataaaatgtatatggtttgctacatttactatgataaataaactgaagggaaaatgcatgtgtgaacctaggtggtagcatgataaagattttaaacaattaatcaatgctttagatgaatatgctgtagctttcaaaaataaatattcacatctttccattcactgtgttaaatctgccttgtttgtggtcataaattgatattggtgtgtaacggatacatcagtaaagttcctagcagtgaatcttgacagttgctcagagaatctgcttgaactgaggtaccctatctacaaggatcaccttttatttaagtgttattttctccagcacacgataaatatcataaatctctaggtgtcctaaggtgaaagatttagaaggaaaatatgctttctaggttttcctaactttgctatccaaaggaacttggagcgtccctacttgttctctaccatggcagtaaattattatgaataaattaaaaatgaagaagatcaatatacagagatccagagatataagaacgaacccgtttcattttttgatgtgtttctcctgctcctccacgtttttggggatgttgaattaggggcaagaagtgtagctgtggcttagatcagcatccttctgtcttttctcagtggtttcattgtgtgctttcttcttaaatcagagcctctcaggaagggcagcctaacatctactggttcattagattgcagttaattctcttttttttatttatttgtttatttatttatttatttttgagatggagtctcactctgtcgcccaggctggagtgcagtggcctgatctcggctcattgcaacctctacctcctgggttcaagcaattctcctgcctcagcctcctgagtagctgggattacaggtaccctccaccacacctggctaattttagtatttttagtagagacagtgtttcaccatgttggccagggtggtctcgaactcttgaactcaagtgatctgcccctcggcctcccaaagtgctgggattacttgtgtgagccacagcgtgtggccaagattgcagataattcaatgaaagttcccaaagaggaggtatgtgaggaaaccatttctaaactcaagcagctcagataatctagccatgagagacagatacacggcagctaaacttataactagaggaagcattctggcaagaattagagggtctggggaggggcagttttgagaaaaaaaaacaaaaaccagctctttggaagggcagtcatgtgtttagccatatacttatccattgtatttattgcttcaggatcatttcttagagctttatctgactcccatcattttttccatccatttgcaaaacgtctcacatataataacattcacagcctgatatgtccttttgcaatcagtatttggctacaaaggaaaagctgttaagatttcatctggagcttttattcccttcagtgaacagagctgttcatagtattatgggtgtaattatttccgaaactgaaaaagactagtgtttgaggaaatgcactcctaacttagcttcctcttcttaaaatgcactattattacacttcttaaggaatagtttatgtagattagacaatatcaatattggctgtctcccagatgcctttaatttttacttatttacatgagtatcatttattttttatgctttcagatgacatttattgacagtattctgaaacaatagaaaggtctgatccatgcttcacaataggggcatggtggtatcataatgctgctttgtttaagagcttagggacttttggcatttttctagtggaaaaattggtgttcccagtattgaaattcagtggagggaacatgcaaggatgattacatgattacagtattttctgaaagtgatttcagtcatttagaaatgtaaattctgagcctttatttgattaattcacatgaattgatttaggagttttgaatatttttggacaagttccctgtttagacattcaacttctaataatcttatcaatgtatatatcctacattggttgtatcatccatattggctaccttagatcatagaagtcctttgtatccctgaggaaaacctgctaagaaattatattcaagctagaaaccaacagtaaatgctcatttattctatgtcagatttattacctaagaactacatagggcttctaaatgagaaatttatttcattatccaattcttacttctttatacaatgatggtgttttatttgttttacaccatagcccataaaatatagcaccaaaaatctttgattgttttgttctataccaaatgaaggtacatgttccataaaataataaatactgtgtaaaggtctgtgtttttaattcataaggtaaaatcaagattactatataatgcttgatttacttcatatcacattagcctacataggtgtgcaagaaggcaaattatatctattttccgtttccttatatgttattaaattgtaatcaaatatatagagcaggaagttaatcaaattaatttagaaggtgttcagtgatttaagaaacaatattcttcacaagccgaccctgactttcaggaagtgaaatgacaatggcagaatttaactgaagacacacaatctagaaatggaaccactgctcttttgacaggcgccacctcagtggcatcactgcaaagtccagattgcctgacaccctgataaccaatgattgggggtcaggtcaaagtcagggtcggcttgtgaaaagttgttaaacaacatgctaagtgtgaaatgtcaaccctcactctaaactttccctgttcagagcatcagatgaagacttcattgggttttacagtggttttctgtgttttgctagtccattgaagaagggagtttgaaagttgttgtatactgctaatgattgtctgcccatgtccttcctgaaatagcacgattgtttatggaaagtatctttaataaagctggatacagtttgtcttggaaaaaacaaagaaagaaacaatattataatctgaagccttgttaatctaacacaacaagaagaattattaagattgaaaaaactctggacatacatagaaagtcatacttttaccaggaggcctctgctggctagagaagtgattctcagtccttgctgtgcaggagaattacttcacactcatttaaaaagtatagttgtctaggcttgatccctgaatgttttgattcaattgatctcttgatccctgaatgttttgatttaattaatctgggcactttggtgtgtgtgcttaggctttttgtttattattttactttttaaaaaattacagtaaaatatatataagataaaatttaccattttaaccatttttaggaatatagttcaggggcattaggtacattcatatcgttttgcaatcattgttattatccatctccaggactcttttcatcttcccattaatgactatcttcagtttattgggtatgaactgaagctatacatgcattagacaataactctcctttctctcttcccctcagcacttggcaaccccaattgtgctttctgtttctttgaatttgacttttccagacatctcctataagtggaatcatacaatctttgtccttttgtggttcacttatttcacttagtgtaatgtcttcaaggctcagccatgttgtagcatgtgtcagaatttcccagtttttaaggctgagtaatattttattgtatgtatatcccacattttgtttctctgttcatctatccatagacacttatgttacatccaccttttggctattgtgaatagtgcttctatgaatgtgtgtgtctaaatatgtttgggtctctgctttcagttctcttggttatatacctggaaatggaattgctggatcatatggtaatcgtatttatttgggaaacaaccatattgttctcgacagcaactgcatgcttttatattctcaccagcaatccacagggttccaatttttcctcatccttgtcaacattattattattttaaattaaaatttatcccaatggttgtgaatgtgattgtgtttcaaactccaaaatttgttattttatgcaggtatagtagagaatcatagggtactagcaatggcttatcaaaataattcatttctgtcattttctttagtagtactgagaattttgtgtagaaagagttcttattaaaacagtccaaagtgtcagagaattttaactaacctattcacctttcagatctggtgccagaagcaggtaccaaagggctttgagaataaattgtgggaagcaagaaaacccccaaagaaaaatcattgcctccattgaacacacactccctatatgtcaagtattttatagaagacacttacactaccttaaaaagtagatacaaagctagtaagtggtgtagcggaggtttggaattttgtatttgtggttttgaaggacgtttactcttttgttatgaaataccgatttataatcagcttacctggtttatttctcaactcagagtatacccttttcatgagaagacatggtgggaatggcacaggtgaacacaggcagctaaagggtcaatcatttggcatatgttgttgaatcatatatagaattgttccacaagagaggatatgaggtgtttgtaacttgtattctaatttttagaatctagaaatatagtgttttaaactgactgcctctaatgtctgatctttataaatgatttttagatagatttagcattcatctgataatatatcacttaatatctagattttagagcatgatttttctgattctaatgaatattttataccaaatattatttaaaagtcctttctcaggtcaaaataaatctatttgcactgctcctcaaactgactcatggtctatataaaaaagaggtgatataatctgagtttgtatttcaaaatcctcattgagacaccagcgagtctagtgtgtttgtttgctttcacgtaaaccctctaaaagttccacgtgtaatcaacctgtacttcacttccaatctttagacagtatactttgttttgtggagaagcaaatatcctaaagaatttgaaatttgctagtattgtacccactttacttacaaatattttataattcagttttgaaccttttttgttagtaagtagggaaataactcaaagacaataaaaacttcaaagatgcttgaacccaggaggcagaggttgcagtgagctgaaatcatgccattgcactccagcctgggtgacaagagcaaaactctgtctcaaaaaaaaaaaaagaaaaagaaaattaacttttcttgaaatacattggaatatgctgtgcttctatctttgcatatctgatcatctccataggtttaagatttaactttcatatgaaaaaaagctaagtgatttttcagttaacacttctcattggagaactagataaattatctttttatggttcaaccaccagtaattcttcaaagtaaacaagcacttttacataaatacctgcccccacatatgtatctatcattatttatccatgatgtcatgatgattattgtgtaattaattgtgccaaaattacaaggataaataaaaatgaatgaagaataaataaatatactatgactgctcaattcttcaatcccagttgtattgagattgcatctaactggatccttccacttaatcagaaatgaattaatatggccttagatttagaaaaccataaaattatcttcactaaaacaagtttctctctattacacattttccaccatggaaatattctttcataatttatgtgttagctgaaaatacgtttttctaaggcatttgttatggaaggaaatgctatttcctaagctgttgaagtttccaggtatgttcagttttatacagttgtcaggatcttctagttttcctatcatctgaataacaaaatactatgtaataatatatattgggcatgtctggtttcttccgacacttattttagaacagtataaaatcacctgtataatactttcacttttgaaatacatcacacactacttttttttcttttgcatttttgtaaattacctaacaatctagtatgtaaactctagactaatgcttgtttacatagtcttagatgtctagaaagatgatgagttgaacatgtttacttctactattgaatactagatcttttttgacaatataattaatatataattattttaggtaattgcctcttacatgctttaattaagataatgtgtagtatttttatacacttcctataactttctagaggaaaccatatatggaactcaggaatagttctacttaacatattttcttttcttttcgatacaaagtatctctcaggagtgcagtgacacgatcttggctcactgcaatctctgcctcccttgttcaagcaattaattctcctggctcagcctcctaagtaactgggattacaggtggacatcaccacacctggctaaattttgtattgtgtagagatgggcttttgccatgttggccaggctggtttcaaactcctgacctcaagttatctgctggcctgggtctccccaagtgctgggattacaggcgtgagccacagcactagggttacttaacatattttcaaccaccatttagccttctcatttagtttcaattgttataaaatagatagtaaagatagtggaatccccagtgaagacaaatattaaaatgcctatagaaaaatcattgtctgactgccaaagttagaatctaaatttttatagtgtcttaagtttaggtcaataatgttaagtgagttggcaagcttcataaaccaaccaatccaataattctaacataacccataaattcatattatgcatttttcttagtggcttattttgggaaattcatacaatgatttaaaagtcataatttggcctttgcaaaaagaaacaaaagtttacgactagttatcaatcaatatgaacttatatgtctagcctcatcaggttgttagaatacatcttcagtcaaaagcaaaatagtactttcctgatttttaaatctttaactttctacttagtataacttctctctactcaaattatttttatagttaccctatttttaaaatactcgttagatgttacaagcagttacatttatgacaagatgtcatctatcaaactcaagctctactttccctatgaagatacctcttatgactgtaaatgcattctcttttaaattcactatacttatcttcagaaatgcctgccttagaattcacttggtctttgttttgtgagagttaatatgccttcttgattgagatcataagctcgtcaaagtcctagcatgtagttatatccgtatgtcctctacaaagtcctgtaccgttgcagataaatatcatatactcttcactagagtcaaatttagacatttctctttctccattttgtttctgtttctgagtctttgcttctgtctccccacaacttctttgttacttcaagtctagttttaataatcagccttcctcttaacactattgtttatttcatgctcattgtgtacaattatcttacaataaattgagttttaaaaataaataagaatctcagaaaggtgccaggtgtggtggctcaggcctgtaatcctagcactttgggaggccgaggtgggtgggttatgaggtaggagttcgagaccaccctggccaacacagtgaaacttcatctctactaaaaaacataaaaaattaactgggtgtggtgatgcacacctgtagtcccagctactagggaggctgaggcaggagagtcacttgaaccccggtggcagaggttgcagtgagccgagattgtaccactgcactccagcttaggcgacagagtgagactttgttaaaaaaaaaaaaaaaaaaaaaaaaagaatatcagaaagaaaaaaaagataataaaggaacagaataaatatttgaaacaataatgacataatttttcaaaatttgtgtcagacaacaagcactgatgcaggaagctcagggaacaccaagaagaataaatgcaaaagaaaaccacccacatctaggcatattatttttaagctgcagaaaataaagcaaaaacaaaaacaaaacaaaactcaaaagaagccaggcaggaagaggggaaacacatttcctgtagagaatcaaacacaagaatcacatcagctttgcctcagaaaccatgcaagcaaaaagagtcaaaaaatcaacatgctgaaagggggtaaaaaaaacaagttagaagaatataccctgatgtaccctgttaaattttactgctaaagtaaagaaataaagagttgtccagacaaggaaaatcgagggatttgttgccagtagacatacatgacttgcaggaaatattaaaagaagttcttcggagacaaggaaaatgatataattcagaaactcagatctacataaaaaggaaggttactgagaaaagaacaagggagggtaaaatggattttttttctacttttagtttatttaatagattgtagtttgttcaaaattataatagcaacagtgtattcaagtagatatgcttatatatctgtccttatttatgcttatgtatagatgaaatgaatgacagcaaagttatggaaagaaggaattataaatattttattattgtaaggtacttgcactacccataaagtggtagagtattatttaaaagtggacatggattacttataaatacatgacacaaactctagggaaactacttaaaacggtataatttaagtagtagaaactacttaaagcagaagtataataaatattctatgaaatgagaaaaatagaatcctaaaaaatgctcaattaaaatcacaaaaggcaaaaaatgaaagaaaatagaaacaaagcacaaagctaacaaatagaaaacagtaagacatatggtaaatattattccaactatatcaataattacttcaaataccaatagtctaaatgtgccaattgaaagacagaaacgctcatagtgggtcaaatacaagaaccaactatatgcttaaaaggaaccgactttaaatttaaagctacgtatagattaaaagtgaatggatagagaaagatataccatactcacactaataaaaaataagcagaagtagtggtattaatttcagaaaaagtagacatgagaacaaagacaattatcagggacaaagagggacattacataatgattctccaaaaagatagtctttaacttgcatatgcctaacaagagaacaaaatatgtgaggcaaaacctgagagaactacaaggaaaaatagttgaattcactattgtactggagacaacatccctccactagaaatgcacagatctaacaggcagaaaatcagtaagaacatagttgaactcacagcaccatcaatgaaacagataaaattgacatctatagactgcttcatccagcaacagcagagtaaacatccttttcaagctcacatggaacattcaccaatataggacacatgctgtgacataaaacacacctggacaaattaaagtaataaaaatcatacaataactgctgactgcccataatggaattaaagttgaaatcaataacagaaagataaccagaaaattccaaagtatgtgttgattaagcaacatacttgtagatatcacatgtgtcaaagaagaaataccaagagaaattttaaaatattttgaattaaataaaagtgaaaacaaattatcaaaatttgtttgtggcgtgcagtgaaagcagtgcttacaaagaagtttataccattgaatgcatacatgagaaaataagaaagatctaaaatcagtcttacaggctcttagtaaacttgaaaagaaatttaagtctgaagtaagaaggagaaaaaaataatagagtaaaaatcaattaaattgaaaaaaggaaatcaatagacaacaaaaccagaaactggttctttgaaaaggtcattaaaattgacaaaactctagccaggctaagaaaaaagaagggtcacaaattactattatcagaagtgaaagagacaaaatagctacagatttcatgaacattaaaaggataataagtaaatattatgaacaactctgtgcccacaaatttggtaacttagatgaaatggaccaattatttgaaagacacaatctgctaaaacctgaaaaagaagaaatagtcaattttagtagactgatatctattaaagatgttgagtcaaaaattaataacctgtcaaaacaaaaaatatgaaactcagttggatatactggtgagttcaaatcaacctttaaagaagaataaaacaattctccgcaattttttagaagatagaagaatcaaaggaaatacttcctaactcatcctaaaaggccaccatcatgctaatatcaaaatcagacaaacacattacaaagaaaagaaaacaaacactgtagactaggatctctcataacatgggtgcaaaagtcttcaataaagtattggcaaatccagtccaaaaatgtattataagattaatgcactacaatcaagtgaggtttatctcgggaatgcaaggctggctcaatataattcaaaaccagttatcccaacacattaagaatatagagaagaaaaaaaattacatagtaacataaagagatggagaaaaagcatttaacaaaattcaacacctattcatgataaaaactatgtataaagtaggaatagaggttgacttctgcaacctgataaagaacatctataaaaaacctgtagctaccatcatacctaattatgagaaactctaagcttcaggaataagaatgttccttttcaccactgcttttcaactttataacgaaagtcctaactaatgcaatgaaacagaaaaggaagcaatgatatacagattgaaaaggaataaataaaactgattttgttccctggtgtcattgatgtagaaaatcctaaaacaaaacctcctggaattaataaagattataacaaggttgcagaatacagagctatcatacaaaagtcaatggccttcctatacttcagaacaaatgggattttacattaatgcaatatcatttacattagtaccctctaggatgaaatacttaggtataaatctaaccaaatataaacaagctttctataagaaaagcagaaaacactgatgaaataatgagctatcaagccacagaggaatgaaagatgcagactactaagtgagagaagccaatgtgaaaagtctccatgctatataatgccacctaaatgacattctgcaaaagagaaaactgtagagacagaaaaagtgatgaggttgctattgaagagagaaccagtggtgtgtgcctcaccaaaattccaccatctcttaaaaaacaggataatctgctgccagtaataagtaaacattagtgaatagcaatgatcaggggcacacaaataactaccccttaacccacttattggcatgacttacttgacccttaggtatcaacctaaagcccttataaagcatctggaagtaaacttggttgattattctattttatctaaaaattctgtgaacatgttcagaaacacttgatcatttttgaagatgttctaatgaaagcctttttaaccttaagagggatttattgtttttcctttatagggggtggtgtaagtataaaactgtcctaaatatgaattacttttcaggtttctcttttcttccacacacaaatttaagacatatttggtaaatcagagttttctgatcagtctactcatgaaactcaactaggtaggactttaacagacaaaagtatgaacaccaggcctgtctactacatcattagctccatgcctggatctctgaactttatagtttcacaaactccacatcatatgtatttgatccagacatagtttaagttaaaacaattacataacaattacataacatatcctatttgttgtttctgttcctctaattcagtattctataagcagcagttacagtcagccctccttaaccataggttccacatccaaggattcaaccacagatggatagaaaatacctgcatatgggttgaatcccctgattcgaaactcatagataaggaggcctgactaaaggacttgggcatctgcaaatttttgtgtcttctggagatcctggaatcaattctctgccagtgctaaaggatgactgtacattgtgttatctgttatgtttggatagctattgctacacttgatatatctaatgaaaggattaaataaaattctaataggagggaaaatggaattttgaatatacttttatttcattcaaatctaaacatgaaattgtttaatgcaatgcttattattgaggaagttattttaaatcatatttataatttacattttaccattttttcatttaatttttatttgtaattaatacataaaattgtatatatttatgaagttcagtgggatgttttaatgcatgtatacatggtataatgatcaaatcagagtaaataccatgtccatcactttaagcacttaccatttctttgtggtggcagcattcaaaatacttccatctatcttgaaacatacaatacattgttatttgctgtagtcatcctacagtataatagaatagcaaagccgagtttcacttctgtcttgttagtgattttgccccttgttagagcattttcagagtatttttcacatacattttttcatttgttcctcacaagaaaaatctttcaaaatttgtagggggagtaggattgttgctaattctaacacaagaacaaactgggaataatttagggtttgatttgcacagattacacaaatattaataaatgcagttgagatcagattttagatcttctagatactagttttgtggttttcaagatatcatgtagcctctgttaatttaatagtttaataatggtttattgttagagaataattttcataagtgcaaaatttaataatattagctgtcatttgttgaacacatactacacaccattagaagctagccaatatgtcactcaagtctcacacaagctcccatttttattgcttttattctgttgccatgtttattattttattgctccttttacaaagaggagagacagtgatattcaatgaggaaaaataatttgcccatgatcctacagctatttagagtaagaagcagaattttaatctattttattttactccagattctgagattctccactcacacatgctgtctctgaatcatgagcaaggtggccatttatgccagtgagcccggctctatccatgaccactcattacaccttcgagtgagacctcatgagaaagctgctgttaccactagaaaatgaactaaattctttccactcactgtaactttgtataaatcatttaaatcaaacctgttgggtttttaatttctgatttttaaaatgagaaaataattgcagaaaataacttacaaggtctcttttatcccctaagtttcatctttctaatcttctacaaattcattgaatggcatattaataattgtatctttgaatgtaaatattgacatgttataacatttcattctgccatagtttacatttatatttctttacaaaagaatagtgatttttcactattttcactttacaaaagaatgaattttactttcaggagaaatttacaaaaatatgttgggggaatctttgttagcaacgtatttcattaaaggtattttgaagcacattgttaccatacataaggccagctaagcattagttaagaaatgcttctgtaatattttgcagtttcttatacattctaatttgaggctaacagcatgtttatatgattgggataatgaggcttgctatttccaacttcacagtcacttaatcaaaaaggtaagggacttgcctaaagttacatgaaataactataaagctagtcatttatattaagtggtacatccaggaccacaactcatgtcatttatcactgagtgctgtgccttcccactatcctatattctgaaataatcacacgctacttttcaccatcatattaaagatgagctagctattgccttactgcagtggggttgtttgtgtttccagttaaagccagaacttttagaaattaaaatattttaatgcaagataggaggcagtatatttaaagtttctaagtgacgtttaatgaaacataggctgcataacttaagaaaattttgtaggctttggaatcagataatactagacttgagtgtgggctttacaacttagtcgttctgcaaaactggaaaaattaattaactcaaggccaaaggcaacattttcagattaacatttagcttaagcccaaaagaattccaagagatagataataaaaaggtagaggaagaggagaggtgagaatattcaagctgtcatttaggctcaaggtgtcttaattgtttatacaactttgtgtggtatatatacataacattcatacatttttaaaatgttttcgctatacatttaaaatacagataacaccttttattccgaaatattaaatagtcccaattttcacttaattttgacagtgtatacagtgcaacttttcagcatttttttttttttatttagtaaatggaggtaggagccaatgcatacatttctatcctctactcattttaaattaaaatattctctactcatttctatccttgactcattttatttcttaggaagaaaatggatgtcaatgctgtaaaaaaaatacatatgtatagacacacacatatatacacacacacatacacatatataatgtgctagttgttaattctagaaataaaatttttacatttattacacttaataattgattttaagtgttattgtcacctatgaagtaaggtaagatcagtgttgtggatggagttatgtccccgcagaagatacacataagtcttaacctcctgtgcttatgaacgtgaccttaactgaaaataaagtcattgtaaatataatcaagttaagatgaggttattaggtggaccttaatccaatatgatgggcgtctttctaagaaaaggagaaaagacagatagacacacaaggacaaggccacacgatgacagcagcagagattggggttaaactgagggaagcaaggaacaccaacgattgctgagaagcccgggaagctaggacagaagcatggactagagcgtctcttggagccctcaagaaggacccagcactgctgattccttgatttcagacttctagcttctataaatgtgacataataaatgtctgttttttttaagctacctagtttgcagtactttgctacagcagtaccaggaaatgaatacaattaatcttattaaaataatttttaaatttatataattgctaaacatattccatcacataaatgcaagagctgatgtagaataaacctagatgaatgcctagttttgattttaatattaacaacagtatatattaattgtaacttttactttgtgagttaattctgtaactttatatagagtgtatgtattttggatgaatatttttgctcaagtagcagctgtttttctggctttagcattctgatttttttttttttttttttttttggaaaaaataaacaaaacatgcaccacgctcttactgttagaccacaggttctctataggtggatggcaccctgggagtggtcatgtgacacagatctgaccaattagagcctccctgcccctgttctcagtgaatagttaccataaccaggctattagattctgggacgtgtggagtgaatcacgggaatgagaagctctcttttttcaagattagctagaaaatataacataaatttgtagataatcagagccaccttggcaagaacacaaaatgtaggaatgctatgttaagagatgaagaaagtatgccatgtctgaagtgagccgtaaacataaatttctttaccctttcttttctttctttggtcaaaccatttttaattctcttatgtccaactgaaagtgtcctaatgatatagacactagtatctggacctgagttgtaaggaatcctaaaatttttgaagttgagtgagctgagacaggagcagaggggattcctcacatataagaagttggtacatcatgctgtattataggaatgcagtgactattttgtagcctactgtctctggggtctcatagcatgtgccgttgaaactggtccttttaggctcatgctagataattgtccttctcctgaaaattgcgcatgttgatagtgtatagaattgtacttgtcccagagctttctgtttctgtgactggtttgtcgttatatcagtgcttaaaaacaaaaacaaaagtaacaacaacaacaacaacaaaaagttttttactttctcaaaagctagacatgtactttatctaattagatgtgcagacaagttcaggaaaatacttgataaaactatgttatgtcaaattatatatttggtatgaaccagattttcctaaaaggttaaagccacctccacttaagttaggtgttctaggtgacacattcatctatagtgacttctttgtttctcttccatttggccccagcaatgcagaagagttcaagtgccttctgggctctcagactttcacagtgtgcctgtggagcctgaactctgaaaacagtgagctgatctgggcagtcatgttgaagatgcttttagatatttcaaaaaatccttagtgtgtggacagtgttcctgtaaaatagttttttttttttttttcttcttcttttttgagatgaagtctggctctgtcgcccaggccggagtgcagtggtgcaatctcggctcactgcaacctccgcccccagggttcaagcgattttcctgcctcagcctcctgagtagctgggaccacaggcacaccccaccacgccgggctaatttttgtatttttagtagagacagggtttcaccatgttggccggtatggccttgatctcttgaccttgtgattcacccgtctcggcctcccaacttgctggtattccaggtgtgagccaccgcgcctggcccctgtaaaatcttttacctgcatagtgtatataaagcacaagcaaatatcctcaatttctcccctacttttgaggatggcaacattgcctcagtgagtgaagagctgagcagcaatggtctcaaattctcaactctacaatctcttttgtaaaaaaatgcacaatttaaaagtgtaaatcttcaacttaccttatcacttgataatggtcaagatctttcaggcagtaagaataagataaggatctagatccaaaatctcacccagggagaagcactctatgtggtctcgagagtaaaattacaaaattttcaaacaatatggatctcccaaaatattttttttgttgttgatataacagcgttagagggcatccatacagctaagccatctaaatattaaaaaaaaataaaccataaaaacctagagagtcgtatttatttttattagaatatagaataatataaacaatatgtgatgctataactttgcttagccagtagctgttcatttttgttttgatggattgcacttcacagagaggagtaaaaaaacatagaatttaaaagtagactattccgttaaaaaatttaaatgtcaaaatacaccatatcttaaaggcatgagctactctatcagaagtcttttatttcagaggccactaaataacagcctaaaatgatcctaaataactaagtcagcaagaatatttaaaaattgtttttttgtgtatttcttctgcacccggcttacagtaggactaaaagttatttttggttgaaactgtgactgggcacaaggctgcagttgggatataaataaagaaataaggtcaaggaaaaaaagaacatccatgaaggagaagaaactttcaaactttgggtgtttttttacttcatatagaacagagaaaaaacgcagataagggcactgtgaagtcaaatgatcagttctaaatatccagggaaatacattttggcacgtcgcaaaagcataccaaacagagctcaaaatagttgagccaatttgggtgtctcattaggaatatttccttctatcaatgggtaactaaatgagtagggagattctgatttaaatatatttgggcaagatagattaaatggtctttcataaaactttaaaatatgaagttaaaaaatggattatctcattgggagctgcgttcagcggaagctcaaatgtaatctgtagtgatatttaagctatggtgaataatttaatttttctaaaagataagggaaatgggggttgttaaggcagaaatacattggaacagaattgctaatgcagaatgacatggagttgcagaaatcaggaagaagtagtaattgtggaactcctgatagtaggcacataagttagcaggttttaactggctgttgtattaatgttcaaagacagggcatctaatcttttaggatgagaatgaaggtttgactaaataaggatagatataggttcacgctagggttctaggaaatgtttcctagccaggattcgggtagggaaaaagacagggaaacaattaccagaactgtgaaaattgcagattgggtttcagggttagacagcagcctgctatcacatgtgagagacatgatcaggggtggttttgcaacaagggtagaacatggttaatccatggagatgtgttaaatttggagctgtttaacttccttctgcttaaggaaaggtaggtcctgtagggacttttcttgagctggctcgtaaggtttcaatttcctaccctaggatacttttttttttcatcacatcttacattacattatctgcttatcctaacatttaaacctgttccactttctgtattgtccttcactctaaatatgggatcacactgagatgttctggtaatcatatagaaataatggaaggcatacagcaaaactcacgacagcaacaataacaacaaaaaagtactgctacatcaggtctcttgagtcattcagtctacagaagaaatagctttttttgtcctttgacctttatccccaaactttacccttgtttgtgtttttcttctatttggagttgacctaagtatttaagttggcagagttactcccttatttgctactcactcgtctagttttttggttgtttttgaaacctacactgaataggttcctataaaggtttaaactggtttataaagatgtatgttttatcaatgagtagatattaacctgggaactaatacataactcagaatatacttgaacacacatgtatttgttggcaaaatgtttgcttaacacaggaagagtctcaaaatttgaaattctgtatggagataaattacttttatatttatgtactctgcctatttttgttttcaccctgaacagtacattattgttgattaatttaaaataactatgtcctttcaaatgaatttaacattgctttatatgtagatgtattaacctccaacgatttttctagctacagcattgttggcttaagttaaattggaattctcaccagatatagatcttggaggccatattttatctggattaaaagtttgctagtgacagtacatatgtacgagctatggttttaatcacagaacatgacttaagtcttgctgagctgataaaaatgaaatcattcccatgctgccaaggtaggtttcattttgtggtagtgtttttaattagatggttaagctggtatcaaactgtgcttttaaatcttatctctatctttctattaagcaaaagacattcagtatctcatactgaaaaataccgggacgaccttgtatcagttgagtctctcccatacccaggataatttgttattcagcagtttcttttttttttgttattttgatacagcttgggtatatggactcaaattttatctctaatttctaagtctaatatcttgtttcagaatgccttttttgcacaagaaaaaatagtaaatacaattttgtgtatgtatattaaaatattttttcacttattcctagattggctgcatttaaatagcttcatagaatttataagaattctgagggttttgataatctggaaatcttttaattccaatagtcagattctttctgaaagttactttttattataagatatttctgcaagaagatagtggctatttctgttaatatttattttcttatgttagatacaatttctgtgggataggactctgaagtccagtagtatataatacatttgctaatttgcttagtaaaacacttttaatgacataagacagcttatgaatttgacatgtgatcattagaagaaaataaagaatgtattataattttatagagggctgccttaatctagtaaattcaaatggagaagtgccttcatctagtaaattctaatggagaagtaagactatttactagtaacagcaaccttaaattcatcttaaatttctataaatatttttggtaacactggggcccaggcaggcaaggaagattccctgagcatcctaattcatgtgttttgggaatactatagtgttgtgttgagaatcattctgaggttcaccatggattaggggtgtgaaggcctgcatgccatgtatttactgatttgctagagtgatttcaattattgtttgtttctgcctattcaatttaaccttcactttcctatcttcagataaggaaaaattcttataagactggtgtgagaagtaaacaagatcaatgaagccttgagaactttactttggccatatcaaacccttaataataataataataataataataataatgaataattgcttatattatgaaaatgtaacttattgaatttttatttaaaggaccaaatataaattgttttaccccagaattatgctacctttctttatttaaaatatatttataatatattgatttaaaaatataagctcttaaaaatgctcagtggtgaattactttggcactagggaagaattccttttagtttaaagaagtcatataataatgctcggcactggtgatttcccactcctaatttagtaataatgtttatgataatgatgatgtcatgataccatgatattatgactaatatgtcctgccagtggctctgaactaaattaaatcacagtggcaataatgggcaatcctgctgagtatctctgctaagcatgaacaattaagaaacaaagccattagtcgtaattgaagaattcatgtttatatgtagcagtttttcacagggaactaagaagatgaatccaaatcggccccaaataataaaataaccagtactcattgtctcattagcatcttaagagataatgacaattgagctctttagtatgtttttcagaacctaattagaaatgcagcttataatttttagaattggatacagaatatgtatttgtcaaaatgtcatttaagttgagatcttcccttctatgcctttttttctatgataattaataaaatcataattatatcttagtagaatgcagtattttcttttttttataaagctcgggtattttagtcataaacacacatgtatgttctgcatactaaggtctcaggagtcagttagcaatcattaactgagcatacagtacctgctgagagtgacataagatactttttatgatcttaggaattgcacaaatccattatgtgattttacagatgaagaaaccaaaatttgacactattgtaatctgtgaagctggtcaacatctagccctatgtgccattctcttcaacagcagagcggtgccaagcttcattcctcagtttattttattttctttgtgatactcagtttgctatgcctagaaataattaccacctcaatttttgcctctggagctctagctgacaacatctttatattaatgatcattgatattaactgagcatctttatactgaggaattaaatcatatgtaagaagtggaaaactttctttgtctttgcttcatatactacccctctctcaaaaacaaaatcctgccctaaaatcttgattttatttaatgatttttgctattttgatttcttgggcttgtaaatttggatttgtttttcagcctcttcttctaaattcagattttctgtttatttgttgaagtaggtgtacttgctctggcaagtttatgtgaattttggtcttttaatgcaagcaaaataaaccagccctggctaagttaaacaaacaggaaatgactaacagaactctagatacttcaaataaaggaattaataacattgctacccctgtacgtggtccagatacaaaaccctaaagaactgaatttgaatggcagcatttagtttaatatttcctttataactaaagttgtgtcatgtctatcattggaatacaaacacattggcatgaagaggggcagatccctaaaggaaaagaaaggagtttcaacagagagagggaaagattgctggcagatgcataaaccctatttttaattattttctctctccattcttacatcataatactctacttcatgcccggtcttgtctctagtttttctttgctcaatgttttaatccactgtaggcgagcagacatctttcaacttttggctctgtaattcaaatatttttctcttttctgccctgttcacttaacagtgtgcctttttcttgtaagtgagccatttatcattataataatattggaatgtgttcttaaataatttgatcacagtaactgtgcttttttaacaccttatgttgttgttagggaataaagtattttagtaaaacgggataatatttgtgtttgtaatagacaataatatcaagtagatttgttcttttccccctcagtaaatgtgaatatcccttttctaaagtagctcatataataaaacaattgataatatttaggctataacaaatatagttattctatttaccttgtcttatttcatacctctaatagagtcagtaaccttggcacagtaagactcaataaatataaaactatcaatatcagaccaggtttttattaattggaagctattattctgaatataaaaatatatgaatttatctaaacattaaggtgaagattaaatccaaattttaacttttggttgtttactcattaaatgtaatttgtcaattatccttcaaagatatgatgctatatatgaaatatgatgagagaaaaattttaaaactcaacacatgacaaatatctcacagacgggaaatggagcaatgtgcctggttcaggctatgggctttttgacttcagtctgacatcataaagagatggccaagagttcctgcagcttgttggagaaacaggtattaaaagtgtccttgctagaaactttatttaaaaactaggattactgtttgaaaacatgagtaaggtaggattcttacctattgggggttaagtgcaagaattcagcaaccatgtcctatatggtagagtctcttattggggacattcacataggtttatttaaatgacatgtctatcctgaaccatgaaattgagccagtcctcaacaaaatgaggtacaaatcataaaacaatttaccttaaccaaacaatgtaaacaggctaatatatcataccctccaaaacactcataggccctttgctacagaatgtcattttcttgcctttaattaatacatttcattattttggccaacagtcaataccttgaggtaaacaagaagtcaatccagactagctaaaattaacctgtgcttcgcagccaagaaactaaatcaattgctaagaaataaattcagcacaagcaattgaacaaaatatggtaatctgatcttgataaaaaataatgtttatcttgctcaaaaagacaataaaaacaggtataaaaaacaaaagattaatcaaaagcaagtaaaaatgaaatgagattcagtgtatactaaaataattttattgaaaacctaaaaataattactctctgcctcttttctctctctcaggctctctttttctagatggatggatagttgaggattaatggatggatggaaagatagatagatagatagatagatagatagatagatagatagatagaatgagccattaaaataacactaaaaacaaaaatagaaatctttatgaataggtgaaacaatagaagagcgagaaaatactaagatactatgtgattctgaagaacagacatagtaaaacagaaacagaaagaaataaagcccaatacaaagaatacattttgaataatagaaggatgattaactcaacatcattctaacatgagttccagaagttaatattaagtgaaaatggaaataacatgaaaacatttaaaaatgtaatcattgataatttccatattgaaagaggaatataaaatacatgtgcaacaaatgtcacaaaagattgaaaaaattcatacctacatccttattgaagaacagcaaatataaagaaaaatcataaacatgccagagagaaaagactgattatctaaaaggaaagccaattatgcctgcagcatgtatcttactactaacaatagatatgggaggaaaattgacccatgtctttaaaattgaagggaagtaaattacaatctacaattctgtatttagttaaattataatcttaaagcaaatgtaaataatggtaattacagacacacagaaagataattttcacccttagtccccttctaaaaaacatctgaaaggtatatttcaaaagaagaataaaataaaacctgggaatagagtaaaatgcaaaaaataatggtacatttagtaagattatcagaaattggtaacagaagatggtaaatttaatttattatgactctaaaaaggtcagagactaattttataagcccaaaatgtttcagccaaaatgttaaaaatcaatagtgacttggatgtgagtagtagttggtgtgattaatgattgctggaagccgttatcctcagcaaactaactcaggaacagaaaaccaaacaccaaatgttctcacttataagtgggagctgcatgatgagaatacatggactcatggcggttaacaacacacactggggcctgtctgtgggggcagggaaagcatcaggaagaatagctaatggatgctgggcttaatacctaggtgatgggttcatctgtgcaggaaaccaccatggcactcgtttacctatataacaaacctgcacatcctgcacatgtaccccagaacttaaaataagcattgaagaaaaaagattgctaagatcctagtgttgtttgagagaacaggcaatgaaaacttcaggatttgttagtagaaacaaagagttaagttagtttatgaagtgtgatatgttaccacttaaaaacaatatcttcaatctagtgttcatggcagaaactgtatgttgttcctatcctttttgaatagtattagaatgtcaaaattttgttgggcacatggctacccaaaataaagagatttttcaatctccttggaagcaaagtatggccatatgactaagtccaagtggaatacttttgagaaagtcatatgtaactttggaaaattatacataactgcaactcaagagatcatgatagacacgaatagcaagcttgctgccaagaatggcagaacaacaatataaggggccctcaagtctgtagctccatacttggcccttggcccagagagcataaatttttattaaattattattatatttcatttcaatagtacacatgcaggattattcttttgttgttgttgttgttgttgttgttgttgttttaccggtttcactctgtcacacaggctggagtgcagcattgtgatcatagctcactacggcctcaatctcctgggctcaggtgatcctcttgcctcagtctcccaagtagcaatgcatgtaccaccaagcttggaattaaaaaaaaaaatgtaaagacagggtcttgatctgtttctctggctagtcttgaacctctggcttcaagtgatcctcctgcctcagcctccccttattcttaagtgatacaaaattttactcaattaaaaagaattttaaaatgagaagaacaaggagcattaccagtccaacagaagatatcaaagagaaaaacagaagtatggtaaataaaacataaaataaggggacaggaagttcaaacatgtggtgatcacaattgaatataaatacatgcaacccaactgttccattgaagaaaacaaaaaacaaaacttaggtacagttgattcttgaacaacatgggttgaactgtgtgtttcctcaacacaaattttctgccacctctgacacccctgagacagcaagacccccttcctcctcctcctcggcttactcaacttgaagacaacgagaataaagaaagatttttatgatgatccacttccacttaatgaataacaaatatattttctcttccttatgattttcttaataacatttttctctagcttactttactgtagaaatatagaaaaagaatgcaaaacatgtgtaatggactgttaacggtaaggcttcaacagtaagctgttaatagttaagttttgggagactcaacagttatacatggatttttgactgcatgggggttgatttccccacccctatgttttaaatcaaaagaactaaaacaacatagaaattttataatagaagtcttaattatatatactattaaatagtacaaagaaaatccccaaacaaaatgcaagacaagggacattacctagtgagcaaaggaatgatttcccaagaaaatatcaggtacgatgaggttgtatgaaccagacaacatagtctttaacatgtaaacattgacaaaattaatgagaaagtggatgaaaagtgcaaacatgaaacagaaatttagcacaatttaatcagaaacattttagaacaagcagatattgttctaaattgtgaagactgtgtgaagaaatttttcagggtgttacagtgtcatattagaagaaaacctgatcttttctgtctgaaggagttgggaaaaacttccctgaagaatgacatttcaaaaaatgtcaaggataaattaggaattaatcaaggtgagggggtggccaaattccaggtagagagaacatgaaagaaaagatttggggatttaatgatttgattacagttcagggagaaaattatatgataggaggtaaggatagaaaattctgcacaaaccatatcatataaggtattctctgatcctcttcagtcacctcaaaatgtcacgttttaggaaggggaagatacatgagttcaaaaataaaagccagacgcttgagaaaaaaaaaaaaaaaaacttcaaatgccagaacttacttttcaaccaatgcgatatattttcagattaaaataatttaacatacaggatgaattatattcaaaatgcatacaatatctagatgtaaaatagtgtattgtcataagctattttcactttatcaattaatttgtagaaatttttatgttttagttctttattattttgacttcaaacaatagggaagagctgatttaaaatttaataattcaattactactatatagtgatatctgcagtgtgtttagagctattattattcttgctcagaggcttaagccagatgattttatttggcaaagggtgtcacaccagtcatcgtcttctctgtctcagagagaacttccaataggcagaaaattgcagagtgtttttcttccttatgttactatccttaatactttctttcagatattgtttgtagttcttagtaaagatgcccatacctctaatatgaagaatttcttgtgaaatagtgatctaacatacatggcaactaagaaattccagcactaagttttattgaattacataaagtgaggagattccctgggcagttcttcccttttctacagtatgtggccagttaacccgacacagggctctgcatggcatgtattcaacattaattgatttacagtcacataccacattatgtttcaatcaacaacagaccacatataggatggtggttccataagaaaacaatggagctgaaaatgtcctgtcacctagtgatgtcatagccatggtaacgtggcagtgtgacataatcaccttttctatgtttagatatgtttagatgtacacattcttaccattgtgttacaagggcctacagtgttcagtgcagtaacatgctgtacaggtttgtagcctaggagcaataggctccaccatgtagcctaggtgagtagtagactgtaccatttaggttgtgtaagtacactctacgatgtttgcacaaggatgaaatcacctgacaatgcattcctcagaggaaatccccattgttaagccaggcatgactatattttatgttacgtagtgtttttaaaatgtaagaatgattaaagaggtaactataattaaaaaacacatgctttgggggtgatatctggtgcattttgtttgtactagtttgggataacacactcttggtctgaagttcttggtgataatgacagttgctaaagctgtctgtaatcctgcttttggttctcacagacctaagtacctgacctggaggagaaacccctggatgatcaaacaggtctctaattgggttaatatcgttatacatattatttctaagttaaatccatattaaaatgtaattaaacttcagaaactcattgtacacacgttattttatttaaggccacaggtatagtgtatttttaccctttcaacttgtttaagacactgccagtttcatcagagagcctcatggtggctgttttcattgatggatagttttggtaggcttggcctgctggttaatgggggaatttgaagcttgaagtcagggtgaaaccatctgcagatgggcagttttttctaaggaaaaaaaaaaaagcattcagtggccaaagaattgtccacagctgccaaagatcaaagagtggccaaagaacatgagcagaaaatgatagaaccagtttgaccagaaggacgaagatattttcagatatattatctactcacactgcatctatttctagaggactatccatatagctctcctgctgcatcttatcctcaatgatccagtctggccagatagctttttatgatacatgctataaatctaagaaaataataatttacatttctaccatagaaagataagcacagtttcaagcacttaagaggcacaaataataaaatattagtaaatacaatattttttaaaggactcttttaaaaatttttaaaatttttttttatttttccataggttattggggtacaggtggcatttggttacatgagtaagttctttagtggtgatttgtgagattttggtgacccaccacccgagcagtgtacactgcacgcaatgtgtagtcttttatcccttgcccacctcccacccttcccgccaagtccccaaagtctattgtattattctcatgtctttgggactgcataatgtcttatttgaggggttactgacacatatcctaatgtatttgttcaaattgaaattgaagaatattttagttgatatagtttgtttacatcttgcccactgattatttcagggttgatttctagaaatataattgtagggttaaaattaactctcagggcatctcttacataatctaatagaatttattagaagaaatttataaaccagttaacgtgtaagaaatttatacatttaattgtgacccttttatactatttgagctcctgatcttacctataagtaaaaaataaatttgaaaataattctgactattggaattaataataatatgatatttctaaactcatttttaatttttttagcaaatctgtcattttcagctggaaaacgtcagggaaaagactgtacaaatcagtaattaaagagagttgagtagaagttgtgcgcaaaagtgtgaacaggttaagggatccaagaaaggatggtgaagcacccaggatctagcaacagagaaaattgtcaccactcctaggactgacaggatgcagggaacccaggcaattcctccaggcaaattgtaaccacgggagagagattcaccgttaatagcatctgcataggtgaggcatgcagacatggagtagcagggagagaaaagggagaaatatacattttgacttctttctgcctctgcccaccaataactttgtagagggcaaggaggtcaagatgataaattttaaagaggtcagacttacagcgtagagcaggatagaaaacagtctggctttgcattagggggatattcagcagggtttactttcttttctccccagcatgtgtaatcttgtcctttctctagcccatttctccacgtgggaaacatacaaagtcccagtagtctcaccatatcgctgtaagggagtttcagttttgtcatatctttacagaaccatgcctggagcattacaaaccaccagtgctctttaagtacagaagcagagaaaaagggggaaaaataactcatcaaagaactacggctgttaaagtcaccactggtgtcatgaaagctaagttagtaattaactgtagcttcctacactggcatccatcccatacctccacccccttactctttgccaacaactttttgcttgttgaatttttcttttcttttttttttaacctagtgtgatgatccaagtcttaattcccatatgattgatataattatagtatctttatttggtggttgcaatatccaataaaccagtactattagacatttgagtactagaatgcacccaggtgaatcctctggctaccagacacagtacccatggctatcaataagtctttttttctgagttcataaaagttagtccagggagatgcattttggattccaagatgcaaaatggtccccctgaagaattgtgccatatcgggacctcagcaatgacctctgctcttggcagttttggcaaacatctgtatccagataagccttgtgaggggaagaccattagctcgcattgactaagtgaaaaaccatttagccaaaaaaaaaattcctgtgcatagtctctatacatgtcaccacaatcattgtgtacatgaatttcttgagcaaaaactgggaagactggaggaaagaccttggggactagaaaaagagctgactgttataaaagatttaagagctctctctgagtggcatttatgtggaacaaaaaaatctgcttcctctgagtgtattcctggaggatcatctacatatctctctcactgacttcttgtcccaatcatttagtcttgttcttcccatgtccataaccagctggccagcatatcaaccctggccatgactcagggtctatttgtaatttaagtcatgttgcctcccacatacagcacattatgggatatgctgccctaaactctaataggatttacctttatcactatgtttcagggttacctctgaagaggttcataatgcaatggaattcatttctgacctatccataaacttgggctgtactttcaattgtatctttttcaccatctgaggccctacctgtgggttgagggaaaagtggtacaacagtatggctcagcaccatgggcatctgagtcactcactcagtgtatttgtcttctccagaacttcttggccttgatcttatatatacacattttatttaatgatggtatgttcctacacattagaaatcacccagtttataatgggcaaattgggctgcctggtttcttggtttactccggtcaggctttggggacaagctggataatatttttcagttgcagaacagttgatggcaaaagaggaatgtgtctcatgtgaatatcctagagatttatattatattctcctactgggtcttggatcataaggctcgcatagcctggctgcttgcttctcaatctggatctggtgcaggtcttttgtttgctccacgcccaacctagacacacagttttatgagttattcagtactagatgggaacagcacatccaaatgacgttcgggtatcacactgtgctccaaactaacagagttcctagaaactttaccaacgtgacacatcccagaacttttgcagggtttatcttctattctctcacaagtaaaagaattactaagttatagaggtagtattagggtactgcaattattattgttattatataagcttaatacccaccgaaggagaattggggtccaaaaacctttagttaaaatgtacattttctattactgagagattaaaaaacaatctggacatgtctgtgtgtctggttgtttgagaactccgtgggttcatttgtgccatccgaaattatcttgatttggattgctgtttggcgccacctggtggtggccgtttgaccttttttttgtatagatatgggtcgttctggctcctgtgcaacctactaggacagtggctgtaattctaggaatttcctcaagttagttggtgccagttttatcaatctgatctggggaaatcgaccggagagaggggtagggatgtgggaactctcttgatccctgtcattcccctgtttagccttccttgcctaagttaccacagtccccagataagaacttttgacacccacttttgagaacttgactgggaagaaataagagccagtcacacatcactgtttatatatctccagtgagaggactgatgggtgggctatcacaagattttaatagatctattttaccttacaatttttttacttcaggactaactcgcaagaaatgacaacaataaagaaaatcatccaaatttctgaagtgtataagatttataaaatttacaaattatataagatgacttaaatagacatttaatgagccactttgtgttaatattttctatgtttttgctatagtaaatagtaaatatctttggaagaaacatttgatttttaaaagtctgagcattttattttaagattaagttttttcaaggtccagtattcttataatttttattcaatgagtgacacagcataataatattttatcaatcggtttcaataggtaacccaacttaacaagtgcttcttcaatttcattctcaggaaaagtcagtactttaatgaatctaacagtatatttccaattagaatttggaattcactttttccaccttttagttctggccctaagaaactgatgcatcttaacttactccacccatcttcttcaactttatcccaacaattttgaaacatgctgttttgattgttgttttgcttgtattagtggttattagaggtgagcttcttttttttgtaatgggaagtaaggatatggttatttcatggaaaaaatgatgcttctttcatgtgtctttgtgttgctaaaacaaaataccacaggcttggcaatttataaagaacacatacatatttctcacagatctagaggctgggaaatacaagatcaaggcactggcatctggtaagggtcctcttgctctgcccccatatggcagaaggtggaagaacacaagggacgtatgaacactgttctcacatggcagaagagtgagagtgaactcacacccaaaagccctttacataagagccttagttcattcatgagggcagcacccccatgacttaataactgctccaaagactccatcttttaatatgccaaaatgcagattaagtttcaacatgaatttttaagggcatgcattcaatctataagcaatagagaaactttgaagacatgttaccctctttggaaactgcaaatgctattctagaaatttcccctagaggccaaataggcacttcatctgccttaaaagttatatggctattttacaaaatgttttattactgaatgcatgggtttccatatttccaaactgctgtatctattttcatactacctcctacctgaccagtaagacaatgcacacattttagatttcttttatgtaggcactccactgcaagatagcaatatctgcctccatgagattggttaggctacagtaacaaaaggtcccaaagttatctcatttcaattaaagtttcacttctgtaacatccaatagtatttccaagttcaggggggcttgtgctccagtcactcatagcaacccatgccaatgcagcttttccctcttcagtacctgaccttccagtgccttggagagcaccatctcagctgaagtggaaatatatcacagaggatggtgaaggagagataattatgggatgagtctaaaattggtacacattgcttttatttatgttctatcaattagaattcagtcacacggttataattctttagaaaagaaggtcggaaaatgaaatgttcaggagaagaaaaagtgatatttggagaatgctcagtagtccctaacacacattttaatttttggtaaataaatacctttaatgtgtacaggtacaaaattgaagaatacatgatttattgcttactacttttatatttaagaattcgggataaaaaactaaatgcaaataatttaaaatagaaaactgcatactttgtagtatttacaaaacaagtaacatgtaaaatatgaaatatatgtatatattgtatactatatataattttgtatatttaacattctctataaattatatatggttataactctatgtatatcacgtatatctaactgtatatatttatatatcatacgtaagtggaaaaatacagaaatgataaatttgcatcattttaccacaaccctaaagcttatcagaaaaatttagccttttattttgaattataggacagaataggttacattcttctgtgatttagaagcctcaaaggccacaaacaataaaatgggtgccaaagacccagagatttgaaagcttaactcaaaatgcaagaccacttagttggatagtgcaaagagattgtgaaactcgttttgtgaacctcagctctgagttttacaagagaaattgaagactgatcagagggagggttgatattcacttataatgagttggtggtgtgtcgggtgcatccactgcctcttgggaaagggaaacagctgattttttatcgtttcaaatggcttcattgtgctcacttggagagacttgtgtcccattgatcttgagggacttgagaactagtggtgattctggcctggatattttaatgataaatatcaatggaaattgctacttctgtttgtagcagggcaaaattgaggtggcttcactgagaaagaaagtatcttccttcaaagatagagttagtgcttccatttgctgcatactctgctgatagaagccaacatgaagctattccaaatggaccaaacagaccacctgaaggacaggtggcattccaactgaaggatagataataagatattggattctcaaaggctgctaggtagtaaaaattgactagccagaggggaaaaatgacctatccagaagacacagtcagatatcctctgaaggagaatctccaaagaaacaaaagtagcatgccggaagaggaagaaccaacaattgagcattggtcatcgagtgcacagatgccagcaggacctgttttcttttccactgttcttttattctgggcgaatggctatagaatcacaaaccatatttagtgagtggagggtatgggaagaagacaagaattttcctcatcccactccagaattccaaaactaaagtaggaccccaggtggagagtgaatggaatatggagacattctaaagtatgtaatgattaaaccaggctggacacttcattatataaaggtgactaaaaatactgcctgagattttatgtgagaaaaggaaatattaggtgcaaggagaaatagtaggtgtaaaaagcaaaactcatcaggagcaaattgaacactgcaaacactttctaagaattagattgttttttattaatacttgtactctattaatcaagatcatttattatacaagttataactatatatcagcataaaaaacttaacttgaatgtgtgaaaaaatataatatttttacttagtctatagtatttggtttcttcccaagtccctaaaagagaaaaatctcttaataagtcccttcgtgagaaagaaaaaaatgtacaatacgacttgttacttactctaatttaacaattagataacaattgaataaaataattcaatctaatcaatattgggtgtttttaatcaatatcacccaatattgggttttaatcaatatcctgtttttaatttttttaaagactgaaacaaaggttttaagtacagatgtgttgaaagctgtgtcaaacattgctatcaaaatagctaacacacacatgcatacacacactcacacacacacacatacattcatatacaaacggtcaggatggggctgggctggcagtgaggatggagatggtgagagaaatgttcttaactcaggtatctgcattggatgttaagtctcttaactgtctcctcattcacttttcctctttccaagatagtgtcagtctgggtgtaaggtgggcatggctggtgaaggggagacttagccctgctgagtacagactgcaaattatctatcatggcctctatctatccagtggctctactccactctggagacaagatcacttcagtctggagaatgggtctcatgccaagccctagtggctctcaagttagtgactatgctgggtaggaactgaggtggccttaaaagtgcaaacaaagatttccttttgactgagcagctctcctcccaaggttattaagatatgttcatgtctgagactgtcccaggacggttttgtgtgatggcctctgtgttactgtacaaatggtaacagtaacacaggggtgcagatgatcccctgccccactgtttggagttttactctcactcttccgagcattgcccaaaagttgagctgaagcccaaggaaagggaaatgggaacccaggttcaattactttgctatctgcccttgttatttctccatttttcccctcatttattccaagatagaaaatatgggaaggctcttatattctttgcatgtttcaaatcttgtctttactacaccctagcctaatagagatccattccattccatagaataatcctatgatcttggtctttcagactcattgttgatagcttacgtagggacagcaatggtgtagttagaaatctgggaaacacttccaaagctttgcatctcaaagtaattaacttgcaagttcagccgtggctcacaccttgtaatctcagcattttgagaggccaaggctggtggatcagctgaggtcaggagttcaataccagccttgccaatatggtgaaaccctatctctagcaaaaatacaaaaaattagcctggtgtggtggtagacgcctgtaatcccagctactcaggagactgaggcaggagaatcgcttgaacccaggaggcaaatgttgcaatgagctgagatcgcgccactgcactccagcctggtgacagagcaagaccaattaaaagaaaaaaaaaaaaaagattttctgggttccttttgcatctctcagtgacatatccagctttcttcatggggaaattatacgcaatatagtgaagattttacattctaaaagttaattgtgcaacggaaatttacaattttccaaacattttatctaagttttaaagttgaacaaaaatatatagcagcattttatcctctttaaccttttttactattgatcaaccctgaaatactttggaatctcatgtttcagattcattgttgttctgttttttaaaaaatatgttctttttattctccaatagcttaatcagaaaaataaatttctaatatttaatatcaaaaactacttacagacttaactgcttagccatttgtgttgcttgcattatttttcatatcatcaagccacatattataattccacaggctttcctgtcagtttcaaaaattggattctgctataactattcagtcaggcctaattggatcgtcaatttacaacccgaagaaagtgactataaatactttttgaacattttgaatatttggataaatactttttttaacaaaaaattcccagtgtctttagatttttaaattaggcactttggcatattagctcaccagatatggcaaactattaatctgatagatcaatgttaaagatgcagttctttagtaaataacaattaggaattttcatttgcaccaggatgaactacagattagcatgtctaacaaaataaggttaccgaaagggctatgagtgtcagaaaccactctatcatttgatgcaattacttggataatttctgggttttaatctaatcacgcctaagtagatggcagtcaatgaaagtttcgtttaacaacagtcagatcattactttccaacggattgttttttgtaagcagcgatattaattggaaatgacaaactgaagactaagaaagatccataaggctcatttacctgccaggttgattgttaaccttgcttagctaaaatagtttattattcttgcaattgcagctctatttaagcaacatcaatcttctgaaagaagaaattatttgaaaaacatttacaaagctttaatttgtaaactaggttctaaaaatttctatgcaaaattaaagataattcttaggtttaaattctattaagttgtaactttagccagtattattattggttttacaaaatagtctcagttttaaaagtctgggcatatataaagcctcttttcatttttagagtatttagattccagtagtgaaacccaagtcttttataaacattgccaacagtatttgaatgaagttttgggaaaatgagatgtagttctgtgtcttctttcatgtcataacttggttttttaaaattagttttatctatctatagggagcagtatttaccttctagaggagcaccctctgtgaatggggtagaactgaattatactatctaaattttaatagtggaatttttgatgtttatttctgattgcatggttttgttgtcctgaaatagttgatttaaaaggcttttaatattcttatattacaaaaatatttttaaaataataatattttagaaaaaagagtaattttcttttccattgaggtataatttactaaaataaaatgcagtaattttaagggtagtttgagacatttttgtgaatgcggatacccgatttaagaacatttctctcaccatctccatcctaacggccagcccagccccaccctgaccatttgtgtaggggtgtgtgtgtgtgtgtgagtgtgtgtatgcatgtgtgtgttagctattttgatagcaatgtttgacacagctttcagagaaaacatatctgtacttaaaacctttgtttcagtctttaaaaaaaattaaaaacaggatatctctctgtcacccaagctggagcatagtggtattatcatagctcactgcaccctcgaactcctgaacttaagtaatccttctgccttaactttgtgagtagctgagactacaggtgtatgtcaccatgctcggctaaatttttattttattttattttttgatgtcacggagtctcaccttgttgcccaggctagtcttgagctccaggcctcaagcaatcctcctgcctcttcctcccaaaatactgggattgcaagcatgagccatcttgcctggtgtgttttaaggcttagtttcattattctttaaaaagagtttatgtgaaaattattatgtttaccttaaaatagacaaaaaaaaaaaaacccactcaagaaaaagtagaatttatttagggaagtggtgagtttagagtcaaaaggattttattgcatggaggaaattctgtgtcctactagagggctgagaaaggcagattgttactcaaagtgggccagagatcctccaggaggagctcagtagaagtgcagggcacgttacaagagattttataggggtttcatagctaatcaaccaaaagtcaaatgataatggccaaatataatgctttctatgtgcctgtaaatactctaggcacctaacacacattcattcaaagttacatacacatcttttcaactcaatgtgaattcttaaatatatttcttatgtgtttatgcactacctcccaggctagttaaatcacacaattataggatattttattttacattttagaattaatagcccagtttttccaatttacaaattaaaacattaggtttaggatggttaggggatatcatcaaggaactaccgataaacattactttatcaagccaaagccaaaatcgccatattagtaggggctttcttttatgattctatttgagacagcttttttgtgttaactaaatcatagatatattcagttctaacaccggaaagacaatcccaaatataaatccttagggtgagaattcagtatcttcatctttattatatatcatgtaatagattacaaaatggaaaccggtaaaaatattttatgataatattttataatacaatagttttataaataatattatttatactaatattcactgtatttaacatatatggtgatcaatattctgaaaggcatctattttataaaagaaatcctattagcatttattttattaagaaatttagaagacaatattatatattgacaaagaaaacaaatggtagcaaaccaaagagaatggtattttaaaatcttcctcaatcctttgtctagagtagaacaatagtagaataaatttctgccttgtaatagcatttagatttttcattagctttgatttgtcaatgtagtagcttttgcttttaataaacatgtattaagatatcattgaaataaatattatggtattttggtatttatttattacaaaataaattaatcctgcaatgcatcaaaatctgctaataggtagcctttcacatttcatatttgcaatggggagatcagagttagagtacatggattttatacaactgaagtaatattaaggtttgaaactaataaagtcaatccaaagactcactgtatttaatcacttttagtaccacaaaattgactgtcaaaagtctaattaactatcaagtattacctctactttctatgctgctcagttgcaaagcctttcattataacatctggcaagtttaaaaaaatcccaagaaaaccacttcttcctatagctttacagcatagagttacaatgaaagaaactgctatcagaacaacaaaaacatatttaatgctttattattaaacattaaaacgattttaaaatcatgttaaagttactggtcacttcattttttgtgagagcacacaaataagcttaaagaaacattttaacaaatgaaagatggctatgtactgattgcattatttcgtgttgtgatttttccaaaattgccactaaactctgagttttactattcatctgcttttaaatcatgataactgtccaacttagtcttagttttcttaatttttttccccaagtgctaaagagctatctcatcacctaaatataacttaatcacctaatataactacatcacctaaatgtaacttaaatactttaagttacaattgaaattcaagagaagggtatatttgcttatgtgtttgccataatagtggcagatatatgtgccacaatacaaaattttgatgataaaatataatacccaggaaggaaaactgaatttttacatatacaacttttttttccagctcatatgaggaaagttacacgtttgcatatatactagtagaggctgtataataccaataatttttaacacttgacaacttcattctaaatgaattacataactgcttgtacctttattcactgatatttgtgtttgtatgcatctttcttttagattttcatttttaattattaaaacatagtcccaaaacattactggaaaaatcaatttgaatagaagttgcctcattttttcagttttttaatttattcatcccaaccttgaaaaatgtcactcaattaaatgtgaaataaactgtatttttaaaagaatgaatggagagtagaaaattatttttatttgaatcacacacaaaaatattaaaaagatataaaataaaacaataagaggattattatacaaaatgtataccctaaaagattttgcacagttgtaaaaagcatacctcacatttggttctgaacttcttgatggttaaatgaaggatggaatataattaatatttacaaggttaatggtctccaaaagagactgaattcaataaaagcaataggtcttttatgtatttatttgttagaaagccacatttgctgatgagttgatgtttatatggccaactaatgtattcatctccttaaagctcaaggcttactattctaagacatactcaaattcttgaggaaaggacatagcatttaaagctatattttaacaacattgatcctggggaaactttttgttgtcgttatggttattgttaatattttaaaattgttaaaattactttaacatttgcatattgaaaaatgtgaaattgtaataaataacaaagatttgaattttggtggaggaaagtaacaatacaaagtagaggttgaggaatactggggcatggaaacaatgatgactacagaatagaaaaggaaagtattttagagaggttgtttgaataggtatgcttaaggcaacaacccctgaatcaactgatgacatttccagctctctccttccacgatttggggatttttgtgtgatgtgaatattgccataactgccttcctttggattagtacttgccaggtaagcttttcccgcatttttttttgtattttttactcaatttgtattatattttaggtgcagctctcaagaacccttaagaggtttttataagtccaatctaagattatctctttttttttctgtttcaccaattgtgagttttgatataattgagttcctttttatcattttactttgtgctagtttaaaagttatgaaatctcttgctcttctttgagtaatttgttttaaatgtttacatgcaccaccagcaaaactggatgaaagtaactatataataatttgctccattgcccttctgaagagtgctgggattttagatcacattagtcacaaatctttgacattcgacttcctcactatttttaatgagtttcacctcattttatctcccccccactggaaattaatcatttttctattaatgtgtttactaacataactaatttcaaatcatcaaattttatcagtttattgctcatcatcgcttcttgcaattcactattccttctgggtccgtcggtatactttccccctatttgttgaagcatatccttttgttgttctttcaacatgtacaaattgtgctatatatacatttaataattttttatgaatgtatctttatgaacatatttttcataaatgtatcttaaagaataatatggatgtgtctggattttttttttttttttttttgagacagagtctcactgtatcatccagactgtagtgcagtggcgtgaccttggcttactgcagcctcaacttcctgggctcaagcgattctccacatctcagctttctgagtagctgggactacaggcatggccaccacacccagctaatttttgtactttttgtagagatgggtttttccatattgcccagggtagcctcaaactcttgagctcaagtgatctgcccacctcagcctcccaaagtgctgggataacaggtatgagccaccacgtctggcctggaattcttatttgataattatttgttcctcactgcaatatatgatttcacatgttttgccatgatttgccattaactcgtaaattcactcttagtctgtggttgttccctgaaaacaaactgctttttccttttggttgctttcaatttactccccccacccacttattgtttatttctttgcagtttcagcataatgtgctttggtagttaaattttaataattatactcagaactccctattatttcctctgaaggctagggttgttaatctgcaactactttttaaattttagttctttttaatttctagaaagtctgttttaatttttttcatattatcatgttgtttttatatttctatatttattttatatctttaatcaaatattttctcttatgacatgaattaatataaacatgcttaatattttgtccctttctgattttacaagaatattttgatttcttgatatgctagtttttgagtggattaaatttggatttttgagtggattggattatttgtttcctggtgtggtttgcaattttgtgtgtgtgatcctcttcattatgtttattttgttatttttgttgttgttttttttggtattgtgagggttctgtatgcactggctggtgaaaaattctgatgctgcagaaattgcatttgtttctctcacagccttagaatttgtaactggtttccaccaatattttgttaaattatgagcttgaatttttttacaccgtgaaagtaatataaattaaaacctcaccaccaatgtggaaaaagacttggagttttatatcctttcatggtaattattttttaaaccagtgtctggatacacttgcaattttatgtttattttggttagttgctgggctttcttatttaattaaagaaggagctcttcaggaatccaagctttaaagagttcccaaatctagttcccattttctttgcattacccaagagaacaggtaatgccctcggatacatactaaaattgccagatcctagcctatggtttagtatttttttaagttattttgttgttgttggatgtttgttaatattttttaattataatttttctggatatgggacagacattattgaaggataaatagattatcatgtaaatatgatatgaagcatattagttatacaaaagaaaaagtaattgaagaccttttattttttaaaattttttaggggtgtattattctttttaattgttatggattctgggggtacatgtgcaggttattacatggatgtactgtgtaatgctggggtttagcatctagtgaacccatcactcaaatagtgaccatagtactaaataggtagtttttccagtccttcccctgcttccctcccttcttgctgttggagtccccactgtctattgtttccatctttaggtccatgtgtactctttgtttagctcccacttgtaagtaagaatatgtggtatttgattttctgtttctgtgttacttcacttagaataatggcctccagctgtatccatgttgcggcaaaggacatgatttcattctttcttatggctgtatagtcttacatggtatacatgtactacattttacaaaagacatttgaaaacagtagtcagcatataagcacaggtttacttggttaaagagaaaaatgtgactatctaaaatgagaattcatttttgaagaaagaatttcttaaaaagcctgcataacatcattatatggtccctaaatatgtaagacttacatattcaaatcctctaccatagccttttatgctacaatttttatagcttcatgctaatattacctctagtaatatagtttataatgttgctaagaattataaatgtcctaatatgacttaatcattctatatttgaaaataagaattaagtatatatttatattacagtaggatcgacatggtataagaatcacatataaaacattacaatagaatattaatcttcctgaaattctttatgatctagtacatttttttagaccttcaactctgtatataaaaagttatttttagatgtaaaacttgctattataatactaatggactgctactactgctcaagctcaagaaataaatatatttatagttttaaaacttattttcattaagtgtcttcttagccttaccaatttgcatgaaccttatgcacattttattagcactgaattaccttttattctttttccttttgacacttagaaacatgtgaaaaatttatttctttcataaatcctcttgaaacaaaataaaattttgaaatagagtgatatttagaaggtctaataccttagcatcattagactgtggccaatggtaatattcataattaaacactgtcctgtcaccttcactcacgagaggaggaaaagctgttgacaaaagcatcatcagtaagctcttagaggttctattgaacacaggcaggcttgtcacaaatttaaactttttcattttaaagttataaagcctagtcaatacttttcttgccacagaagaagaaaaggattttctacagctataataaagggcattttagatttctacagggcaatgaccttgttttatgaacaatgtgactgacttctttgcagccagatggttaaggttttatggagagtgcagtaaggactgacatgttgcttaaatcagattacaactggccctcagaataggcagtctccacatctgtggattcaagcagccacggaccaaaaatatttgaaaaaaaaattaaaatagcaatataacaattaaaatactgataaaataaatatagtataccaactattttatagcatttacattgtattaggcattatgaataatctagggattacttaaactgtacaagaggatgtgtgtagattatttggaactactacaccattttatataagggtcttgagtatctgcggattttggtaccctctggggtcctggaaccaatactctacagatacaaaaggatgactgtatatatactgtgttagccacagaagaatagagccagaagccagggtattaatgtttccttgagctccattaaattcacacatttctgagaactgaaaaataaggcttcaaggtgaatgcagggatatatgtactccttggaagaaggctctggtgatggagaacaggcttatgaattctagtgataacaacaacaaaaacttcccttaagtacatctccatggaaaggaatctctatagaaaagaatgacagcatatttacccaaagaatccttggacgtggccatgctgtgatgaaagagcaaagtggcacctgagagttttgagttgcgagggataaagagtatgtgagagaagcagtgctgtagtagcaacaggtatgaggaaacaatacccgtagctagaaatatgcctgggaaaagaggcggaattaaaatagaacatatgatgaatattttaaaaatagtgaaaaattaatgaacagatcaaatagttaaaggtttccccaaaaagtctgtattttgcattaaaatgatagtgctttcatatgaaatgtaaagatcagattaaatagatggcttttaggcattgttgaatgattttctgggtaggcgaattatcggaatacagtattaggttccaagcaattgcatatggaactgacttattagagagaaagtaacatatgtaagcataagaatgaactctcagaatcaaaactagacaaatactctggtaatagtcaatcttacagtcttttctgcttgtcttactagatattatatatgaatattatttcagcaaaagttttaactttttattctgttatagagaatataaaggtcagctgatcacaggacattgtttcagctactctgaatctcaccgaaagctcaggaaacgggattcttcagtggcaaattattcaggttttgtaattccaagggcttgggtttgaaacctggttctactaattgctagttatacatcctaggataaacattgtatttgatctataattttctgatatctaaaactgagatgctaacatgtttcagaaaatggttttaaggatattttacacataaacaaaaaagaactatactggcacagagcagatactgaataaattgcaataattgaatgctcataaaatatcccatccaaatgcttagaacggatgtgtatagaattttgaaattttcatattgtaaaaaatcaatatgatttgtgtatcatataatgcatgcaactatatgtataccctgtaaaaaaaattataattctgcagcataccaccctgcaattaaaaatagtagtccttttgaagctaaatgctaaattgacttaaaatcataaattaatttacattaattcacagtatccttttctttatcaaatgagattttcacaagtatttgcaagtccccgacaacaacaacaacaaaaacaaagacctttcaattatcagaggtttttgggttttgtgattgtaagtcagtattttaaaggacattgaaattctaaggtttaagagctttccaatcatttctcatccagagtagagggtttgcacaaagtatataaaaggattttgagtactgttttttttttaatggtttctgcatccctgttctcaaaatattaaggcgatgggcaagaagttgatgactccaagaaaatcattgtccagtctgtgcgcggtggctcacacctgtaatcccaggcctttgggaggccgaggcgggcggatcacgaggtcaggggatcgagaccatcctggctaacatggtgaaatcccatctctactaaaaaatacaaaaaaaaattagccaggcgtggtggtgggcgcctgtagtcccagctactcggaaggctgaggcaggagaatggcatgaacccgggaggcagagcttgcagtgagctgagatcgcaccactgcactccagcctgggcaacagagtgagactccatctcaaaaaaaaagaataaagaaaaaaaagaaaatcattgtccattattctgttctcagtatgtgtaaaacctgggagatggtgcctgcgttctctgttccagcccaaaaatgtgctgtgggaagaagataagagagttggccataaaaataagttttccatctttttactttaaatatgtcatcaagctgaacatcctaaaaatctaactagattacaagactgattatgtttctaacgtacattctttgagatgactgctggagggacatctttcccctaacctctccttggaatacaagatccgaatatctaggtgacagctgagtattagtatctggatgtcaccacaggcatttcactaatatgaaagataaggtcatcaccttaacttctcacaactaaacttgctgtattttttttctcaccaccaaatatcttatttattgttcagtggtgccaccaaacaccatttcttttatttcgaccaatttcccccttctattatattaataattagaccctattgaatcagtgtcctttttgaaatgcatcccctcttctccatcttcacacccatttatcttagatcaggttcttattctttctctctcatacagctggttaatatccctgtcttaatcacacacacttcaaaccatctccaaattcttgtgtgtggtctttctgcaataaataatcatgccactcttctagctaaaatcatgccaggccatgacattaccaaaacgataaaactctggaaggctaagaagcttccatctccctgttcagtgttttccacgatactcacaggcgatatgagcattttatatttcactggtcctgaactatctgccattccatgagtagggcatcctttttctacatttttgctatttattccatctacttatactggagcttcattttgtgcacttggtgggtcctatattcttgtaaaacttacctaaggtgtcgctcattctagttttctcccattcaccatcatgtgatctctctgtctctctgtgtatgcatattatatattgttatgtaagttccacttaacaatgtattctaattattaataactatttatacatctctgccaacaaaaatgttgagtctgctggagacaagatacaattcttgtacgatatctgtcctagcataaactaggaagaatcaggcctcatccagcccataatggtgggaatgcctgaggcagcaagggtaggtgagaccaaaaacaaatgtgaatgaagcccagggctttgtctggaagtaactgggaaaaattctggactaaaaaacaagtattctggcaaaagattgagggagatcctacactgcgaatgtaatgacgctcaaaggatacattatatggcagttgtttaaaatacagatggtgttttctgaaacacaaccaaaaaaaacttacttgtcaggtacccaggttagtttacactgaccagaaagtttattagagattaggatgaagaaaagaatatagccaagtgaagtcaaatgcaattgctgaaatctttctagaggtagtttgactggttgctggagagaaaactaaatacaatcatgcggaacagaagaggagacgctaaatggaaaacaagacggaaagaagaacacaacagagggagatgatgaatttatgccaggtccctttaaggcagaggattgattctaatccgtggacttcagccaagagaaatttgttgtgttattgttgtggtttcaagaataaaatcttaggcatctgtatttacagtgtgtaatgttttgtattttttaagctgccaacaatgtgagttctactaaaaaatacagatggttaaaatctcatgcacagaaagtggtctttttgttattgtacatgctatgtatctgattctttatatttattttctcctatattttccatctcctgacaaatactgctcctctcttatttggtcatttacataaaatcctatgtaaaactcattacattatttttcatgtgttaaatttgttctattttcactgtatatcaatttttgagttccattttcttgagcatacatgacaaaactgtgtgacagaacttttggaaattatcgaatgcagattttataaggtaaagaaacagctataatcataccagtctgcattggaatcgtaactagattaatcaaaattttatatgtactatagtgttttatttcaaaatgaaaacactcctttttcagaacataagtccaagattaaatatactcaaaaggagtatatgacatatatgtacatatagtacagaggcagtacattatttaattgttaggcagaattgtttaatgaattttaaaaagtgattttagtaattagacatcaacataggctaaacattagaaatagctcaaaacacttttaatgtcttctaagttatagtgtgtttttttcttttatgttgtccaacaagaagtcatacacttttgtagtgcagtatttcgaagacagcttttttttacctaatgatgattcaaactgtgatagtctgaaaagaatgttgtagcaatttacatttgcatagtgaacaaagtatatttaacatgttatagacaatgaaaaattaatatagtttattttcattattaaagctactgaccaaacaaggaaagctataattaatctaatcattacttatttaaaaaattatcttagtatggagaaaattgaaacatttatcttccaaatagatgcatttaatgtcttgaccactttagcatggaataatataaaatgtctgttagttaaaatgtcaccaatgatatgtgttaacattctttattttaaatctcatggttatgtaaaatctctaacaagagttttgcagaaatatactttatatatttgaaatcagtaagatatatgtgcatatatattatagcttatatctgtattttatattgattatcaggccgagggcagtggctcaccattgtaatcccagcaccttgggaggctaaggtgggtggatcatttcgggtcaggagttcaagagctgcctggccaacatggtgaaaccccgtctctactaaaaatacaaaaattatctgggcatggtggtgggcgcctgtagtcccagcaacttgggaggctgaggcaggagaatcacttaagcctgtgaagtggaggttgaagtgagccgagatcgcaccactgaactctagccagggcgtcagagagaaactctgtctcaaaaataaaataaaatataataaaataaataaaatgcattgattatcaaaatatattcactttatttaggctattgactaaatatgcttaagaatcagcttgagttaccctcaaagattatctcaaatccacattttatttccgctggtcagcctggaacccttccaaatacttctgcatattccaaatgcacatttttctggttttatttctctttgtgcactagaattttttgtttaccatatttcattgtttctttctctcacttttggcatgtaccaaatctggacactcagtgccttttgtttatttgtaccaactcctcctctggtctgcccccaacaataaattacaacaaagtgtcactgggattaaccatgaacgatcaccaatagcagtattatttacaatagccaaaaaagtggaaacaaccaaaattcatatctactagtgaataaataaaatgtggtatatatgtaaaatggcataatattcagcaatataaaggaattaggtagtgattcatggtacaacatgattgaacttcagaaacattgttcgaagtgaaagaagctagtcacaaagcaccacaaattttaacattcaatttatataaaatgtccagaataggaaaatctctagagatggaaattagatgagtagttgcctaatactagttggaggggagagggaataggggatgataatgataacaagacgatatgtttgggtatttttggtgatgaaattcttctaatattgattgtggtgataattttataattgcaaacatactgaaaaatattggttgtaaacttaactgcccaaattgtgtagtatgtgaattacatataaataaagatgttataaaatgaaaccgtcgacatttcacatagcctttttgttgacagccatcaagacaggtttgtttgaagaaatggtggtccaaatattatgcacaaatgatgtaaaaatgaaaatgcagaatctcagttcttactatgatatattcatccagtctccaaatacagctctagactatttttggatagccaaagatatccattaatgtccactgacatttttgtttgttcattttgtcccttttattgacccaccagcatttatctcgggaaagcaagggtatagattgcagttttccactgtcataaaatacttcagtaacatactctatttcaccacctttgctgcttagaaggcagtagcaactacagagagtttgagtcttaaagtttctattttgataacacattgtctgatcataggcatatgtgcatcttagcttctgaatagagtggatgagacaactacagctagctgttaactctgagttatgtgggtagaagcagaagtttctcttaatagagaaagaatgtgaagaaagtttacaattaagcattatgtaaatgacctgatcaaattgtgtttgatgggatttgatacctccattttacagaagcttattttaatattttctttgcaatttttttagctttagatccagctaaggatccatgcttaaagatgaaatgtagtcgccataaagtatgcattgctcaagattctcagactgcagtctgcattagtcaccggaggcttacacacaggtaaacattgttaaatttaatcccactgattgaacagcgctccttaccaggaataactgcagagtataaatatttggcagtgcctgctaatcttttatgcagagttttattgaaacagttacagaagcttagttaatacaattatgattcacttgggttaaacattggtatcagtcacaattactacagattatagaatttgaggcatatattattaaataaagaaggtcttataaagatgatatttaaaatgttatatctagttgtttgtgctttttcaagtttaaggaacaattagttttgttccctctacatatttttgtttgtggctattcaaacatctttatttccctcaggagagagttagaaagttagaggagagaaaatgattgatgttcataaaaagagattaaaagtcacgaaatagggacttgggacttgaacccctcaggatgccttctttaggggtcactcataccagtggagtcattgtatctattcggtggatgctgattcacaatttctaaaaaagaagggaggatttcaagtatcttataacaaccagcactgcttctgttagacgggctctgttttgggaaggaccagtaatttagaaatagcctgtgtagtttggtgctgagtcttaaaaatttgaacgcgccacaatcaaacatgaattcattgtttaaccgactgaaacaagtggtgtattcgtttcctttatcatttttaaagttattttttgagaatactctttctctgataatggacttatgtattgcttttaaatcaaatgaacaaagaaaattttgctatttgtgtgtgctcagagaaaaattggatttttggctttagtgtacttgcatataaattctattaaacacaccaacagtaagagaataagaataataacattggaaaataagaacataaatagcatttctaggaaacagcaaatatttaagttacattgatgtttctcataatgtaagaggacatatacataacaccctgttgtacatgccaaaaggattagaagtctttattccacaatgttaagtctatagtggcagatttctagaaccaagggagttggatataacaaaggtatgcgggtttgaaaatgtgttcacttgggttagaatcatggtatatcaataatgtactcgtggaacagagagagggagtaggagaaagaaaacaacagtttggtgatataaagaacaaaagacttcttggaaatcacaattctgtaaagttagcctactaggggaaagcacaaatgggtgaagcagttatcagtaacatatcccccatcaatcctgactttgatgctaattttacagagggataacaaagctttgggccagaaactcatttttctatttatttccttaggattctaaatttcttggcatttctattaattaatcatacaaatttaaaaacattagtatgtgaatgtgtgtatatagggggtgaaataaaaaagagaagggtgtcaaaagggattcatatatgatctctcacctaagttacagagactaagtcagtttatctcccataaaagcaaaaaactgttttatcacaagttctagagaccctgggaaagatttccacgtgcagacatttaacagctttgaaaagattcacctgccacttcacccctggccccgtgaacccaagtcaaagagcaaccaaagacgtcgcagttaatatcatgtctgtggcagagacacactcgttttgacacctgctggacactgaagctaagagaggttaaagtaactgcctcaagactacaaagctagaaattttcagagcttcaattctaatctgtactgatcgaccccagagtctaagctttttaccactatgctgtctcgttacttctctgacttattaaacagcttaactacaggcaaaaatcttccttaacatgataaagactatcagaaactgatagccaaatgtcccttaatatataaaattgaaagatccttaatagggcactactgaagctttgcctttggtgtagtggtggagagggttcagaggggagactaatatgcttttagtgggtgaatttcaaaatgttttatgtaaatagtatttagtcctgttctatttctgatagagactatttataaatgtccattcaatccatgctctattcaataaataaatcactagtttccaacaaattgattttaagattaatatttgatatgctttatttgccttgaggatgtcagtacatagtgattatttatacaacgcttagggaagaagagctttgccaagcactttgatcaataaaaatggctaatataaataatctagatcttagatttgaggattgtgtgtattttggggatgtggtagagaaagcagggaaagacggcttaattgatcaatttttgtccatttgcatagtttagaatacaaattgctaccttttttctgtttaaaggaacaacttattctttcttccctagatctcataaaagagaaaggaaacccgctgtttcttcctgcaaggggaatacagtttttcaaacacactttccagtctcctcttcccaatacaatatatcacactcatttctccattgctttagaatttcaaccttcgcatcttacagtgctcacaacatttgtaatagtttgtctaacattgatctccttcgactgactgagctcagtgaaggtgtcttatttactgctgtgtacccagatcttgaattactgctcagtacatgttttctttgaggaggttagtaaaacagctgccatttgtaaaatatttaggaagaaaattttgacaaatagtttgatcaattgaaatggtcaatctagataatctaggtttaaacattattttcttagtgctttgcgtatatttgctgaaaatgaattaagaagggtataggcatcagtcaacaagtatgttttaatggcagaataaatgaatgcatgatttatcaaataaaaggaaaaggaggatttttaaatattttattttattttattttaagttccgggatacatgtgcagaatgtgcaggtttgttatataggtaaatgtgtcccatggtggtttactgcacctatcagcctatcgcctaagtattaagcaccgcatgcataatctgtttaccttgatgctctccctccccctaacccccaccgacaggccacagtgtgtgttgttcccctccctgtgtcaatgtgttctcatcgttcagctctcacttataagtgagaacatgtggtgtttggttttctgttcctgtgttagtttgctgggatgatggctaccagctccatccatatccctgaaaggcacattatcttgttcaagaaggatatttaaacatgaaatgagggatgtaacgattggttttaagaaactagtaggtccttcacttggatttgtaaataattgaaataattagtaaatttctccttcctcagcgttttaaataataataattgtcctctgaaatcagaaaaataacatgattaggtgaatcatagttttagtctagttttgaccaccactgccggtgtaaaggatggtgtaaaccatccaaatatgtgatgttcaaagtcatatatttggatattgtctccaaatggctttttctgtgaagaactggtctcagagcaggtgatatctttgtcattgtgctaactttctgttacctttatcattaccagttaaaagaaaatagtagtatgaataatgagaaggaactttagctgcagcatgtttttccaatatggtaacataacccattatttagatgctttaatatgaaatacatgatgggtttcccaagctttgaatgtgatccacttgttatattgttacccttggggaaagatctgaagatgctgacagctgagggtgattgtttcattgtttttgtatattgtgaacaagaagcccagtgttttatgctcccttgctgcctgtgcagctgcagataattaacactatttctagatcagtgttgctggcaccaatcgatgctgctgatattaaaaggaaaaggtttggcataataagacagagtaaggttgaataagttgtaggacaaaactagccatgttaatttctacttcatttacactgaaggattaaaagaaaaaaaagaataaggaagtgcttttgacctcctaagaaggcattatatagaaaatgatgaaagtagtgtaaaatgctacttatcaaaaataattatcaaaaaagtgagtcctaaaatttatctattttaactatgcaatcttggaattcatggtttataatgactatttttaaaagaagatctaaatgtatttatatgatcactgattgaatagctatggcgtttgtgtttcctttgttgaaatattgaaagcagaaagatttaatcacaaagcataagttatatagtgttccacaaatgtttgctgaactgaattgaacttatcataatcatttaaaaataatgcttcttatacttgagagacatttaacttctatggaatatgactgtattaataatgtcttcagagagaattaaatccagtatttatttcacacttaatgtatgcaaaactctttcctaaatgccttaaattgatttagcttttacagtgatgctaatgctttatactaagcattattatgcccataactgaggctcagagtttctgggtgttctgcttgagattagttctatagaagcataattgataggtatagttagatagataggtagatagatagatgatagatagatacaaagtgtagatttcagatttgaaatcatgcctatcttgtttatatatacattttttccataattatcaattttatgtatatgaacagatgtttatagatacttaacttttcataaatttattttagttaggatgacgaaggtttgcaaaagtttttaaaattaattacttttacaaatggtcattgtactttggatagtgaattagtataacattgtttgattcctcttcttaaaagatagatcataactaaacttcatagtttcctttatgtctggaatttgatatctgtatgcacacacacacacatacatacatacatgcatatatgtgtgtaattcatttaatcttacaatagttggaagtaagatgacttacagttgttatccccattttacctatgataaaagttgagacagagaattcacttaatttattcaattggtagacttggacactgaacctggccattgtggttctagaatttgtgctcttattatgctttattgtcttatgttacttataaagtatgttatataaatgagacattcttctaagcattgtagaattgttacttatcttaccaccaccctatattttcaaaaagaaaatttctctacacctattgcctaatgtactgtttctcagcatgttttagcccacattctttttttgctgaatatacactttttaggttctccagttattctattatcaccctgaagggagcatagtatcccctagttgagaactgctataatcagaaaattcaactacttagattgtacatcttagtcagtcaatgtgatttggtcagggtttatattaggtgttatgcattacaaaaacagaaagcatgtttctcatatatgaaaataagtcacaggattgactttatttttgaagtacacaacacaccttatcattattgggatatatttcctctccagttgaaaatcaggaacctgttggttaaagtccaaaatccttctcgtggtcctttataatctggcccaggtagctttagagcctcctctgtagttttctcccaatggcacattgcagatttcttacagcaggaaattcattctgtagagagcccagaatgtatgtcagagcacaaggggccagagacagaatgcctggcttcacagtttagccccactgttcttagccatgtgatcttggacaggttacccaagctctgagtgcttcagatttttctgctgtaaagtaggtatcatacaaatggtactttctgcgatgtagttttaaggattaatgacttaatgtgcaaaaacaattagaactacttcatccatgataggcattatgatagggttagctattactattttttcctaaacacgttgtatattttatgatcatgggtgttggttctggctgtgttttattttctcgcgagatgtcctgcccacttgttcctttgttcttctggcagactccgtttctgagaaggcttttcagcataatggttaatggatgtaatttgaagctggacggactagctttgaagtctggctccatctccatttctccagaatgactttgagcaaattaaattatcccagacttagttttcttgtttaaaacatagagttgataattatactatgtatctccctctgtttttgtgagaattaaagacataatttgcttaaagcacttttcacaatgaaagcactcaataaacattaattattgagaaaggtctattcagtctcccctcccaacccaaggtagaattaaatatgcttgcatctttgtgcccatagcacgttagaagtgcttgttaacccacgaatattatagtgactgtatatttaatagctaacaggtgaattgttgggttgccatagacaaagtagttgagaaaattgatttactcctgtcatgatcataggatatgaaatttaagattaccttatacgttaaataaaaggaagggcgtgattttggcagttgagaaggaagagagtggaaacaatgagccaccattgtgttatagaaaatgtgagacagatgcttaaagagaaatagcatgagggtgggcatagctttggtgggttaaagattattagggtacttaaaatttcaaaaaatttgctgcccttaatgattctctgctttacatcctttagcattgcctatgtccccatgaccagagaagacgatctttagaccagaagttccaaaatacacgagaaggattcataggcactagacgcctcaagggatgtcaattttttttgagtgagcatagctaagcccttgcatgtcctgtcagagagattttatttctccactgggcctaaaggctccttctgcttagcaggaaccctccttgcatttgaaggaaggaaattctggatctgagtagagatccttcgcagttctgcttgcaatatatactggctttgaagcctgtataacagatttgtaatgaatgtgcctccgtgtatacttctgaatcttgtataccaagatttcagctgtgagaacaggggtttaaatcgatgatcggtagaagagggcaaatagagcagctagccacaaaaagggtgcactatgacacagggaatagatgaaggccagttaatggtgtaatgtgaacagtgaacagaaggaattccttcacacataagctgttactctgccatccaattaaggcttcattaatgtcccctatagaaggaaaagagtatgaattggggggaaaaagtacagcaaaggaagattcaaatagttcctggtttcttgttccccaaatagacaagaatctggtataaacctttggagagaaaaaattggatattaatgaaggttacttttaaagaagtattttggatggaccttaatatctcttaatcaaatatccttaagagatgaagattaaaatgctcaggttcaaagtaaagtttaatcaacattacttaggtttctgaattgcaggaagggctgtatttacacaaatatgtagtaggtgcctttcatataaaagaaaaactctatttttttgtctatgagaaagaggaaactagctgcctattaagaataatgattattctagttcttccaattcagtctatttctatattgctttattattttgaaagaactgagaaaaactatgattgtttattagctacatagaaaagggtagaaaatattatacataggtgatgtcagtgatagcaattttaaaacttctttatttttaaaatttaacgcttatgaaaacaacatgtggataaggtaacaactccatatgatggaaaggagtacagatttgattctttcctccgcagaccactcagttccactcctacacttccaggaattatctacacacacacccacacacacatttacacaaacacacttacctccaaatgggaatattttaatatatatttttgtgccttgttttaacataacatgttttgaacatttgcaattcagcaaatggattttatctcatttctttgaatggctgtaaagaaacccattacaagactatcccataatttacttaacttaatactttattgatggacattagggttagttctactttttcttattatcatgctttgtacaacacgcttcagcatgtatctttatatacacgtgtgtgaatatttttgccataaattcgtagttgttggattgctatgtcaaaaagaaaatatgtttaaatattgacatgtattgtcaaacaacctccagagtgtgtcagtttctctactgtaaacaatatgctgatgcctgctgtttcacccctttaccagtaaagaatactgtttagatattagtaattttgagttttcaactgtcgtagtttattttttatttaaaattggtatggactgggcactggtggctcatgcctgtaatcccagcactttgggaggctgaggtgggcaggtgacttgaggccatgagtgtgagatgagcctggccaatatggtgaaaccctgtgtctactaaaaatacaaaaattagcagggtgttgtggcgcatgcctgtaatcccagctgctcaggaggctgaggcacgagaaatcactgagccagggaggcaaatgttaaagtgagccaagatcgtgccattgcactccagcctgggtgacagagggaaactctgtctcaaaacataaataaataaataaataaataaataaataaataaatataaaaacaaaaagtcacattatcttttttcagcttcaggaataaatgtatgtgtgtgtgcctttaataatggaggggctatgtagatactgttggtggtttcatatcagccattatctctaagttgtaacatggtgaatcatggtaaaaaatagtggtgaattaaaggaaattgactatactgataacattttttagaacttaagcaattttttcaaagaagaggatagttttagcacaagataaggagacttaaaaaaagaggctccacagtggaaaagaagtactggatccacaagctgtaacaaaatgtgcataatttatttactttcactattatttagacctattactttaaagcaattagtacttgatggacaggtgctatagtgaacttaattagtcctttacatatttctgtttttaataatctcttcattaaatgagtatttcttattctaaatatttctctctccagttcatcaattatatttcttaaaattttagagtatttaatattatcattattaataatgtgatttccagtgatcaattgggatgatgcttgctatgaattcattaataaattcattttattttaatcatgacattttaaatattaaatccaaacttgctgttactgaatttgtattaaataattcaacattttgggtaaattagagctaaacctcctcctagtcaactgttggcaaagagacaattgtatttctgggtaatggacattaagggctggagcatattaatttttaaactttgtataaaatcttttttcttgttgctgcctaatgtagataaataattaggaaattagtagtcatttctgctatatttcagcctgaataatctttctattcctaaattcttgctttattttactattttctttagatttttaaaaaaatatttgtaagaacatttttttttaatttttttattatactttaagttttagggtacatgtgcacaacatgcaggttagttacatatgtatacatgtaagaacatttttactgttgggcctatctaatgtcaaaatatggagctcaatttacttcttatttatttctgtcctcacattgtgattttgaatatgtaatttgtaatcattgatattcagttttgggcagagagacagctagccatagaacaaaggatgatgttcctctttcacagggtagacttgtttctggaaagtgcctgccagggcaggtactagtttcctgcagctcttcccactagccctgacatctttctgagatcatgggattacttcttgcttgtcaaaacagaacaaaagtaatgcttatcacttcggagttcagatggttaagatatgggtgtgactgcttcccccttccctttctacttataagatggaagcagataattctgagatctaagggatggtataatcacaagatataatgaaatttatttccagaatcaccataggaatgatcatccaagaaatagcctcattggcctattatatgaaagaaaaataaacttttgtattaagacactgaactttttagatgtgtgagtagctatcattatcctgattaataaatctatttgaaatttactaccaaaaaaacgtaagaattacattgatggtggaaaaataatagaggcgtgtgatgggatcttagtaattatctcatcaactttttcattggttaaaagcataggagactgtgtaagtgttttgaagaacttgtctcctggggactagctgtggatatgccctaacaattgcacataattcatttccaaacttaaacacttatttactcttacagaaaaagctgtagcacataagacacaaaaaatactggaatttccagatgatcataaaaaattactctagactatggggcttcactaaacttagagggattttgcctgttattaaggcttatataaaacagaatataaattatattaatttaagccttaggtcccagatacttaacacataattatttaagtgaggagtaaagtatattcatctgtagtgatataaagacagccacacaggtctcggtaataatgtgtgcgatagagaaacctagattttagtcataaatatattaataaatagacaactgtgtgactctggacaagtcagttaacaggcaactaactgtgttagcaaataatgggaggctttgaaatcccacaggtctactggtttagtgacaaaatataaacagctaatacatctgtaggggtagagtacattctttatcattttcgtaggtttctttccttccgttttagcattcggttgactgatatgtatctagggtttgcttgtaactagaataattttggatctggaaaattctttagagatatttaattccatcctgcattctaaatataaggtaaggattatcatgattatgaaaatataaggaagaggattaggttgagaatcatagaaataacaatacctgcttattgataagagtttactaagaaatttgtaggtattttacatgtattaatttattttgtagttactattattttcgtccttttacagattaagacaatgcaactcagttgatgtgaattgaaaaggctataccagtaataattgccatagctaggagttgaatttagacctgttcaatttcaaagcctcccattatctgctgcctatgaattctattattagttgcctgtgaactgacttgtccagagtcacacagctgtttatttgttactatatttaagactaaaatccacatattattattgaaacctatgtggctgtcttggtatcactatagatgaatatgctttattctcaactagaccattcacattttctgctaattgttctgtgtcctgaatcagtttatatctctttttataaaatgctactgtaaaactctatttgcattaagctgtatatattgctatcttcccttctgttctcagtgggcaaattcagcattttgttcacagagaaaagagaaagcatccagtagagtcttttctgacattttgcttactgacttgtgcagatatcagtttaattaatactcatgaaacactcaggacagtggcttctattcttattcttgcttttattattgttactattattgttatcaaccacgaccttcatcatcctcttctgcatatccctaatccatcagcttgtgttctcagctctagaaccatcatttcttatgtttgtattccttgatctaacaattattgctttgtgtaatatgtttaatctttctgtatctgttagcttattgcttagcatatatgaacaaatgcaaatttctatattttttaaagcaagcatacgaaaattccacttcttttacaacataggaggagaaaattattccataccctctctttacctttggtttccttctaattcatattgagcaattatgctgctctttgcaggcaaatcttttagaataattttgtttttattttcttgcctcccatttgcttttccacctaccacacattataaaaattttcaacaagttatgtagtccttctgtaaatagaaatttttacctgctctaacttgtgattactttatttattaatttgcaatgtctattcagctaaagcagtgaaactacttttccacagggcattggtaacttctatgttgccaaatttattgtctagttttttgttataacttgagatttctattgcattcatttactcaaaacttgtttatcattgaacacacatattgatcatctattgtgagccagtaatgcatataggcacctgggttatggtgttagaaggacaaagaaaacctctaattttgttactttcacattttggagtggaagacagacagtaaagaaatcaaacaatacgcaatataatttaagatagtgatcaatgacaaggcagatatagaggtgactgagggaagaggcaaggtggcagagcagttaaggaaactttctcattatagataatgtttgaagaattacttgagtgaaaagaaatgagtcattttcagatatcaggcaagagtgagccagacacagggaacagagattgcaaagatcttgtagcagaaacggacttggcatgttcccataaaacagtaaaatggccagtgtggtcataagagaagtaagatatcaggtccaaaactgtgcagcactcatatcttatagggctttgaagctgtgtaaaggaggttttgaattttatcataaatgtaactggcaaaccatggcagggcttcagtcaagatacaaataagaaatgagtttcctttccaaaggatcactgcatgtgctgtgagaagcaacagttaaattctaggtccagctagtcagagggtgagggcagtaactcctgggggaagattctggtggtgcaatggggttggtgagggtacaagtgtacagaatggacagtcaaaccaaacacttgagaatgaattggatatctcattttggtgtgtgtgcatgtgtgtgtgttgtggaagaaagttgtgaatctgtaataaatcattacaaatagtctggtatttgttgaaatggcgatgtaaaatcactagattaaagctgtgtcactgatatatcatcctagatatattattttacttctcttcttggaaattagagtcccttttattgctgccctagttttcccacttcacttggtggtagtgatcacaaattgtgagcctgcttttgtgatgatacacatcgcaggattcaggaattcttcattcgtgtgctgtaaaattataaatggtaagatggcttggaaacacaggggcctaatcctgagaaggtgcagatttcccagccaatcaccacagacaggctaaggggacaccgtgacaaggcaatctgtgtgatatgtgtttctctttagccagaatatttgatatcattgggagtcccatcacaattgtatggaatttaaggaggacagtttctccaactaaggaaagagactttttataaagtatctgtgtgtcagagtggggtgtgatgggtaacacttcaacatgctagcatccttgctatgagtaaaatctcctgtggaaaacatgacaaaaaaggagtttttaattatgattttaacttatgattgacataataattacatacataaaaagaagaaattcttcaacaagtgaaacatgataaaatttgacattgagatgttttgctttccagcattttactttgttttttaaacatgaagatctattgaaatgatagtattgtagatttggaaaatttagaagagttaagtttgaagtgaaattatttaatttacagtttctgtgattcagaattttatatattttgacacactaaaaaggggaaagatatgttaaactcttagagcctagagacagaaaatgtaataatatcaccttaactttatctgttacgtttgtttggatgtactaaaccaaattggaaatgttgatatcctaatatttgtatgattgcaattttctattgagatataagcagtatctgcttatctacttttcccatttagcttcatagaataaataatcctcactccaagaaatggcctttgcatttcttttaatgtgaaagcaaaattgcttgccttcccaactaattatataatactagtgttcatctgagtgcaagaaaatgtggttcattattatcattttatagtcacatcccatattgacactttgtaatattgtagaacaggttccaaggattattattgtgatacttttcaatttaagaaattctaacattgaggacaacattgagtcctgaatgtttgctaaaaacagataatgagtacaaagtgacatgttttctgtgaacagtttttcttttaagggagatgtgcactataactaaaaattgctaatccattttaataaagttatttgatgcaaatatttccattgtaacctccatatattcaaaataatgggcctggaagatttgaattgttgcctcttcacttggacggattacgtctaaactatagccagctgatgatttttgcagtcaatttgaaaagacatttctattctgatttttattccaatgttgaattttcattgtggaggatttcttaggttctggtttcaaacaatccaaaggtaccctgtaagaaaataagccagagtttaagtcaatttctttcccaacttctgtagtgattcaaagatctgagaaacattaagaataatgaaattatcaatgataaagaatattacaccttgggcttctcttctggaagctaaagtatctcaccatttaaatgtagacacttctggggccatattctgaatggctccttgacagcaatttccctgtgttcttccaagccaaactcactttggttataaagaccatgtaaggaactaaaagcatgatcattaaagacaggagttaaagaattattgttatgaaacaaaatgattacagaggacaaattaatttttaagttaaactttaaaatggatactgtatatacatttcatggtctgtagttaattgtatagacaaacaacattgctgctaagaggctaaaaggaagaaaccaagaattttgaactgtcttagaagagaggattttattttatgcatcgtccaggacatgtatgcaccttgagaatgaactcttaccttgtccctgtttattcagtttctgctgttgtgataatctgcaatctctccctcatatatagagaaatctaaccctgttagcacccctcctgttgatccttatgccacgaattttttaaatggaggagcatatcaacaaacaatacaactcccagtattttcttataaatttattacaaagcacttaaaagagtaagtattaatgtttgactaattcaaaagctgattaaatttttcagctacaagaggaagaaaaagtcaacttttgttgagatcaagctatacggtttatcaaattacatatttgatgttgtattgttttcgatgttttatatcctaattcctaattcgccttggttctcactagattctggaaagccatacaaccttgctctttaatctggtaaattatcattataaagatgaataaactattgaggaaaatataaaaaatattgcataattttaaaagaatttaagtgcatttgtggtgttaaatttataagaagtacccttctctaggtaaagagagagttgcttcaaacaatttgtattattctttttaaacataatggtctaaagaatgattagcatattgatgaaggtgatattattttattattttttaggttttctacaatttttctaaaagaagccacactgtattacaagtatttccgtgatgcatggtcttttccttctcttgttttattatattgaagtaaataggaaaaagattttcaactcagtacatattcattaagtacctactatctgtaagacatggtactacccattgtagaaaattcaaattaataatgaaggctactatagtcttgcttttcagtcagcattaattcaatcgagagataactacataattccacataggggcaatatacatttttcaggggctctatgatttgaatattttattttatatttaattaagacattattatacatatatcatggtaacatattaatcacatcagattttattatttctttgtgttgagagcattcaaaatcctctcttctagctattgaaaaatatacgctaaactattaactatagccatcccatgcagctatagaacactagaatttatttctcctatctagaagtaattttgtttctgttaacctctccctttggagaaacatggatgagcccagaggacattacattaagtgaaaaaagtcaaggaacaagaaggtaaatatgacatgttatcactaatacatagaagctaacaaagttgaggtcatagaagaagagaatagaactgtgactattaaagtctgaaaagattgggaggagtgaagataatattcatttaaatataaatataaaataattgtaaacaagtaaataataggtttcagttttatgaagtcctgtgctatgctgtgtgtcagaaacaagcagagaagaaaaaagcaaaaactggcaagattaaaattagtagtcattaaaattgtctcttttcaactacaccatagtctagttttcctcctttgggtatagactcaatactacgtggaaaaagtcctgaaagttaatgattgcattattaaaatgcaaatacattttatatagtatatagttgtatgtatagtatatagttgtacaatatagttgtacaattcttccttactaacaagatctccacttatactcattgaacaattacctcaggaaagaacttagggaagaggggttgataaatcacaaatattgccccttatgcttatctataattggctactctcctagttcctgggaatgcattatttaagtacaagtatggcctcaaaatatagggccactgtgttcttaataaatggtctaaaaataaatatggcttgagttttacatgttatgtttctactcattttaactttattcatttagtgactcaaaggtatagttcttttcaatgtgtatagaaacataaacataataaaaaaatccaaactgcattttctctatttagtaaaattcataatttatttgattttatttatatggataaccctaaaatgttattttcacctataggagttatttattttttatttatttgatttatttatttctgagacggagtctcgctctgttgcccaggctggaatgcagtggtgcgatcttggctcactgcaagctccatctcccgagttcacgccattctccctcttcagcctcccaagtagctgggactacggcgcctaccaccacgtctataggagttatttttaatgtgtttattattatgtgagattacaaaatatgtgttctgatttttctacgtaaatgatggataaaagagatacaaagtcatcaaaagacagttttgcattatcagtaaactctgtattgatgatatggtatatcttccactacactgatggcggcagcagcccatctggggcagccactgtgaagacactggctgcaacaggggaggcatggctggggtcacatgctccatggagccagaggggagttaggaacaggtgagagagcctggccccctgctggttcagcagggcgggagcgctgtgctcctgggcacagctgcagccagccaactgcagctccagatccaggcattgctgcactctggggacccaggatcccccctgttcccacagactcagaagtgcctgctcccacttcctgccctctccgaactctggcatctgctctgtggtggggcaaagttgcagagcgtgtgtgagctgagggtggtgctgacacaccagcctccccacctcagtccccaccagagtttgggtgctgaccaacatgggacagaggccaggggtgctgagtccagcttgtgcaggccagcaggctccccttggtgtagactgccagggtgccatggatgacaagattgatggatggcaggagtcagacaggtgcctggtgaaacccgtctttcaagccaggaatgacctgaagcccgggagccagactgaatgaatagttctgaatgaagttggtggacaggagcgagaattatgttgctttttccaggcctgcccgtggactcccatggaccaatcagcatgcacttcctcccttctgagcccataaaaaccctggactcagccagactcacacaaacatcaggactaccagctacagaaggagctacccacgtagagtctcttcaacttgtcgggatgacatgcctgcagaaaggagctacccactccaggtcgcctaccctctgagagctggacactcattgggatctcctgcccgcagaaaggagctactcactccagttctcctcttggctgagagctggacacttgttgggatgacctgcctgtggataggagcttccattctcctctctgctgagggctacgctcatcaggatgatctgcatgcagaaaggagctacccaccatgggtcttctctctaacgagacctggacactcacggaatgcccttcctgtggaaaggagctacccactatgggtctcctctgggctgaaagctggacacttgttggaacgacctgcctgcagaaaggagctacccatttcaggtctcctaagagcagttctattgctcaataaagctcttctctgccttgctcaccctccagttgtccatgtacctcattcttcctagaccgcggcaagaacttgggacctgctgaatggtggaactgaaagagctttagcacaaacagggctgaaacacaccccctcccccactcaccatattatgggtgacaggaaggagagaagagctgtggtcattctgggagcccagatttaggggcctcccaagcagggctgtgataccctctttggagctttgtggtttctagtggctccaagcttctaggcattgccacattcccctcacacaggtgcctacagcagaagctgcttgcggtacatctgatccagccattggcttgcatggatccagtgcctgtgccagagcctggagctgcccaccctgctgcagctgctggtctgcctagctgtgcacagtggccggaccccacgcttgctcatgcaagcaccctgcaccactctgctcctggcttgcccttggcaggtgtgggatcttggctgctagcatgagccaagcacagcctgccaggctgagtgggtggaatgagcccagtgggcccaagcaaaacttgggcaaaggctgataccaccagccacagaggtttcatgctggaaaagtgacacccaaaggatcctgtgacacttgtgagctctcaattgacataatcaagcaaattcttggtaatggtaatggagaaagattaaagaagatattattgtatctcttcattcatttattcaacaatgatttattatctgcaatatgccagatattctaggcatgccagatacattaatgaataaaagagatgtacatattgctgtcctgcaggctaaagtctaatatgtttttctttaagtgaagaatagacatataaatacagtataaaatcactgctgtgaagttcaccatgaaaatgaagttggtatgatatccaaattggcagacttgtcaggtctctgaaggtgtgccatcaaagcatgaacatggaaaactaaatagaagtcatcaggcaaaacacagaaggaagagtgaggcagaggaaacagcttgtgcaaaggacctaaggaagaaaagaatgtgacatgtttgaggaactgaagggaaggggagcaagaatctagagctgcattttgaacatgttaaatttaaaaagctcatgtggtaaccagtaaagatgtgaagtaaagtgggtgggaggttacagttatcacaagagctcagcttggagatagatttcaacacatcaataatattaaaactcatggaaattgatgagaacatttaaggagagattgaagacaaaaatagagaatagatccctgggaaattcaaactctttagagttaggcattgaggaagagtctacaaaagagacaggaaggaacaaccagtgaagtaggaagatgataaggagtatctggtgtaacaagagccaagcaaaattttaaggtgaaggtggttgttggctgttttgttctgcacagaagtaaaaagagataattacagaaaaaaataaccattgaatttggcaatctgaattggtattcagagcaaaacagatggaggagtgaagggaaaataggaaattagaaattagattttggggaaaaaacaatggaaatgtctcattaaaaatcaaggagtttttgtagtgttttatgttggtttattgtagggttggagtttaccaccagagactgtttttcattgacggggagttcagtaaagcaagagagatttatggtgcaggagaaagaggggcaaagtctttgagacaatgagaagagaggcaccctgcatatggatgtgtgtataggggcttactctgggtaggaagaggagctctttttcagtctcaccagaaataaagaagacatctgcagagatgcatgtgaatctgcggctcttaaattgtgaaagggatttttttccaggaaacttatattttctaaaagcagtataaatagataaccacagttcttagaacataggaagtgtttgaaaaacagaattattatgattgttcttattgtaatttgaagaagaatacattcacatacttcacgattcaaaatatactaaggtatgtacagagaaatgtctccttcccagcctcttccgcactcatatcccttttctggaaataaaaatgtttttgatgtcttctgaacatttctagaaatattttattcacatacaaacaaatgcattttattattttctttttcccttaattttctatcatcttcactttgtatatgtgtgtgttgtatatttatactcaataagttactttgagatcacacttagtaaataaaaccgtcttccttcttctccttctccccctcctcttcctccttctcctctttctccttcagagttacattgcatgccttattactgtttttaaactgttaatgcaagtggcaatttatataaagtacatcactccaagctcagaacatggtgggtatacaataaatgttaatttccttccttttctccatgtattggagattttaagggactccagaccaaactaagcagcacaaaataaattcatctgtgttttttattcatctctgaccttaaaattttgttcaaacaatagagatcttgtactgttcccaataccatcttgttcaagttcttttattactctccctatttgactcataaggccttgctttgattgctgttcattatcctttttccctacttgtactcaatctctgcttgccatttcccagtttgtcttaatcagggctcctgagtgcaataggtgccaggaattatttcatgtaacagaaaaaataaaataaaatatgaattggaaagagaagtaagaattatggagtataagagctcaactgttttaacttgtgaaattgccaatcctaataatactaatatgggcttggcccaacattagtgaaaacatggttatgatatacttaatggcagactaaatcagaaccccttaatcaatatctgcttcctctgtaatagaagactcactctttgttttcaaagagtcaatggagactttaagcagatttgtagcaataactttgaatcatggctagacttgggtcagaagcttgtgttactaataggaatctaaaatctttgtgcatatgcagttgcagttttatcaagagggagaaaattgatctaatgctatactgattcaaatctgttttacatctttcttcttaaaagagaagagctttggcagccttcccaactaatggaagatttccagaaaaaaagttagtgactatcagattctggcttcactatcaatggaacaatcatttaagaagcattaggtttaaatgacttactctagaatgctcattctgacttatctgatactcaaatcctccaaatatccttgaaaatatatattctgcaaatgaaaacacaagtatttgttatcaatccatattacacattactatgaaagtaacacagagaaaaacatttctggaatttctgcaattcaaaatgacagtcattttaaaaattggcaaggaaaagatacaatattatcagagaatgctatgattatgaacattcataaatagttctttcttgcctttcttgcctacttaataattatcataatgaatattttaaagtatttgtaagatttacaactctttatacattttggtcttcatcattttgtctacattttcataactgagattaagtctaaataagtctgaattaattgactctacaaaacaagacctttaaaaataagttaatcaatctctaacttgtacatctctattaaatacaacatgattataaataaattataaacctaataatgtaaaaaagacagacttaatagaagatatattttgagtaaagtgtctaaaaacagcaaaaagtaatccacatttaattgcattaaagacataaagaagaatcaccagatgctctgttttttgtgacaataaaagtttcaaatacaagtttcaaaataagactggcttaaatttttgctctgccttttattaaccatgtgtgcttatcacgccatctttctcaatttgtttctttgcatataaaaatttaattttaaataaatttaattattaaaaagaatcaaatggtataataaaataaatacaatttgattatatatatataatatctgtgagatttttatggcaagtataaagtgagtaaaacaagtggtgaaaatatttagaatttaatggctagattaaattcttgagactagaaataataggatcagttgtggcaccacttaagtaaatatttattgagcaattctttgtgtcgtgtgcttttctttatgctagaggtacagaaacttaattttaaggagaaaaataaagaaggaggacagagagtattggtaggatgaagggagagaatgttgcaggactaattagggtagccgggatggctgcattgagtatggaagaacctaaataaagaaaggaagtaggttgagtcacttgggtatccaggttcaaattcaaatatcaaggactaaggttgaagtcaagactgagagtttcaggaacaacaaaattcaagcccctagttacatttaagctctacctaaactcttgggctatactgacattgggttgcaataggcaagcatagggccatgcaaatcaattgcagttattcaggtgggagatgttgatggctgggatgatagcagtgcaggaagtaaaaaaagaattgagcttatgaaatacttacattgaagagccagtagcgtttgataacaagttagagaggagaagtcaatgatgcctccaaaagtttgatctgagcaacacaaaggatgaaaagtaagatgggaagaaagtggtaggaacagacatttttcttggttagttaattggctgttttgtgtgtgtgtgtgtgtggtgggtggagagtgttgtatgtaggggttgaatagaccctcacttcagggcatattaagatcaagatttctatgcatcccatgctagatatatacccagaagaaaggaagtctattgaaaagatatctgcactcccatgcttattgcagcactactcacaatagccaagatttggaagcaacttcagggtccatgagcagatgaacagatcaagaaaatgtggtacatatacacaatagagtactagtaagccataaaaaaatactgagatcctgtcatttctaacaacatggatggtactggaagacattacattaagtgaaataagccaggcacagaaagacaaacttcacatgttctcactgatttgtgagagctgaaaagtaaaacaattgaactcatagagatagagagtagaaggatgattaccagaggctgggaaggatagtggggaagtaggagatgagggcagtgggaatggttaatgggtacaaaaaatacagttagatagaatatataaaatctaaatatttgatagcacaacatggtgactacagtcaacagtaatttatagtatatttaaaaataactaaaattatagctggaatgtaacacaaagaaatgataaatgcttgaagtgatggataacctattaaccctgatgtgattagtgcacatggtatgcctgtatcgaatacctcatgtacccccataaatttatatgccacctctgtacccataaaaattaaacattaaaaattttttaaaagatacatatgtagttagatacatgaatctggcattttgataaaggtatagcatgatgacttatattccaaattatacatattgtcttagtctgctttctgttgctgtaactgaatacatctggatacatgagactggataatttataatgaaaagaaatgtattttttacagttctaaagaccgggaagtcaaacatcaggcagctacatctggtcagctgctgtggagggcctcatgctgtaccctaacatggacaaaagcatcacaggacaagagggaaagggtgacagcctaaactggctgtttatgacagaccgactctcagacccactctcatgataactaacccacacccatgataaattgttaattgattaatctatgagagaattaatttctttatgagggcagagtcctcatgacctaatcacttctgaaaagcccaacctttcaataatgttacattcgagattaacattcagtgtaagttttggagagaacaaacattcaaaccataacacaaagatttctaactgaatgataataacaaaaccatgtctgtagacaaaatatttagcaagtactgaatattatcagatgctactgaaagatcaaatcaaggactgagaatttaccatttggcttttagtaatgtgcaaatcatttgtaaacttgacaaaaatatttttggtgtagtgagagtttaagaaaacttggtaggagagaaattagagacaatgagtatacacacatatagagaaagagacagaaagaggaattctgttgtaaagaaaaagagagaaatggtagatacatattatagattattatttggtattaaaaacatttgttatgaggattaatttgtaaacattataatgattagcaaaataatatgcacataggcatggattatttgactgtaaatgaattcaacatgtatttgaaaattattgaagtattattatgttcttttagtattaatagatttcaaaatctgaaaactttcaatgtctgtccccaattccaaactctatgatcttgatattcttaaaaaaatccttcataaccaaaaggtagacattggtggatacttgattattactgtcagaggattttgcatgatgaggtaaaaataatatgctattcacaatattcacagtaatcttacctatttaaaaattttattaaaggattgctagacttccatgagaatcttaaaaatgacttttcaaatttacctcatgaagatgaactggtggactttgccattgatgttatttttcagtttactctttaacccatgaatatttgtcatgcagtagcttcatattttaaagaactatcaaatttaggtatataaataggcaatatttgtttatcagatacatatcttagccatagccaactgatttccataagtaaagatttttttaaaaatgtgtatatatatttatgtattccaaagtcttgtatcataatgtttcttggtaaaagttgttttattttccttaaaaaattaaaagtaacttgcatttccattgaggttatcttttgtcagtcttggatctatcttttctagcggccattaaatcaacttgtgatcaaactactcactttgtctagcgacagtgtatttaaggcaaatttattttgcatgaaatttaatccaggcatagcagacaaatatttttcatttccattgcatactaattatatttctttcttcttatatttcttatatttcatactaattatatttctttttattaaattagttgataatgtttaagaatttaattggtaaacctcatctggtttcagcgacaataacctgtaatgaactcagtactttctatttagctaagaggtgagccctctcccattaacaaactctttactctgcactgtgctattattgagtatattttggagacacttcttaatatggatattgcatcatggaaataacaacatgtattaattcactttcacactacagtaaagatactacctgagactgagtaatttataaacaaaagaggtttaattgactcacagctttgcatggctggggaggcctcagaaaacttacaatcatggtggaaggtgaaggggaagaaggcaccttcttcccaaggcagtgggagagagtggggaggggcgcaggggaaactgtcaaatgcttttaaagcaacagatttcatgagaactcactcactatcacaagaacatcatgggagaaactgcccccatgatccaatcacctcccaccaagtcccttccttaacatctggggattacaattcgggttacagtttaagatgagatttcggtgggtaaacagagccgaacgatatcaacatgtacatctgaatatgcctaagccattgtttgtagtttaaaatgagaaaggcatactttattccaagtttatccaaactactgaattactttagtgtgatgaaaatcaagtgtaatttgattcagttttcaacatgtcacacctgtagttattttatatattgttagtagtaatttacttattgttatatattttatattattttatatagtttaatatattgttaagactgtagtataactgactccagtcagttgttgatcaataattaagaaaaataaccagcatgtgcttgctttaaaataaacatccttaaaacaatgtggactcaccactgggcaaattttagtatttattaaataggttatgaagcatttgacataggattatagaacttttcattttaatgtgttttaataatcttaagagctatcgatgtgaaaatcattgtttttgttgtttctttttctcccctctgagagttttaaaaagtgggtgatgttcttttgatttgtcagtttttctttttgatgtgcttgtcaaaacagggagctaacttgagacagtctgctgaggctgccaacccggctatttagaatgtcatcattttacattgtaacattgctgagtgatgaaggccagctggtgcatttaagtttcttattgaagattttcatctgattcattattgtgatttgtggttttgtacagaaacacttaatcatgcttatgtagcaagcacttctgaagctgctgaaggctttctctttcgctgagtaatttgtgctatcaatctgctagttttgaagaatttccagcttgttgtattatcagtgtttgtttgcacaggaagtgatgcaccacagaggctgaatttatagtagtggtttgcaatgggataatgaacaacactgcttccttcataatgttattattatataacttggattagcacaattattatgtatctatccagttataattctctcataccatctcatgagccagcaggaatcacttgtgtttttgcaaagcaaaagtacactgtaccttgtgccttggctatgtaccttcattcgaaagatactggcctttaatattttggcatgtttccttagtagtagtagtaatctgacagagagtaattctccatttgccattggtgaaaattgccctaatatttgtgtttagttgtaagccgaagctaataatgtctagtatgtttcaggaaaatacatacgtagggaatgcattactttagtgcattattggagtattcgttgagttagaggagttatattcttaagcagttagtgttttggtttatagcttcttttagattcacatctaatactgaatattgggcaaataaaaggtattcacagaagatcaagatgaaaaattatttttattaaatactttaaattatcttttattattaattgaaaaaatactttctcttcttgtgaaaagagaaatatgactccatatttgcttgtaattgggagaaatagacatgttaaaagccacagacatgaatgtaagtacaaaatatcaagtaatcttcgaatcctcttaaagacttttttctgcctttgcccatgtttgccttctaaaagagtcaagcacttttaaaaaaagcacctctgttctctttttggagctaaacaatacaaaaatatatgtgacacattggaacatggggggaaaaataaaaacacaaaatagcagaattatttacatgatggaaaacctagggataatctatgtacaaatatttatgtgtcagaaaattcatgaaccttttacctttctctgtgtcacatcttgcaaacacctctagacctttcttctgaagtatgtaaattatacattgaagttgggtgccagaaaacgtctatgcctatacttctgatgtgtttcaacttgtctttcctaatttaaaaaatcaaagccaggtatgctggtatgcgcctataatcccagccactcaggagctgagatgagaggatcccttgagtacaggggtttgaggccagcctaggcaacataacaagactctgtctcttataaaacaaaagtaacaaaaatcaaatttaataagtcatatgactgtagttggagttggcaatataccaaatggccttgatatatttctatttcatggggttggggttttgtaattgtaattttatgatacactataagtgatcaagtcctgtgttactctgttttttttttttctttttcttttttgacggtgtcttgctctgtcgcccaggctggagtgcagtggcacaatctcagttcactgcagcctccacctcctgggttcaagcaattctccttgcctcagcctcccaagtagctgggattacaggcaacacctacctcgcctggctaatttttgtattcttagtaaagacagagtttcaccatgttggccaagctggtcttgaactactgaattcaggtgatccacccgcctcagcctcccaaagtgctgggattacaggcacaagccaccgctaccagccactctgtttttgaaatcttgtttttggaatttatagttgtctgtatgccaagaaacataagagtggtggtacattgatgttagagtcacaaagaattccaaagaagtgtagccattccataataaagtcccaaatctgaacattataggtaaggagctagtgtaagtcagcctggtgtgaagatctgtgtaactaataaatgaccaaaaaagaaaatgtttacatgtagatggaaaaggtcaatgaactcctcagaccagaatctggtaagatgatgaagtgggggagtcagcatactcagactacagctactttacctctgataattaaagttattcataattgcattttggcaaaagaaagactagtgtgtttctaagccttgagatataattagctgaagaaaaatatttgcatttgatagactgaaatacttctaaattcatgtggtcattattgaaagaattatttttgtgtatattgacatagaaaaatcaataaaacataatgcatttttatcaagatcagtatcaagatcatattttcctaagactacccataaagctgctagaagacataataggcaatggctataggtatgtccaattgttgaattacctaaaaaaaaggaggctttgatggaatgactggtattggattagccttctgtattagtctattctcaccctgctataaatgactacttgagactgggtaatatatgaagaaaagaggtttaattggctcatggttccacaggctgtacaggaggcatggcagggagacctcaggaaacttacagttatggtagaagggcaaagaggaagcaaacacatcttcccatggcagcagaagagagagaattaagggggaagtgctaaacacatttaaacacatttaatgtgttaaaagtgttaaacacatttaatgtgttaaaagtgttaaacacatttaaacaactagatctcatgaaaactcactaccacaagaacggtgaggaggaaattcacctccatgatccagtcacctcccaccaggtccctctctcaacatttggaactacaattcaacatgagacttgggtgggggcacagagccaaagtgtatcattccatcactggcccctccaaaaactcatgtccttctcacatttcaaagcacaagcatgccttcctaacagttctccaaagtcgtaactcattccagccttaactcaaatgtccaagtccaaagtctcttctgagacagtgcaagtcccttctgtctatgaacttaaaaatttaaaaacatattaattacttccaagatataatggaggtacaggcatttggtaattactcccattccaaaagggagaaatcagccaaaagaaaggggctacagaccccatgcaagtttgaaatgcagcagggcagtcattaaatctttaagccttgaaataatcttcttttactccatgtctcacaacctggtgcaagggttgagctgtcatgaccttgggcagctccacccctgtggctctgcagggtacagcctccttggcttctttaatgggctgatgttgagtgttgcagcttttctaggtgcatggtgcaagctgtcagtggatgtaccattgtgaagtctggagaattggcacagttctcatacgtccgctaggcactgtcccagtgggagctctttgtgtgggttccaaccccacatttcccctgtgcactgccctagtagaggttctccatgaggcctctgcctgtgcagtagacttctgccttgacatccaagccttttaataaatcctctgaaatctaggcagaggctcccaaacttcaattcttgccttctgtgcacctgcatgcccaacatcacatggaagccaccaaggcttgtggcttgcaactactgaagcaacagcctgagctgcaccttggtctgtttagtcattgctggagctggagcagctgggatgtagggcatcatgctctgaggctacacacagcagcagggtcctgggcatgccctccaaaaagcattttttcctcctaggcctccaggcctgtgatgggagaggctgccacgaaggtctctgcaatgccctggagacattttctccattgtctcagctattaaaattcaactcttaattatgcaaatttctgccaccttgatttgcaacccagaaaatgagtttttcttttctaccacatgttcaggctgcaaattttccaaacttttatgctctgcttccttttaaaatataagctctagtttcaggtcatttctttgtttatgtgaatgagcataggcatttggaagcagctaggccacctcttgaacactttgctgcttagaaacttcttccaccagctaccctaaatcatctttctcaaattcaaagttccacagatctctagaggagggacacactgccatcagtctctttgctaaagcacagcaagagtgatctttacgctagttcccaataagtccctcatctccatctgagaccacctcagtctggacttcactgcccacatcactatcagcattttggtcataaccattcagtaagtctctaggaagttccaaactttccctcacctttctgtctttttttgagcccctcagattgtgccaacctttgcctgttacccagttccaaagttgcctccacattttcagttatttttatagcactgccagatgccttttgccaattttctgtattaattctcacactgcaataaagaattacccaagagtgggcaatttatgaagaaaggaggtttagttggcttacagttacatggactatacagtgggactgactggggaggcctcaggaaacttacaatcatggtggaaggctgaaggggaggcaagcatgtcttcacatggtggcagaatagagagaacaaaggaggaagtgctatacacttttaaacaaccagatcttatgataactcactatcatgagaacaacaagggggaaatctgcccccatgatccaatcaccaggtccctcccccaacattatgaattataatttgacatgagatatgggttggtggacacagagccaaaccatatcaccttcccttcaaaaaccactataacaatgggcacaatgtatgaaacaaacatattcaggcactggataaccagctgtacagctcaatctttgagttagagggaatcagattaggcgggtgccagacaactatgcagacaggtagaacccagaagatgaaccctggtttccaagcttagaattcagggctgctgaggtgaccaaatttgcagatcaggttgataaagatcagggaactaactacttggaggaagtacttcataaatcagcatggggtagttctcacatctttgaccaaatagagaagatgcataagtttagggcaaaatttagctcctagggagctgtgaattcaggggatacctagaggttgcatgatgctggtaggtataagagtttcaatgaatcagaacatggaaacctctttttggaatctatggggctcatgacactctaaatgaatcagtctttgggaaatagagctaatttatcactataacagtgtcatcaaagtgtgatctataaactccttgggatccccaagactctgctagagggtcagtaaggtcaaattttttaaataataatgttattattgtaataataatgtgtttgcattttttccactatgttaaaatttgcagcgatgttaccaaaacacagtgaataaactttctaatactttagcacaattcaaggcagtggcaacaaacgatgattgtagtcattttattcttcactgctcagaaactgcggtataaaataacagtttcacttcagaatgtccttgacaaagtagtaaaatgtattaattttattagcctcaactcatgagtatgcttttgaattatctgcataaagaaatcagaaggacgcataaaaacattctgctgcaaaatagagtaaaatggttgtctgaagggaaagcacttgtatgattgagctgaagacagaactggccacattttgtcacagaataacaatgttatatgaaataatgactgaaagaaagccatggttattcagaattgggcttttggagcatatattttcaataatgagtgaagtaaatctgtcacttcaagaaaacacttgacgggaaaaaaaaaaaaacgctgaaaggatggatgaataagtggtgatccatccgacaatgaagtactcattagctctaaaaagaaatgagctatccagctatgaagagacatggaggaaactgaaacccacattactaagtgaaagaagctaagctacatacatattatatgattccaactatatgacattctggaaaaggcaaaactatggagtcagtaacaagatcagtggttgccagggtctgaaggaaggaatggaaaggtggagcacagaggatttttagagaattgaaactattctttgtgatactataatggtgaagacatgtcattatacatttacccaaaacccatgaaatgtataccaagagtgaatattaatgtaaacaatagattttgtgtgattataatgtgtcaatatggcttcactgattatgataaatgtaccgctctagtggggatgtcgataataggggtgttgagatccatttgctgagtcagcaagtatatgagaaatctctgtacctgctactcaatattgatatgaatctaaagcagctttaaaaaataaacccagagaccaaatgtttgattaatggcaataatttttcagacttgataaagtagacaagttatagatctgagaagtccagtgaatgtccagagaaaaattacacattccacaaaggagaacaatgatatcaataatgactaagtggtcatcagaaacagtgaaggcttgatgataatagaacgacacatttaaagtgccaaaagaaaaaaaataccaaaccagagtctgcaaaattaactttcaaaattgaagaaggaacaaagagattttcagaaacaaaaaaaaaaaaacaataatagaaaattctttgccagcagacctttcactacaaaaactctaaaggcagagagaaaaggagagggtaaggaaagaaagagagagagaaagataaatacagccatgaaaacaacagcaaaaggctgagtgttggcaaatggaaatgcactattacccagttttaacattttacatgaattggtaaaatattgactctaagtagtctgcatgaatttttgggtatttcaaataattaataataaaaagcatgttctttccataaataattacctttctatttttactaagttttccagataaacagtcattagtccactaaaacacattaggggctttttcaaaaaagtgtaagagctcaaaatggcttcattgccagatgcctagagattagccttgtaaacactgaaaagtcccaacacaagagagattggtatttttgtctttacatctttacagttgttcacattcctgggcatggagtcacaaaataatagcattcaaattatttttagttaatatatatttattactgatgacagcttaaaaatatcctagaaaaaaaataaaatgtatttccttatgaaagagaggtccaatttattgacttctttaattttagttctttgatttttcaagctgtttattttgttttcctttaacctgtcctgttctcttttagaactggaatattttggcaagcctagtagatttgcgtgccttccctccatctcctcatagaaatattattatatataatatcaactatatatttacatacgtatatttagatgtgaaatatttggggaatcaaactcatcctgttgtataccatatgatgaaatagaatacaaatatgtgatgagaacattacttgagatcctgtgttccctaattgtttaaaattattagtattttgtgtgcattttgagttaccatttttctaaggacctagaaaatatttcatataaatcaataacaatatggttgagacttaggagaatactgtaaaatatctgatgtctaaatacttttaaatcccatagcaacataggttaatctgctcctctttagctttgttcctatttttacttagtttttttctctctcctcagaacatatgcaataatgaatactgataggaagaaatgaaatgtttattcacaagtaatacctcaggagaaattaaagttattttgaaaataatacctttaaaatacaggactgtttatcctttaattaattttattcattcaaaatttattgatcatctagtatatattcacctcaacacaaggcagtaggtttgctctcagagtacacaatcttatatagagtataaaaaagtacaagataatggactaattattatgtgaaaggaagtgcagattttatgaaaacagataggaagagtacctgagtttaatctttgcatcctgagactataattatgactataatttatattttaaataatattactaatcaaggtgtttgacccactgactcatgatatctaatatctgatataataattgtctctcatttatgcttttgaaagtcaggagaaaataaaatctgacattgggataaaaaacaagttgcaaatcatgccaacactgtattcatattcatgtcctcccactgacaaataaataatgttagccaaaggctttgcataaaaggaagtcaacaacattttgtgtgcagaatatttaatagcaaattttaatttgtttttttaaattgaataaaaaaagaaataaagtgtcagttttacatgaatcttgcctattcagtatcatcccctggtgcttaagttaatgaattttaataccaaagactttttggctgcttgaaggcctcaaaaatcctcttagtgttacggtgctaacactaaatcattgaatatatttcattatcaacaatgatgattcaagaacaaaattctaactgacagaaaataatgttaccttcttataaagagtacgaaagaagcatctgtgtcattcttttgaggttaacatctcaatttccacataacacattacattaaataaaataaacatcattgctcactcacatttctatttctcttttcaaatcacatggattttttgctacctgtcaaaaacatcaaaaagatgctcttacttaactaattttagtaatggtagtcaagttcaggacaaaaatttttatgatcagggagaaagttatgaggtctgatttcaagtgacagaaatagtagagctgaagcttaaaaaaatcaggaattaagatttgatgatgcaggttcctaggacatatacttggagaaacttggactgcagcaaagagaaggcaaattgtcctacctagaacatagtgtgtgtgaatgactgcatgacaaaaggaatggcatttattcaatgatggatctaaataaaataacatacaacaaattttgaactgaccatgttgtggtctttgcatgttgacattctcatgattaaatgagctgatgcctcttattttaaaattattctgggattattagagtctgatgaagtttcatctggtgcatcaccatgctatttcccatagttagattttgaaaataatttgttctttgattaaaaatagaataagtcattttcaacagctacctaggcttctctgtccctgagaccttgtagggtctatggaagtcgtgaaaatggtgacataagtagttttctaatgctgaagtgtcatgcacttcaagataatattctagaatttagatacaaattcaaagaaaataggtttccactatagcactttcttctttctcttcctttcctacatctgtcctctctaaaatatttcattgcaaatggcattcttgttaactatagaaggttctctaatgctgctgaatatcacgatacaaacactgaaaaaagttctagtttaaaacagatgatggtttattactcacaacaatagcagtactcagagaagtgtcgtttctacaagttccctgggccccaatacccccagggtgacataataagggccatgtgacaccttaacacactgtggtttctattactgagaggacatctaaatatcttataagcagtgtggtagacagaacaatggcctcacaaagacatccaacattaccaaacttgtgaatatcttacatgtcaaagagcaattaaggttgctaatcagctgaccttatgatatgttaaatttcatggattattggagtaggctcatagtaatcataagggtccttaaatgtgggaagggaggaagaatagtcagcttcagagtgatgtgatttgagaaagactctgccttctttgaagaaggaagggggacagcagggaatccaagctaaggaatggaggcagcctatgggagctagaaaagacaaggactaattctttcctagagcttccagaaggaaagcactgctatgatgtttgaactcctgcaatgctcacagaaactggaataggaatgataatgactctcatttctctgatgaagatgctcaggtttagagcagctggtaagtgaggcagaagattttgaacaactggtcttcctccagggcttattagtttaacaattaaaataatatttttgacgtttttgacttttttgtttgtttgattcttgaattgcaaggaaaaaatgtcccggaaactatcttttggaaggttttgaaagactttcttgtataagcattaaggaatatctcatagaactcaaagagcagaattgattccggcctcaggaataaacttgagccagaagcttgaatcatatctgaacacttgataagctttttttttttcaatttttcttcttaaaaggaaatgacatcttggtttctttgcccatgactataaaatttatatatatccaaattcaagagacaagctgaacaggtcaaacaaaaaacacattttatttttatgaccccccactaaattatcctccagaagttttcttcaattaatacttcaatcctcaaatttgggagtgctcaattctgcatatcctctgttagattatatgcttaaaatgtttgtacatttctatggctgcaaatgtattctatgcactcatgttttaaaattttgcagtttttttttttaatttcgtgggtaagactcacgtatttaaaggttttttttaaaattgatgttttaaaatgctgtgaatttcatgggtataaatgtgattagattattttgtacttcgccaaggttgacagttttttaaaatgttttcttcttttattgtatgattatatcatttgcctgtctttccatatttatccattttgttaacattatgaatacatgtagttcaataaatgtaaaactctaaatctacaactgccagattatttacccttagaaacagtaatggtcatctctaatctaatctacaagctttgttggatctaattatctaatatgtgataaattctcctcagcccttgattcttcctaaaacatcgtatcccacttcattccaactattcagttcccagttccctgaaagactgaccaggtgggatttcttaaaactcgatccctcctgtgcctgtccactgccaagtgtctttctcctgctattctttgcacataaatattctcgtgcatccttcacttatcagtgttcatcctattctgggtacaaacacaatttgtcacattctgatcccaagcattgatttagcttatctcactaaactgggtgagacctctcttgttttaacaattccaaacccaattgtcacactcagggaagaggctgagatgcctgagaaatccctttatttgtatggcatagtttgagtagctgtcctccactatcagactcactgccaaagctgctaagattgattattttatattctggggtaatgagtattctgagacagcagacacatatatccatccttcagagtaaattccaagtgctttatattcagtgaattttttatgatgttccccacctaaagttatttctccttcttctatatttcatagaaatttatatccctcattgtggcctttcactataatatgagtgatacctaccatctgctagggtctataactctccttgtccttttttaatctttgcattctccatatcagcctgcacaaagccttgctttgatgttaaagtataacaatttccaaattaagataaataaaattgttttaaaaagtatctttgagttatcaagggattttacttttcaaatcaaacatttccatactgtctaatgtttttacaatgagtaatactactttcataatcagaaagataaaaatatatatgggagttattaggtttatactctaggggtaacattatgaaatagctccaaaaatcattaaatctaattagagtaaattgtttcaattattagtctaatatgcttttattgtgcttcattttgaaaataaccataaagaggaaatggaaaaattttaattttttgtgcctactcccttaattaaattctatgtttacttattgtgaatatttcctttattcttttgtcatatattatatatggtgcacataaaatagtcaatgtaattttaatagtattactggtctttagaaaatactatctcagctctagctctacaaggtttaaaaattgtggttatattattaagtaaagatagtatttcacattttttccagttgtgtttctctcttacctttctagtccttgagaattcagtcttttttttttttctttttttgagacgaactcttgctctgttgcccaggctggagtgcaatggtgcgatctcagctcactgcaacctccacctcctgggttcaacaattctcctgcctcagcctcccaagtagctgagaatacaggtgtgtgccaccatgcccggctaatttttgtacttttagtagagatggggtttcgctatgctggccaggctggtcttgaactcctgatctcgtgatccacctacctcggcctcccaaagtgctgggattacaggcatgagccaccacgcctggccgagaattcaatcttttagctcacctacccagttaacctagttttctcatttttctcataagcactaattcgttgaaaaaagtcataggctgtattttctaacttacatctttcttgatcacttcttatttcctttcctatttttttgcttcactaacttaagaggaacctggtacacaatatcaaatgagcaacccacatctgcaataacaacaacatttcacacattctaaaattattaacatgtagttaatgctatgcttatagcatcaattggatgcttgtcaccctttataaataaaaattaatctttttgtaactagttttcattgaatataaaatgttatcaaagacataacattttttaagcctgtcactctcttcccttccccaacacgtttactgattttatgttcaaaaaaggagagaaggctttctgtcttggtcatccctttcctgtgcctatggagcacttgttgaaggaatgaagttttcagttctggtgatacagtagtaaacaaaacagaccaaaatgcttgccatcacagaccttaggttctagtagaaggagacagacaatagcaaaataaagaaatttcaacttaaatattgcattctcaatttggactttcataatcacctgaagtttcaacccttccttgtatgtgatatatattttcctgtaccctgattattctccatataactttatcaccttctgtatattttactatgtagttaaggtaataggagaaaaggatcactctagttgctttttctgagaaaatactgaggggtcaaggacaagatttgagtcagggagacctgtgaggaagctgttgcaataacagatgagagatgacaatggcttagtccagattagtggcaaaggaggtgtattagtttgttctcacgttgctacaaagaaatgcatgagactgcttaattataagaaaaaaaggttaattggctcacagttctgcagactgtaagggaagcacagtggggtctgcttctggggaggcctcaggaagcttcaaatcatggcagaaagcagagggggagcaggctcatcacacggagaaagcaggatcaagagagcaaagctggaagatgcatacacttttaaacagccatacctcaagagagcacactcactattgtgaagacagcatcaaggcggatggtgttaaaccattcatgagaaatccacccccatggtccaatcaactcccaccaggctctccccctagcataggggattacatctcaatatgagattttggcagggacatgcatccaaactatatcattctgcctctggcctctcccaaatctcatgtccttctcacatttctaaatacaattgtgccttcccagtaaccccccaattcttcacctgttccagcattaactcaaattccaaagtctcatctgagtaaagctaatctcttccacctatgagcctgtaaaataaaacacaaattggttacttccaagatacaatgagggcatagacattggataaatactcccattccaaaaaggagaaattggccaaaaaagagagactgtaggccccatgcaagtccaaaacaccgcaggttagtcattaaaccttaaagcttcaaaataatctcctttgattccatgtccaacatccaatgcacactgatgccagaagtgggctcccaagggcttagtcacagcttatagtaagtgatgcatacacaagatattttgaagaaagagccaccacttctgccttagactgtgaaaataaagaggagtcaaagatggctccaggagttttgcttgagcaactagaatgatggagttgcaaataagtgagatggagaagaatgaaggagagacccatttagggaatgaggaagtcaggagttcaggctgatgtattattactaaagggaagtgtactttgagagagtgaagagtcagtgttgcaggaaaataatgcatgagttcagggcccacttgaatttactagttattagtttaaagtgagacaaaatattcacatcatgtgggggatttgtttttgcatttattattctctcttttgacataggatgtggctctgtcacccatgcgggagtgcagtgctgatcttggctcactgccacttctgcctcctaggctcaagtgatcctcccacctcagcctcccagtagctgggactacaggcacctgccaccttgcctagctaactttttgtatttttcgtagagacagagtttcaccatgttggccaggctggtctcgaaatcctggactcaagggatctgcttgtctctgcctccccagttgttcagattacaggtgtaagccaccatgcctggccgtgttttcttttaaacatgtacaactgcaagagtgcaagggaagagttgggatgctgctcactgtgtatgatgaagtaagcgagaggcaaggaggatgagaatgtttgcaggagagtgagtttagtaataacttatggattctaaactgggtaagttgagaagggttctcaacttagcatggtgagggagactgagaagattctggtgaagtggaagaattgagggcgttgggtatgagagggagtgggcttagatgtgagaatatggagattctacagtttttggtaatacggtactctccccttacctatggttctgctttctgtggtttcagttacccattttcaactgcattccaaaaatattaaatggaaaatttcagaaataaacaatttataagtgttaactggcttgctgctctgggtagtgtgatgaagtctcataccttcttgctctgtgaatgctccctttgtccagagttcttgcactgtatgtgctacttacccatttgtcaattagtagctggtttggttattggatctactgctgaggtattacagtgggtgtgttcaagtaacccttattttacttcatagtggccccaaagtgcaagcacagtgttgctggcatattgctataattgctccattttaattattgttgtttatctcttactgtgcctaactcatacatcaaattttatcacatatatggatctataggaaaagaattgtgtgtgtgtgtgtgtgtatgtgtgtggtttaatattattcatggtttcaggcatctactggggggcttggcacataaccctcaaaataatgagggactaatgtaacctgaactaatgtataaccatagaagtgagtggctgaatttgggtggaggaaaagatcatggttatcaaaagtaatgaaagtatcttctatatggatactgaactcaccaagaactgttggagttagtgacaatgtaccaggaacaaaagccattgaagaataatgacagtatggggtctatagaggactgtaaagaggaaggatggtgaaatttgatgatgtgagattcaaaaatgaacgctttccaggaaaagtgacagaagagagatagggacatctatcctgctcctcagctcatgatgtgagtcacctaagagggaaaaataaaagtcattgcttgaaagggctgaagaaacaatgtatcaagggacatacaagttggattagagcaagaaagaaataaatatagttataaattatatatttgtaaaagaaaactttattaataatttatatttctctatatattataatttatattataattaaatttaatataattaaattatattaaatttaatctaatttgattatattaaatttaatataatttaattatattaaatttaataatataatataatttaataatattaaatttaataatataatataatttaataatataactaatttaataatataatataattaaatataatataatatttatattataatttgtatttctatattttaggaaatattcaaaactatgctgatgagctactgacatgtgctgaaatgcatagagccctgtttaatctgtggtagttacggactttgagtgcctataggaatggcaaattagtaatatagcagtcagctcaagggagtgagtgagaatacttgattaaaataaatatatgtattatgacaatacaatattctttaaaaatatattgatatattttcctagacatagaaactcatacatttttctgtttaacccagaaatattaacaaaggcttttgtatgtttgtagactatttaattaaaaaatgatttgtgtgaatcatgaatttacataacagtgatctcacttaatagtttcctggattcaaaaaaataaccttgaaccaagagttaacattagaaaggatttctgtgaacatataatagatactgtaagtttttgctgtgaattagtagaagagtcaacaatgatgagtctcagaaagttatgctatgtgaaagaagacagctccaaaagaccacatgttgaatgacgtaattgacatgggatattcaggaagggcatatctacagagatagaaagtagatgattggctgcctggacctgcgggtgggggatggagtttcatgccaataggcactaagaatcatttgtgataacagagaaattggattgaatttggattgtggtggaagtttatttaaaaccattgacttgtagagttaaaaatggataccttttaaggtgggtatattatgcttcagtagaaacacagaccaatggactagaatagagagcccagaaataaattcacacatatacagccaactgatttttgacaatggtgccaagaacacacaatgggaaaaggacagttgcttcattaaatggtgttgggaaaactggatatccacatgcagaataataaaattagatgctcatctctcaatatatacaaaaataaacttaaatgggataaagactgaaatgtaagaccagaaactatgaaactactagaaaaaaaatcataggggaaaacttccataatgttgctataggcaagaattgttttgaataagacctcaaaagcatgggcaacaaagcaagaatagacagatgggatgatatcaaactataagcttctgtacagcaaggaaacaattaacagactgaatagacagcccacaaaatgggagaatatatttgcaaactatataactgataaggggttaacatacaaaaatgttatttttgcaccaacctattataaaaggaactcagataactcaatagaaaacaacctgatttaaaaatgggcaatatacttgaatagatatttctttttttttattatactttaagttttagggtacatgtgcacaatgtgcaggttagttacatatgtatacatgtgccatgctagtgcactgcacccactaactcgtcatctagcattagatatatctcccaatgctatccctcccctccccagcaccccacaacagtccccagagtgtgatgttccccttcctgtgtccctgtgttctcattgttcaattcccacctgtgagtgagaatatgcggtgtttggttttttgttcttacgatagtttactgagaatgatgatttccaatttcatccatgtccctacaaaggacatgaactcatcattttttgtggctgcatagtattccatggtgtatatgtgccacatttccttaatccagtctatcattgttggacatttgggttggttccaagtctttcatattgtgaatagtgccacaataaacatacatgtgcatgtgtcttcatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgggttttctggctgcataaatgtcttcttttgagaagtatctgttcatgtccttcgcccactttttgatggggttgtttgtttttttcttgtaaatttgtttgagttcattgtagattctggatattagccctttgtcagaagagtaggttgcgaaaattttctcccattttgtaggttgcctgttcactctgatggtagtttcttttgctgtgcagaagctctttagtttaattagatcccatttgtcaattttggcttttgttgccattgcttttggttttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagccttctacatatggctagccagtttacccagcaccatttattaaatagggaatcctttccccattgcttgtttttctcaggtttgtcaaagatcagatagttgtagatatgtggcgtcatttctgagggctctgttctgttccattaatctatatctctgttttggtaccagtaccatgctgttttggttactgtagccttgtagtatcgtttgaagtcaggtagtgtgatgcctccagctttgttcttttgacttaggattgccttgacgatgcgggctcttttttggttccatatgaactttaaagtagttttttccaattctgtgaagaaagccatttgtagcttgatggggatggcattgaatctataaattaccttaggcagtatggccattttcacgatattgattcttcctacccatgagcatggaatgttcttccattcgtttgtatcctcttttatttccttgagcagtggtttgtagttctccttgaagaggtccttcacgtcccttgtaaggtggattcctaggtattttattcactttgaagcaattgtgaatgggagttcactcacgatttggctctctgtttgtctgttattggtgtataagaatgcttgtgatttttgtacattgattttgtatcctgagactttgctgaagttgcttatcagcttaaggagattttgggctgagacaatggggatttctagatacacaatcatgtcgtctgcaaacagggacaatttgactacctcttttcctaattgaataccctttatttccttctcctgcctaattgccctggccagaatctccaacactatgttgaataggagtggtgagagaaggcatccctgtcttgtgccagttttcaaagggaatgcttccagtttttgcccattcagtatgatattggctgtgggtttgtcatagatagctcttattattttgagatatgtcccatcaatacctaattttttgagagtttttagcatcaagtgttgttgaattttgtcaaaggccttttctgcatctattgagataatcatgtggtttttgtctttggttctgtttatatgctggattacatttattgatttgtgtatattgaacccgccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctctttgtacctctggtagaattcggctgtgaatccatctgatcctggactcttttttgttggtaagctattgattcttgcctcaatttcagctcctgttattggtctattcagagattcaacttcttcctggtttagtcttgggagagtgtatgtgtcgaggaatttatccatttcttctagattttctagtttttttgcgtagaggtgtttgtagtaatctctgatggtagtttgtatttctgtgggattggtggtgatatcccctttatcattttttattgcatctatttgattcttctctctttttttattagtcttgctagcagtctatcaattttgttgatcctttcaaaaaaccagctcctggattcattaattttctgaagggttttttgtgtctctatttccttcagttctgctctgattttagttatttcttgtcttctgctagcttttgaatgtgtttgctcttgcttttctagttcttttaattgtgatgttagggtgtcaattttggatccttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggaacaggttgttcagtttccatgtagttgagcggttttgagtgagattcttaattctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctttagatgtctattaggtcctcttggtgcagagctgagttcaattcctgggtattcttgttaactttctgtctcattgatctgtctaatgttgacagcggggtgttaaagtctcccattattaatgtgtgggagtctaagtctctttgtaggtcactcaggacttgctttatgaatctggtgctcctgtattgggtgcatatgtatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctgcattcttttattttgagcctatgtgtgtctctgcacatgagatgggtttcctgaatacagcacactgatgggtcttgactctttatccaatttgccagtctgtgtcttttaattggagcatttagtccatttacatttaaaattaatattgttatgtgtgaatttgatcctgtcattatgaagttagctggttattttgctcgttagttgatgcagtttcttcctagtctcgatggtctttacattttggcatgattttgcagtggctggtaccgattgttcctttgcatgtttagtgcttccttcaggagctcttttagggcaggcctggtggtgacaaaattgctcagcatttgcttgtctgtaaagtattttatttctccttcacttttgaagcttagtttggctggatatgaaattctgggttgaaaattcttttctttaagaatgctgaatattggcccccactctcttctggcttgtagtgggcagactgacacttcacacagccgggtactcctctgagacgaaacttccagaggaacgatcagacagcagcatttgcagttcatgaaaaaccgctgttctgcaaacaccgctgtggatacccaggcaaacagggtctggagtggacctctaggaaactccaacagacgtgcagctaagggtcctgtctgttagaaggaaaactaacgaacagaaaggacatccacactaaaaacccatctgtacatcaccatcatcaaagaccaaaagtagataaaaccacaaagatggggaaaaaacagagcagaaaaactggaaactctaaaaagcagagcacctctcctcctccaaaggaacgcagttcctcaccagcaatggaacaaagctggatggagaatgactttgacgagttgagagaagaaggcttcagacgatcaaactacaagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacgtgtagaatgcagaagcctcaggagcggatgcgatcaactggaagaaagggtatcagcgatggaagatgaaatgaatgaaatgaagtgagaagggaagtttagagaaaaaagaataaaaagaaacgaacaaagcctccaagaaatatgggactatctgaaaagaccaaatctacgtctgattggtgtacgtgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagtggatctctcagcagaaactctacaagttgaatagatatttcttaaaagaagacatattaatggccaacagatatatgaaaaaaatgcccaacatactaatcatcaggaaatacaaatcaaaaccacaatgagatatcatctttttacagttataatggctgttgtctaatagtcagaagataaaaaaaaatgttggtgaggaagtgaagaaaagggatctctaacacactgttggtaggaatacaaattagtactcccattatggaaaaatagtgtggagattcctcaaaaaaatataaaacttgaattaccatatgatccagcaatcttactactgggttatatattcaaaagaaatgcaatcagtaaataaaagtaatgtctgcactcccatgtttattgcactactattcacaatagccaagatatggaatcaatctaggtgttcatcaacagataaatgggtaaagaaaatgtggtatatatgcacaatggaatactattcgaccattaaaaacgtcctgtcatttgcaataacagggatgaaactggaggacattatgttaagtgaaataagccaggcacagaaagacaaatagcacatgttctcactcatatgtgaacttttaaaaagttgagcccataggagagtagaatataggttactaaaggctggggaaagtggtaagaaggaaggaatggggagaggttagagaataggtacaaagttacagttagttgggagaaataagttctggtgttgtaatacccagtaggctgactacagttaacaataatgtatatttcaaaaagctagaagaaattgatttgaatgttctcaccacgaaaacaaaaaaccaataaatatgtgaggagctggacatgctaattacccttatttgatcattaaacaatatatacatttatcaaaacatcccactgtacctcatgaatccgtgcaattatgacgtgtcaatttaaaataaaatttgtaaaagaaataaaagaagtaacacagagaatgttttagtacaatctttaagcaacaaaactgggatcaaaaatttaatgagtgctggtgagttttatcaggaaaaactgttacgtttttcttttttttaaattgccaatgatactgtaattggaatagcaacatattacattcttagatccaataatctcatttgtgagaatgtttccttaggaaaattattttcaaaggtggcaaaagttacatgcaaaactttgctactattgggaaaaatgctttagtaaacaaagttctgcacagcgttataatgaatgaacattcaggaaatcatgcagtatttgtgctatggaatttttagaaaatgataacgctctaaaagtttagaaaatctgtgtgcagtattagaaaaggtgatacactcagtatgttaaactataaatatatattcattggccccaaaattcaaaagttagaacaaagcatggggctgttggttgactatataattgcaatataatttctatgtaagagataatgcaaagtaataggagatgaaaaaattgtgacttgttatttcagaagcacaaataagttaattttatatggtaaaataatgggtacttctaatttcttaaaaaaaaatagtgcctaaaatttggtcgttatgggagggtatcaggtaaaatgctcagtggtattttaggatacattttaagtaaacctggtatagttaacttagagatgacaaattgacaaaattattgtccatcttaaatcaaaatattttagggtttttcattggtgatgttgattgttttgtactgaacaccttcatttatccattcgacaattatggtattgttcatctacgatgtgccagatactgttataggtgctatctgtgagaaaacggaactagacaccattcctgcccatgctgtacttacattatagtgtaaagagaaaaactaaaagcactaacaagtattcacaaagtaactaggatattttttaaaggaccaagtgctatacaaaatgtagagtaggggaagagggatccgacatgccaaagagacagggcagggccagaatgcagtgctgacgaggatgatggtcagggaaagcttcattgtgaaggtgatagttaagccaagatttgaagtactgaagaagctaatcgattggctgtctgggaaagagtattttgggcagaaagaaaagctagagcaaaggacttggcggcacaggttagcaggaatatgctagcatgctcatggaacagcaagaaggccaacgcgcaggagcaggctgagcctgggagcagactgagcctggggtatgaattagatgtgctctgaaaaataagagtctgattatgtaagacattgtatacttttgtaaggccgttggcttttactctgaaaggaaaggggagccattgcagggtcttaaacaaaggagtatatggcctgagttatgttttgagacaattactctggcaactgtatcaagaacatattgtaagatgtgggggtttggagagtaagttattactctccaaactgggacatttttatgagcaaaacagagataaccaaatgaattaagaatgtcccagataaacagggcctatggttatcgtagttattcatggtcctaaccaataaataataaatatatatttttacaaaatgcaagaagttttgcagagtggttagggcagacacctcattgaaatgggtttaagagagaataggaggttcttcctcttttactacttctgaacaattaatccctgaaggctttaagtggagcagagtatgggaggttttcacctcaggtggagaaggtgtgaaggctcggaacgaagtatcaattcccatgtagggtaaggagggaaaactacacctgtgtgatcctgtgggaggttttggagcctgaacagtagaagcaggatgtgtttacccaggaactcctactatgagatgtcaactatgcccattgagtgatggtcttgtgcagaggatcagagcccaactagggatgccatctaagcatgagatattagtggtcaattggagtgaggagggtacctgcacaggacacagattgattaggagagggtgagaaaataagtggtgatggctatatgttgatgggtggcaggaacaagaaggaaatcagtgtgaagctgtaggcagaatctatatgggaaactgattacgtcaagggaatctgtctaacagataacatatgaaagaaaatccgagcctggtttcttgttttagaacagagttacaaatatgaaagggaggaagtcataataaatcttgaagtgttatattagaatcatcatgatttataattttgaaaacctatagttataaaaatgaatatagatgcaaatataggtatttatatgtatatatggatgtacataaatgaatgtatttcctatatctatttactgagggtgccagggagtcattacatcctaattgtaatgagtatacctggttcataggtcttggtttctaaatatcatcctccaccaaaaaaggccaaggcttcttgcagtaatggttgaatctaaactgaaacaaagttaacaacatgagccaataacatcttattgttccagaaagcaaagaagtgctcaaagattgatagtggtatatcaaaagaacacagaagtcagcgtgaagggtctgcaacaagacatgtggaagaattcaagcaccataataatgatggtatcaaattataacccactgaatacaattggaaatcatatcagtaatataaataaatgagtgaataaaatgaaaatttgatgagaaatgggatatttacatagtcttaaagtacttccaccacaaatacttttgaaccacagagggaaatgaataactttagagtgaagaatactggaagataccaccataatctagtgatagaagttactgtcactctgaaaggaaaaaataaattatgagccacataagaagatgtgacaaaaataatatgtaatttctgtgatactcctgccaaagttgcagaacctcaatctaatctttaaggaacatcagataaacccaaactgagaaacattctacaatgtaattgatctataatgtttaaaggaataaaagttatgaaatccacccctccctcaagaaaaaaagaacactgaagaactgtaactgtttcaggctaaaggggtcattaaaaaaagtgtcaactatatacaaaaagtatgattctaaattacattcatttactaaaaaggacattatcgggacaatgagcagaactcaaatgagggttagatgggagtgatgtatcaatcttatgtcctcattcatatggttgcattgttgttatggaggagatatgtcgttgtaagaaatacagacatattgggggaatgatagaatatcatgtcagcaacggatactcatatatctatacaatcccctccctttgaggttaaaaaaaaagagacacttctctgttttgaagaatgttttttgtaattcttaacattttttaattttttcaaaaaaaattttttttgagacagtcttgctctgtcacccaggctggagtgaagtggcgcaaacccgtctcactgtaaccttcgcctcccgggttcaagtgattctcctgcctcagcctcctgagtagctgggactacaggcatgggccactatgctcggctaatttttgtattattagcagagatggggttttgccattgttggccacgcttgtcttgaactcctgacctcaagtgatctgcccaccttggcctcccaaagtgctgggattacaggcaggagccactgtgcgtggcctatttttttaattaacataaaatttcatatatttatcatgtatcatataatgttttaaagtatgtatacatgtggaagagttacatctaactaaaggaagtggagtttacatgaaaagcatacgaccactttagtacttgtcatagcaagccacaataaataagaatatactttgaagtaataccctgaaacatttcaaaatgatatctcatgtaagcaaaatagaaatacattatgtacttttcagttttccttaaacatttttcccctccaattcattatattttcactgaactgtaaaaaattgaacaactacttgaggtttttagcctgacatttctgtgttttcatgatgtgtcttctttttgtcaaattttaatgtaaactttcactaaataatgtgattaagttccaaaacattctgactttttactattatgtctcttttttatattaagtattatatctctttttaacttactttatgcctgcagaagatatgcatggctcaatgtgttttctcactgcctggggactcccaaagaaatgcctatgaccagtagctatgagtggccggaaatcaatgttttcctataggtggacattaaacagatatctgtactccaaacaccttggaatttgtttagaaactttacagaagcaattatcactttatcatttttaaaaattctcagcactagaatttgaagtgtgctataaaatgttttttaattggtgtgttcttgcacatgttaatgtaatgcccttgaagagcaagctgtcaagaaaaccaaatagaaattattgaacattttgttaaaatgacacaaaaactatttacatggaatgcaatgttttcttctttcctggtatggaagaaaaaaagacagaatatatgcacacattttctcccaaactaactaatataaacagcttccacatgtcaaagttttacataatgatgattctaaaatgacttaaaattgcaacaagtcactttcattaagccatgaatattgaatagtaattattgcttaatagactttttataagacactatttacagtacagctgctaagttgttataaattcttcttgaatgtatcatgcaaatatcaacacctgtgatactttctaagtgttatgccaaattctatagggtattcttagtctaatcttttctaccccattgcttttgagtttttggcttatttacattcttctttgcatttcacctcaagagaatagtatccatttattgaaatatatatagtgttctatgaaaattggaggttgttttgagggaaaggatttctcagtatttccagagttcatgtcgcctttgctttaacttttgtgttttttttttaacttttgtttttttttttttttaagtggaggccaaggcaggtagatcacaaggtcaggagatcgagaccatcctggccatcacgatgaaaccccgtctctactaaaaatacaaaaattagctgggtatggtgttgcgctcctgtagtcccagctacttgggaggctgaggctggaaaatcacttgaacccaggaggcagaggtttcagtgagccaatattgtgctactgcactccagcctagtgacagagcaagactccatctaaaaaataaaaaaaattaaaaaatcaagaaatggaaatggaaacaccgagtgacctatactcaaatagtgcatttattaaccacattttaatgtctagttatattttgttagaaagtctaagggagatacagtaacatttaagtgtttataaagttatgtattaaaatatcaaatggcattataacagttttttttatttctgtataacaaattactggaaaacttagtggcttaaaacagcaaatactcatctcagtttctatgagtcagatgtctgagtgcagcttagctgggtgcctttggcttaaggtctctcatgaagttgtcttcaagctttggctaggctggagtcatttcaagactgcctggggctgaatgattcacatccaggctcatcacacggttccctaaaggctcggttcttactatgccccgggaactcactacaggactactcacaccgtggcagcttgctcctcagtgcgagtaattcaagagagagcaagagaaagtgagaacccactgagggcaaccacagtcttcttgtaacctaatcacagacatttcaacacgattgtcttctgtatattagaaggaagtcagtgagtttagctcacactcaaggggaaggatcacacaaaggtgtgaaccagaggcaaggatcactgaggaccatcttagaggccaactacccacagatattaaaatgttaaaaggacaacactgtattacaaaaaaacacaaaatcccctcttggtagatattttagctttcagactgtagctggaaggaataatactgcaattgataaaaaaggaaacagttacaagacatatgagataaactctcttctaatggttctgtgtttcatcccggagttaataaccaagatgtctttcttaaattcacttttgctaatcccaaggacaaaatcatgacggaaaaggatccatttttttctgtttctcttgtccacagattctaagtttactttcttatggttttaaattcccatagaaattgaccagcttttttctacattcttgggaggcataaattgattggcctagcttctggctgacagccctcctgaatctgttttaactgtgaccaaacgtgactgtgctgatggctaatgtgacaccttggttcttgacttcttgctttaaaagaatttaaacaagagatgcacagcaaaagaagtgcagcatagagtaatttactgcaaaagaaaaataatatttggaaaattaggtgcagaatagacagttcatcctgaaagggagggaattcaggatgggctgctcataaggatgagacagcaaagatcagcactcgggaaacttccttaacagggtcttacgttcttcataaggaggtgggaagaggagttaccagtaagcactagttgcttactagtagtagcaactagtgcttacttgctaataactcctcttcccacctccttatgaagaatgtaagactcctgtaaaggaagtctcccaagtgctgatctttgctgtcttaggttctgggtgcacatacacagtagctgtacaagcttgttcatatttcacatatctcattagcatcttaaatctcttcctaggggttttttattattacaatgagcaaagggtcagtttgaggacaggtaaaatcaaaatgcacatgctgtctagaagagaaagtctctaccgaagatagctttgcttgaatgaactgaattacagtgcaaatgctgaggcctattgtgttgattgtacggtcaccatggttgctgcctcccaagaacatggtcacttccttgactccctatcctgcctcagatgcagcatccacatctgtttgtatagaatggtcagtttctctgtcgcggacttcggtagggaggctgtagtggctgaaactcaggccaaatcaccttgtagttttgagagaagagaggatgttgtaatctaggctcatactcaaaaggtaatttctagatattattatatcatcatagtcagaaggataactgaatcaccagaacaaatatttcttctctcttgaaaatcattcctagattgttttagcaatagtagaaaagatgtcattgaccagtctgactgctcaccatgcgtgacttatacacttggtcattgcatgttcatgtccattttccccatgtattttattaatcccattttaaatatctttcctttagtaatgcagaaaatgttatttttttgaatcattaaatcaagttatctgtttattgccaaataaaacctggaaaaaagtaactcaactaaagaatttttgccttatgtgtttctagtttctcttaattttatatttctagtaccaatggccttaaacaagataaataaattcaattatgtttaccaattttgttggaaatatatttgttggaacagcttttcctctattaaacaaaaagataatgtgatttattatttacagtgttatgatcaagactctggtttcgaactattttagcaagaccgaggtgactagataagatcaatttagaaaccagttagcagttaatgagctcctactatgtattatatgtgctacagcctcttcctcccagcccagtaacaaacatagacacattttatttgccaaataacttctcttcctgcagatcccaactcaggtatcatttcctgcatagaactatggatttccttccttgtactttggtagtcacaattttacatctatttggtcttctttaaaattcacaattcttcccaccctactgttatcttcataagaagaaagttcttatgatatctgtttttattgctttgttcttattattttatttatgctgaactcttttatccccatcatcttgtatagcttattttgcagaataaataataagtaaatatgtatggaaagaataaatgaaaaaaaagaatgaatccaagttatgggtatgatattaactcttaactgcattctccaagtaagtttttgcaatctattttcattcccatcaattccatcacctagtttttaattatattacattactaaaatccatcctttctttctgagggtcactttggaaaaagaaagaatctatgttctaccaaatactagcttctagtagggcaagcatgccatttaactgtatagagcctctatctttactttgtaaacatggattataatacgtacaaacatataaacatgtttcatacatttcataggatttaaagagaatctgtgtgtgtgtgtgtgtgtgtgtgtggtgtgtgtatgtgtgtctttatatatctaatcagacaaacagtagattctcaaaaaaggttggtgttcttattcataaccactgatatatttgtctttgcacattagcacctcttttttggaactcttttcttctttaacatctgtggtatcacactatatgattactatatatgtatagtatgattattcttttatttaactagagtgtgactggtagtatgttatgttgtatttatttactgactaaatgttgattatgttttttctattctcttcatttccttctctttttttcctgtctcctgtgtgtgcatgaaataatatttttattcttttctcccccattctttttcttagagatttcatttgtatctataaattaaaataatggcttcacatttttatcatgaattctaaaactttgtacttatgtgcttttctgagtttgttataagtttgcaattacctactaaacattttttttaccagattgatcaccagcatctgaaattcaaaatgtctttaactcaagtaattatgaatgtatacttcctgtattcatattcattttctagaaatataattttacatttcccaaatcaaaacttcagaggaaactcattcttgcacataatcaatggcaaaattacatcaatttctcttcccaagcggtttttacacctgctccttccatagtttttctctgccttccacttttgtatttgtattaatttatagcttagcaatcctttaactacttgagaggattccctctgtcattcttcagatgacactgcattaatttttcaaaatcacttctagtcatctgttaaaaaagttctgcttaaaaatacaaactcatggctgggcacggtggctcatgactgtaatcccagcactttgggaggctgaggcgggcagatagggtggataggccgaggtggtcaggagattgagagctttctggctaacacggtgaaaccctgtctctagtaaaaatattaaaaaaaaaaaaaaaagagattagccgggcgtggtggcgggtgcctgtagtcccagctactcgggaggctgaggcaggagaatggcgtgaacccgggaggcggagctttcagtgagccgagatcgccccactgcactctaactctagcctgggcgacagagtgacactccgtctcaaaaaaaaaaaagaaaaaaaaatagaaaaaagaaaaaatatatataatctcacattactttagggataagcttgaaacatctttacctaataatcaaaactccaattatctctccagctgtatttcttacaactttttggcttgaagaaatttctcttttagctcaactggaacaactacaattactgaaaatggttttcactggaaataccatatatatagtaatatataatatatattatataacatataaatatatgcttctagaaatgtatgtgctagaaataatcagacaagaactcatagatgtatggaaaaggagtgtttatcacaacattgttttaataatcataaattataattatatataacatataatatatacgtgtgtgtgtatatatatgtatatgtatatatacaccttacacatcattcatagccttgatcaaatgctacattttctaagattctccatggtaatcctgggaaaaattactttcctgatttttaaaatttccagaaatgtattacatttattttctagtcacgacttgatgcttattgaagttatggtttctgctgcattaaacacttgtgcctctcaagtgcttatttttggtatctaccaaaaatctaccttttgttgtgaccaggacaaatacttgggttgtaaagcaaatctcaactatttattcacactatgttcttacacatagtgaaattcagctaaaatcaatcaattaaaaaataaataaataagttctcaatgtgtgaatatcaaggaatattcttgtaaataacccattatcaaagaaaaagttacaattaaggttagaaaatatttcaaactgaatgaaaataagattatcaaacatgaaaatatgaagacatttggaatatagataaattcgtgttagtgagaatcatataaccttaaatttggtatgttagaaaatttttagaaagttgagaattatcattttaagtatttaactcaagacagtagaataagaatcagtcattaaaactaaaagtagaaataaggaaataagaaatgtaagataaatcattaatcaaatagaaatcaaatacgtagtagagaaattcagctcacctaaagctggttttagggggaattactaataaaaaagatttatccctgtaaagaaaaatagacaaatctcctatcaaatatgggaaaagctgtgccactggataactagagatcctacagacattaaaaaaatcctaagggctaattaccaaccactttgctgtaatagatttggtacttttggttaaatgtacaaacttctagaaaaatttatcttatctcattcaaaacagaaatctctagacataagtgttttcctcattaattattttaaatatttaatgatgaaaaacaaatattgtatacatacttctaattaataggattttaacttttaaaaattaattgtgattaattaaattaaaatcagacaagaactttttaaaaagtatatgttaatattgcttatgaatacatatgtaaattcttttttaaaattagcatagtcaagcctatgtaaaatgataatgcatcacagctcagtattgcgtattctaagaaaataagccagtttggtttgaaatccaaaaactagtcaatgtaattaatacaataaaagaaataaaacttataatcttctcattagatgcagatatttattaaatttcaatacccctcaatactaattcatgattaaatgtcttatgaaaccaaaaatggaaggaaaaatctgaactttccaaacctgaccttctcatacaaattcaattaattctagctcaatccttttagtaattcatcatgatcattttttattatataccacatctaacctttaggcaaatgttgttatctctatcttcaaaatatattagaatgcagccacttctcatcacctccactgctatcacttttgtttagaccaccgtcatgtcttgcctgtgttaatggaattacttcctaactatgtggctttttgtgtcatccttgttttattgtacttttgtttcagtctacacagctgagagtgatcctttaaaactcctcatattaacccttatgctcaaactctataacgattcttcttatcactcagggtaaaaaccaaaatggtttttacatttacagtggttaacatgactttgtcaagagctgtggaagttttgaaattttaccctacttgcaagctaaaagttagcctgttattgtttcatgaacactggcagaaagcatgagattcctggctttgttaaactagaactttattaaagcaaaagctgtaaccagagcttcatgtttgtgttggttccccatgtcccaaagttccatgggcacagtactcatgctgaaatggctaccatttcgcccgttggactgcaattgagaagaacatcgagcttggagttttgccacttttattgtaagtgggagcaagcctgccctttgctgagggagatattatctcaaactcatggttgttggatggaaattcaaccccaggaaacagttgggataaggaacagtcagggcctgttcttggcataccccaagggaaagtacaggtggccaagccccatggtggattgactccctccacagccccgtaagtctgagcttccattacatttctgaccttttcttctactatttatactccttgcttatctgaggttatgctgcccacttgctatccctctaacaggtcaagccgacttttttgcttctcagagtgactttactcacagtttcctctaattggaattttcatagattcttccttcacctccttcagttttttttttcttttctcaaatgttaacatttcagcttttagctttctatataaaagtgcaacacaaccacttttgcttctttgtttgtcttcaaagtacttattaccatttaaactgcctttctggaaggcagtgaaatggagcaggaagcatttcatctttgatttgaaaatttgcttctagaaatgtatgtgctagaaataatcagaccagatctcatagacgtatggaaaaggagtgtttatcacaacattgttttaataatcataaattattattataaataaacatatatagagatcacatagattattataagtaaacacatatatagatcatttctaaatacatatatgtaccaaacaactggcacggggtatctttgggtggtgatattaagtgtgacttttcttttctttcattttttttttgagacggagtctcgctctgtcgcccaggctgaagcgcagtggcgcgatctcggctcactgcaagctcctcctcccgggttctcgccattctgctgcctcagcctcccgagtagcttggactacaggtgccccccaccacacctgacgaatttttttttttttttgtatttttagtaaagagggggtttcaccgtgttagccaggatggttccatctcctgacctggtgatccaccagtctcggcctcccaaagtgctgggattacaggtgtgagccactgcgcccggccgtgacttttattttcttatgtatgtggtttcataatttcttgctattccctactattttgaactcatttttctccattgttttctttgtattttgttatatggctcatatttttcctcctcttttcatgcattattaagaattatgaagagtttgagattttaccctacctgtaatctaacaaatctgcctgttttcattctatggatgcttgtaaaacactcctgggtcacagatagaggacctgattacctgtgaaacagaaggcaacatggaacatcagcatatttattcactcctcttgttcctagtcccatggggcaacatggctggacccagccagatacctgcacacaccatggatttcattgcaggagaaagatcctgaacttagataaccaagaattttataatggtagtaagcctccctctgttttactctagagggaaacattatatttattataaaggacagtgaaaaattatgccctttctctcagaggaaagccttatctctatgttctaagtctctttgcaaatttactcttcctcgaaaagattttctagcagagcagttggtgccttgctataagatgagcagacatggaagattcacatgaattgtctcctaacattaataatacatgttaaataataataataatgataaatttcctatttggaaagagaattgagatttcctgtgagagagaggtgagggaaaaacataactttctgaaaggaatttaaccattcagggagggattccctgtggaaccagcacttgagctgagattatggctgggcatccagagccagaaaagcagagtgaggggagaggtggggaagtcaggcaatgccatagctcccaagtaaggtgaaggccttctttgtttatgtaaatatcaaaaggaagccgttaaaagtttaattatagttttttggttatttggttatttcattttatcattttttagcaagagagtggcaaaattagattatcatttgaaaaagctcttctaattttggcatacagagagtcaaaagggattcagagagctcctttaatgttatttgtagtatcatcattttaatattgtattaatgaaatttatttatgtttgaagtttgagtaaatttggcaatcacattaaaaaaattcccccaaaataccttctgagcaaatttattaatgcatggatttgtcactgcttttatacttactaggattcttattacaagtataaattgctacttacattgattattatatcaacaatcaacctgttacatgaaaatcagagggatactagacacacaataaatctttcccctatcaattagatagttcttaaaatcaatttagtttgccagaaaagcactttactttgtaatatccacagataaagaagcagagtgaataaattaagcaagtgaatttttttaacctctatttatctatctacttacctgtgcatccatccatagatcaaagagactacattctcatgaggttgaattaaacaattaatttaaatttttttctcctagattttgtttcagtgagaaacaaatcagttgacattcaccaaattggcatttttagcaacaaaaatctcccaacattacattttattataaaacataatacaacttccaaggaattcacttgtggctggattttcttaaagaaagtttgtttaataacaaggttcatatcaaagataaattatctatattggcttaattatcatattgttgtttatagctttaatgttaccaggataaatacttggtctgtatttgagggaaaagcatgatattatgtgaaggatatctgaccacttgtgtaggaaaaaggcttttggtaatatgactgaagatttatatccaagagtacacactttaggaattttcttgataaaacagatatgatactttcccattatttccagaataaaataatactgattaataactcatgggacatttttggctgtctcttttatacattaactgtggtcttactgaacattgttaagttaaataatgcaatgagttaacatactttcaggcttattactatggttcagggatgtattcttaaaatatgcatgtcaaatgcattattctgaaagcaataatggtaataactgaaatttgtgtttctgtcaatacttagaaaacatcacaattcttattttcttcctctgtatttctatattcatggactttaaatgtgtagaaagtaggacacaggagaagtgtcacgaaaggaagagaataaaagacctaaaataccaagagtaatagggaaggtccaatagtaatggagagggcacatccatttccccaacaattttctgcctaatgcctattgagatcctgatactggccgctccttctctctaaagaaatgtaaaacatttaactatgtccctgtcctaaaatcagaattagaaaacataacacaagtgatcaatacttgggaaatgaactttagagtgaaaataaacacaaaatataaattgaatgctctaaacaatgaaatggaggtagatgaagaatagataccaattattgtctattattcacggtttttaaaataaatatttttgagcacttatgtattacagagtattctagtcataggcatagagtaaattaagatatgcataaatctctgttcaaaaggaacttatattccaggggaataaaattataaacaaaattaatatgtaaagaatataatattaaatattaggtaaactaatgtgatatagtttgtttttttatgtgcaccagtggattgttttaaagcaatattctaattgcagggctaaaagcaactcaaaggttttcttgcccccccaccccccacacacacctagagtagtgtgtttgtatgcatatagaaaattgcctctgggccgggagcggtggctcacgcctgaaatcccggcactttgagaggccgaggtgggcagatcacttgaagtcaagagtttgagaccagcctggccaacatggtgaaaccccatctccactaaaagtgcaaaaattagctgggcgtggtggcgggcgcctgtcatctcagctgctcgggaggctgaagcaggagaattgcttgaacctggtaagtggaggttgcagtgagctgagatcgcaccactgcactccagcttggcgacagagtgaaactctgtcaaaaaaaaggaaaattgtttctgtgtgtaggcaaataactacaagaaacgtagaatgagacattaatgaaacccctaaaatagcccacttacccgttttggcaaatgacaaattgacacatttatatgttgagtaacaaatctagtaagtgactgtgttttacatttaaaacttaattttaaaaagtgatattaggaatcttattaaaaatgtaatattctgggacaaaaataaattgatctcatggacatacgttttataggataatgcatgctaacttcctgtctatgctttgccttatgatcacttgacaggaaatgcaaatgttttccataagtgccttctgtggtaatttaagtgtctgaccttttcatcatgtagtaatttatttttagtcatttctctttgatgtattgtcctcatgaaaggttgcttttttctcatttttatggtgccagcagaattattaaagagttgtccattgaactgtgactatcattgtctttttttttttaacaagggtagaatactgaaaggatttatgtcagtttcataagactagctcctttctacaaaaatacacttgttgcttataatgacagaggaaactaccataatcaatgatgattaaaatgacctacacacatatagcacaaatagtaaaagaggtatgttgacagcttttatatatgtaaacatgtattactttgtgtttatggctcaatctttactcccctttttcttccctttcatctccaatgttttgagggaaaaatatgttttctttgtaattttattaaaactagttccttttttttacaaagattagttatgcttctagcaaaacatttttttataaacaaagtcagtcgattatatctagcagaaaaaagattcaataaaaatagtatatagaattaaggagtcagagagctaaaagtttattagaaagtattccaaaacaaaatgactctacatcatggttcattttcctcatttgaaactttaagtatgtcattttttaaacattatttagatgaatagttcttaacagactaagtaaagaccactacattttgctatgatagttattataacttttaattgatgcaaacattatacatataatcaaatgtttaaaattttttaattatgttctcacatgtattagactaataatttacatatcttagactaataattcaagctaagtagggtgtggggaaaggctaagaggaaaaatcatatagctaatggatatcgtatcttccagttgagcaaggtgagtagtatacatcttgtttttatacttaaatgaagcaacacctcccaaaagcactcaagaactgaacagatagtggagaaggggttcttgaatttatgaagaatctgcataaaaatgggagatttctgatgaaaacaattaccaggattcacaaaatcactataaggatatttaagctactgaaatcttgctctttggagttaatccccctgaaatcttctagggagaaaatactgatcccaactttgaaaataaaggagtttaataacattgatctacaatctatttgcacctacattgtgagcacaatcaagaaggaaaaattcaaaacattcagtttctgaagcactttgacagctctgggaagatttagaatatgcatgaaaatcatcaaattactcacttctgcagtgggaagaaataggaaattacccctaaactagtattctcagagcactaaaccatcaattcaaaccagaacacctctgctatgtgttttaaacctaaagctaacattctgcctttctttttaaaatacttacttttttagagctgttttggttcacagtaatactgaacagagggtacaaagatttcccatgtacctactgcccccacacattgcagaaccctccccattatcaacatactcctccagtgtggtgcatttggtacagtccataaacctatactgacacattattatcactcaaagtccatagtttttgttgttgttgttgttgttgttttgaggcagagtctcactctatcgcccaggctggagtgcaatggcatggtctcagctcactacaaactctgcctcctgagttcaagcgattctcctgcctcagtctcctgagtagctgggatttcgggcacccaccaccacacctggctaatttttgtatttttagtaaagatggggcttcaccatgttggccaggctgtctcgaactgctgacctcacgatccgcccgcctaggcctcccaaagtgctgggattacaggcgtgagccaccgtgcctggcctcaaagtccatagtttacattagagttgactcttggtgttgtacattctatgggtttggacaaatttaaaatgacatgtatctaccattatactatcatacagagtagtttcactccactaaaagtcttctgtgatctgcctattcatcctttcctccctaataacccctggcaaaccactgatcttttttgtgtctcatagtttgccttttccagcatttcttatagttagaatcttacagtaggtagcctttcctggttggcttcttccagttactgcattaaagtttatttttagtgctgactaatgtatcattgtctggatataccacagtttattcaatcacttactgaaggacgtgttgcttgcttccaagtttttggaattatgaataaagctgctataaacatctgtctgcaagcttttgtgtggacataccttttcaactttttgtgtacataccaatgagtataattgctggatcccttggtaagagtatgtttagtttgagaggaagctgccaaactgttttccaaagttgctgtatcattttgcattcccaccagcaatgaatcagagtctctatagtgccacattatccccagcttttggtgttgtcagcgttctgagttttggccattctaataagtttatagtgctatcccatggtttcaatttgcgagtcctgaataacatatgctgtagatcaactttcaatgtgcttatttgccgtatgcatatcatctttggtgaggtgtctatcaaggtctttggctcatttttaagttgcatttttttttcttattgttgagttttttatattattttcatattttgaataacagacttttatcagatatgtctttggcaaatattttcccccagtctctggcttgtctcctcatcattctcttgacgctgtctttcacaaaacaaaaatttttaattgtaatgaaatacagcttttcaattctttctttcatggatcatacctcttgcgttgtatctaaaaaaactttccaaaaccgaggtgatgtagattttcttctatgttaaattctaggtgtctcatagttttgcattgtacatttaggtctgtgatacgttttgagttacattttgtgaagagtgtgacaactttatgggtgtattcatctgttttcatgctgctgataaagacatacctgagagtggggaaaaaataggtttaatggactcacagttccacgtggttgagaaagcctcacaatcatggcgaaaggtgaaaggcactccttacgtggtggcagcaagagagaatgagagagaagcaaaagtggaaaccccttataaaaccatcgggtctcatgagcccacatgaactaccacaggaactgtatggagaaaccgccccaatgattcaattatccctcacagcatccctcccacaaaacgtgggaattatgggagccaaaattcaagaggagatttgggtggggatacagagtgaaaccatatgaatgggataattttactagtcaggttgtaaagtattattattgaagaaattatttgaaattattctgtattatgtcttccaacaagtaaatccatattttctaccttaacttcatattaggttttctgtcataatttgcagctttgaaatatatatatgtggactttttagagaatttagggtccattgctattagtcaccttacacccctttttcagggatttaagcattataaatcttgaaattaagtcattctgaattttttctctttcacaccttacggaaatgttgaaacgcgagagagacagactcctctcttgctttactttgttcaatgtggccattgtccctttaagtgtatttcagagggtcctttttgcagagtttgaggtaacagggcattagttactaacttgctaaaatagaacttgggatgatttttgtctaaaaataattattccatacatacctattactagtttctcctgggtctcacatagaggaaaaggaggtcaggtgtcatagggaagaggtaaaagttaaagcatctcctaccagctgttgggttgcttggacataaaggcaacattttaaaattctgtcaaagaagccaaaaactaagttcaaatactcatcaaaaaaaacaaaaaaagcaaaaacaaaaacaacaacagcaaaaaacacccaggtatcaaaccttcccattgaattatttcaagcgggatctgaatagcatagcctgaagaaaataccaaaggcagccattttctcttaaaaacatgtataatattcctcaaatatttgagaaaactgaagttctacagatttggctatctgtgctgtgtggctatgagtatgctgacctactcctaagagcccatagggttcaaataattattgaatatgagactcaatgaataattcataaactgaatgataattttttctcatgttctatatttagtaaagctttaccatttattcaacacctgtgtttcactccggtcaaagggcttgtaaaatttagcttcaccaaagggattattatgtcatcacttattttctcttgatgactatgctattcaaataataattttcctataaaaatttctctaagctttgaaaaaatctgtctactaatcattcactcaagtggttgtgtaaatatatgagtgtaaattaatgtgtgtaacttagagaagaagtttatttgattttctagtgggacatagatatatttgcatacttgtttaaagtgagttgttaaacaaacagaaactggtaaataagcttaatgcgttcatgtggctccatgagttttcttaaaataaattggattttagaactctttcactttgcacattgggaaattcacaagcacagcattgactctgaggtatattttgttgagaattgtatttttgcttttaaaatttcttcacactctcaagtccaagattgagattctatgctttgaaagttagaatcgtttgtaaatatttaaaaaaaaaaatttaccttggagtggttgaattgatgtctcactagaaaccaagaaggctagaaatcattttctattatttcattttttgactgtgttaaaataagatgtattttagatattaatatgtctagattgcttcaaatatctatattatttatcataatgctataacaaatttacccccaaatttcaatggtatcacacaatataaatgtactttttacacacacgttaaactagtaagcgtattctcaggttcaggcagtgaggtctcttttttgttgatttggggaatacgttttttcttctattttgtagttctactatttcttagagcagggtcaaaaactagacctgtgtacaaaatcttgctgacagtctttttatgtaggacctgagaattaagaatggtttttgtattttcaaagagttggggtaaataatcaaaaatgtaatatttagtgatacattacattatatgaaattcaatttcattgttcatacaaatgttttattagaatacagctatggctacttgcttatgtattgcctgttctataagcatgcttgtagaatttccttctctagccatgccatagtaatatataagcatagatatttatctctctatatatccactgacatttgtgggacaagattactacaaagttatatttaatctattgctgggaagtgattaaagtaccccagggaaccccaatcctaaataatgctagtgttacttttatcaaatcaatattaaaacaaataaacttctaacaagagaaacaaatgagagtaaaaaagtgttattattttatcaaaagtctctaacaagttgcactagattaagttgcccatttcagcttcccttcaatatggtgggaagacggtggctaactccttggcagcattttccaggtcggtttaatttaaccatgggagtccacaccctgggacctactaacctttttcttcagcctagccattccacttaccagccatgtgttcagcaaacatgataagtcattagtcatctttctatgcctttcaggcattgttagtgagggagttaggaagtgtagacaattcttagcatgtagtatattttatggcctccagttggtcagaaaaaagctgtcagaagggcaagagagactgtggtgagcatttttcaaggggaaattagcatgagttcgtagattaaatggatcttgttattctaaaaagtcatgtgacaaaccaaaacatgcagtaaattaacagtgttctgaaaggtttaaagtattttttaaaagcctttataaattactctttcacttacagttgtgaagagccaaatttttaatttcctgaatgcttgcttcctaaataaataatggaaagcatgctaaaaattctaaaacacagggcagaaaagagtctttgataggctgaacctaccaaagggaagaaattatgttaaatattttgtgatgttcctttatattatggcataaaataacattgaggaaaaaaagacacttgtttgaattcagaggcaagtttattatttttattttattctaactgactggcttttaacgggcaagctaatgtcaaccttggatgtcacaaagcctgtatctttcccaattctgtgacactaagccttgtacccactactttctttcagctttcctccagtgaccacgactgctaaatgcaaaagaacaaaaagaaaccccattatcattagcccctgctttaataaaatttagggtcaaatgagggatgttgatatgcctgccatttttaatttttaatgcataaaaatggggtctatttttttctactctttacaactttaacagttatgtagtgtctaaaaatcagtaaagtgtaaaaagtacaaactgtgctgaaattcactgggaaattagatgaatttaaataccttttgtttgggaacctacagttggtctttactgacagaagaatcagttagacctggctgtggtttgtgattaagacaaagcatagatgggaacagtcttgtggctgctaatgggcaatgtatgagtcccaaaatatcatcatggaccatacgtttttccattagatgtgaaagaattgattagacagggcaaaatatactgtctatgtgaatttatgcatggaattaattatgacatctctccaaactagggactccattcctgaagcttttttgttatcagagaaatagaatctctcttttctgagtattctccctgttgtgagctaaatgatggcctaaaagatatgaccatattttagttcccataatctgcgaatatcatcttataaagcataagagtgaatattactatgtgtgccaaaagatatggttacattaaggatcttcagaggaagaatttatcctagattatcagggtgagacctaaatgtaatcacatgtatccttataagagagagacagggagttttgacacagacaaaaacaggagaaagtgataggaagatggagtagaaagttgtagccataagccaagaaatgtcaatagctaccagaaactggaagaagcaagcacagattatgacctggaaaccccccactgggagagtgtagtcctgccaacaccttgatttcagtcaagagatactgattttagacttttagattcctaacggtgagagattaaatttcgttgtttaaatcagcaagtttttggtaagttattacagcagacatgggaaactaacacatcccccaatcttagaaactgtatttctggaagtgtgatctaacgaaaggaaaaacaggcattgattgggcaaattgcacagaggtcagaatgcttggtatgttgactccaaaggatgctgagattaaattcaacttatatgcaatatcatactgtgattaaaatgacatcttttactgccctgctgcttcctgcgtgcttgtaagtggagttcaacagaagttagaaatatttgtaggctacagaaagtggcctttgctctaagtgggtccataatctcccaaacttcagaattagagaaacagcataaggaaggaaagagtaggtattaggcgcagatacgtctcctaatgtcatgagagatgtcattagagcatgaaagggactcagaattaggggagtgtgagtataaattgggttaaataggaaagatgactatataggtgattgttagaattgacaagacatataaaagcataagaggagttagaaaatatttacaaaccaatggcatcaaagtcaggacctcaaagatgaatataacttcatgagataggctctatattgtccttatcacttcttagactatagaaaaatcctacaaaaagctactcctacttttttgtccacaaataaattctgaattccatgaatgtaatgattctatccctctgatgccactagggtgtgaaattgttcctgaatatcttgtagggcagcggtccccaatctttttggcaccaaggactggtttacaggggagtgggagatggtttgggtatgaaactgtttcacctcagatgatcagatgctagattctcataaggagggcaacacctagacccctcgtgtccgccgttcacaatagggtttgcactaatgccactgctgatctgacaggaggcggtgctcaggtggtgatgctggcttgcttacctcctactgtgcagcccggttcctaacaggtgacggctactgggccactgcctggcttttggggacccccgttgtacgtttatgagcaaataactaaacagtatctagaagggcgcataggtactatttgtaggttagaagatgataatttattaggagagatagtgatgggaattttaatggtacctgattcagttcatagaacatttatgtagctgtaactataagtaataatatataagtaacaataataaaactgtttttgaaaggcttttttatagtctttaatatatagtacaaagtattgagatacaatttccaggagaacagttccttggctagtgagtctgcccctactcctggttataccaataaagagtcaacacgggctgggtgcagtggctcatgcctgtaatcacagcactttgggaggccaaggcgggcggatcacaaggtcaagagattgagactatcctggccaacatggtgaaacccctgtctctacaaaaaatacaaaaattagctgagcgtggtggcgtgcgcctatagtgccagctacagcaggctgaggcaagagaattgcttgaacccgggaggtagaagttgagctgagattgtgccactgcactccagcctggcaatagtgtaagactcagtctcaaaaaaaaaaaaaaaaaaattcaacacatgtttgaaagtatactcttccaggacaggaaaccaatacaatctgatagaaaaatgctataggataaaatattaggctgccttttaaattttattaattacttgttaacttgaaaaatcagacatgtgattgggcaaattgctgtacttcaaatatagctgtcagagctaatgcagagtggaggtttcacacttaatcgtttgtttcatcctgtaaatcagactcaagcaaaacatggtagtttctttcttctttctgcaactttcctttcccaataaagcagtaagctaggagaaaggcaatgataatgacttccacaaagacagggtatgaaggaaaagctgtgttttgtctccctgaactttggatggtccttaatgacggtttacttaaataaaatgcagcatttaattgttaaatggctctgctgaagctttcagatctatttttaaaagcagctaaaatcattggcttctgttaagaaaattttttaaaaattaaaagaatttttcacaatcaagacatttatatatatataaaaatgtgttttcaatagtcaaacaatatttttccatgtcttttaggaaatgttgcgcttaggcattttcttttggtaaaatatttttctcgctttaagctgcatatctgtcactgctatttttaaaatgtgaatacatttttccaaatatagaatctccttgatatttaagaatcacatatttttatgaactcaaatcttagttcacactttgctcagtgctgacactgtaagctagttaaggttaaaatagtagcacagttaatggttgaaagcttgttttgcttatgaacattaatatcttgaatgaaaataaatatacctgtcaatacaaattaaatagaaccaattcataccttagttagttaatccttttactaattcagaatctagattatgatattttattacttatttcacaccatataaatttcagatttcattagccaggaggtatactctccagacaccaccttgtattttggtggtggtgaagattctaactaaaatttgaggtagtgatgctgtcatttttaacctattacatcaacgggtctagaaatttatggaatattggaatgtggttttccattacgtttaaaattttatatgtatgcttatggtaggaaacataaatggcccagtggaaaggataaccctggaagtccatatttatgaattgtacgcaccagagacttgataattaagctccgtcaatttacttcttcctagccttacaatttaaatgctaatacacactgtataagattgttaaaatgataaacaatgtaatatatgtgtctgtcacataaggctatcagcatacatgtaaatctaaccttagatttatttaaatacttggtttagttcttaaaataatgcattttaatattatactgatttaaaagaaaaaataactttctaacacttctttcaatgatgataactatacatagcttttaatgaggtaattaatttgtcacacatgagattataaattcttaatctgttggcttgcattttgctggaaacgggtttataaagatttcttgtccattataactcctggtaatgactctttatatcttatacaatgaagatcatttgcagttgaatatacctttttaaatgaaggggtttttagtaattgaaatagtgtggaattaagtaggtggaaagagtatggacctggatcactacaatctgaatttgacatcatctacattttatacatttcaaagctattttactgttgagggtcagattgaaaaggagattggaaatatgcagtcatgtcatttgtcgtgatgcctattgaaattttgaaagagtttattgatgccttcagtaattatgaatatgcccaccacttaaaaaatcatttacttgacagcatatattattcaagtatgataataactggatctgttcaaagaaattggtgctcattataaattatccacttctctttaaactctaaatcctgatgtttaatttaaacgctctgtaaagcatgtactttaaatcactgattgctttgatttcttggtaacttttctacatcatacttgttggcctcataagcacagttcatattgaaaatttattattataatcattctttagattgtgtcttagtttatgttgctataaaggaatacctgagactggcttaattataaagaaaagaagtttatttgtctgatggttctccaagctgtacaagaatcaaggtgccagcatctgcttctggtgagagccccagagtgcttccactcatagcagaatttgaaggggatctggggtgtgcagagatcacatggccagagagaaatcaagacagagaggccaggctctttaaataatcagatctcaccagaactaatagagcaaggactcactcattaccatgaggatggcaccaaagcactcatgagggatccacccctatgacccaaacaccttcccccaggccccacctccaacaatgggaatcaaaattcaacatgacatttggagggaaaaaacatgcaaactgtatcagattgtagttaatttatcttaggaataatttttaaaggtatttttcattaattacttctcccactgtattttaaaatatgtttaaaaattgtttttttgtgaatttctgtcctttgaaaatatatagagcaaatcaggttgttattcatattgcagaataagctatgtcaaatgatttcttatataacatccattttttatagcaacattgttaatagtattttattttataaagtattttagtctacagcctaattctataccaccctgaacctatctgacctcttctgatctaggaagctaagcagggctgggcctggttagtatttggataggaggctgacagaatacttttttgcattcatagagtatataccttacttaaaatttatttcttatgatattttcctttaatgctcaaattcctgacatacaatatagaaatcatttaaagtaaatagtgttcattgtagatttagtaagttccatgtaggcttttccagcttttatataattttctcacactgaaagataatttactgcagtcagctaatagcaactgtcctttgctaagacccatggcaaaatgtaataaaagtagccttctttcctgaaaagttatgaccaatagggaagaaatcatgacttggcagtcatatctgaagaaataatcctaccacaactctggcagaattttaaaaagcaaatgatttgggacgtgaaatagtaggtgtattgagtgcagaagaaatatattaagtcaccatcagttgagatattccacagaatatctcttctcacttgaatgttgttttatgagattataatcaaatccttctgttaataattaaattaatattggtatgtattagttttcacactgatataaagaaatgcctgagactgggtaatatgtaaaggaaagaggtttaattgactcacagtttcacatggctagggaggcctcaggaaatttaacagtcatgggggaaggggaagcaaggcacttccttcacgaaggagcaggaaagagaaaaataaaggaggaacttccaaacacttataaaaccatgagatttcatgagaactcactcactatcacaagtgagtgacagtgaccctgtataggatgcagttataaactaaataaattttaagtcagatttttagaaatgaatatttttttgaaaaaataattctctgaaagtcatacatttactccagtggagctactgtcggaagaccaatttcagaaaatgttcagagtttttcagccagcttaggttttttacgtcataatccaaccacatccctccctcgacacgtggggattacaatttaagatgagatttgggtgaggacacagagccaaaccatatctctcctaagttaaatatataatgcataaattggcattttattctgcttgcatatttaggaccttaagaactgagactttctactatatggtatcagattcaagaactacaaggtttaagaaaaatatttatttagagaatcaatgtgttataccatttatttttatgatttcttgtttcttgacattgtaatgcaaatattattttatttgtagatagctttcatggaaactgtgcctcttttaacacaaccacgccacattttatttcctttcattcattggttatcatatgactgggctccctccatgtctttcatttgctacttgagacagcccagcattgcaacttcagcatttctagctctctcttttaacatccaacctcatccttcaccccataatgatatatttgcttcacttgttaacactaaatcaaatcctaaaatcataacatgtggccaatatgcactatttatgcttctaacttttgctaagcatcttcatataagtaattgtattaaagatttatagactgatggattactcaagatcaaatgatccataataatgaaacctgtcattgcacaagtgaagaaattaagaccgagggaggtggctggcttgccaaggctgattaatgaaatgggcatatgttaaattcaagtcaagttagaatgagagggttttttgtggtttttgtttttttgctaaccattttggtaacatcatttaccctctttcagaaatcagtgtaaatcctgaaacatggaagttttgttcaaattattttgttaaaatgaacatgattaacttaaacagaaaactaagtagaacataaatgagtaaatgaatgtagcagcaattaacattatagttattaggaaaatgagactgttgagctttcatatgagactgatgctagagacatattgaagactagagtgaaagttaaatcatgaatacaagataatagttcaggtggtaagaagataatatgattcaactgcctagaagtgagtcacctaaaagaacgctagcaatagtatgaattcctctttagttattagtttaattttccagctcttaaaaacataataatatttataattatatgaaactatcttagggccttgaatctggaatctttgaaacgaatgattctgaggaaaaaaaaaagaaaacttgagtttattatatgttattcaatttgcttcgtttccctgggttcaaaaatacaatttcttattccttaagggaagggttgtgaccctgtataggatgcagttataaactaaataaatttttaactcagatttttagaattgaatatttttttgaaaaaataattgtctgaaagtcatacgtttattccagtggagctactgttggaagaccaatttctgaaaatgttcagagtttttcagccagcttaggttttttacttcattagtggaagcaagttgtatcaccctatttgttaataatttcagataactaactgcaaatgacctttggtgtatcaaaaaattagatgtatgctcgaaggttaatcttttctgcacctagaatattcagaataatgtgcctagttgtgctctccccagatctagtttcttacctggggcattcctcttgccacagttgccaggcaaccattctcatagcctgagccaaatacacctttccctaatcatgttgctttgctcatcttcacctatacaatgactatgtgacttcatttctctcttagaaacacgttgctctctcttaaatggggccttcaaaatagaattaaaaaccgaccaacaacagatgatttccgtgtatatataatttatatatgtttacatattatatatcatacacaggtattaagtgttaagtttttaatgttacatcttcatctacttggctaatttttctaagaacaaaacaaaaatttaaatgactaagaagaacactaattctgagaacaatctctgatgccaaaccaaacacattatgaatcataagaaacatttttttttaattattttaagtcctgggatacatgtgcagaatgtacaggtttgttacagaggtatacacatacacctgccatggtggtttgctgcacctatcaactcatcatctaggatacatttttataaaaggagtctggaaatgcaaaaatctctcccatgatgaatagtgatattacatataggtggacaggtgatatcacatagagttggacttctataaatttgtagaagtactttgtattcctataataagactgagaaatgcatttgtatattgttggtgattatatttcactccagcaaatcctgaccagcatcaaaactaaataaaaagtaccatttttattgatacactcataaaacttaaagtataataataataaaaaaaagaatatgaacatgtttatttagtgttccgtatggttaaaactggaaggaataagaacaactaatcttgttttacttcaaaatctattttacaagtacattacaattttactttttaagagctcatttcaatttcacaaatttctaataaatcttcaattgtattttattttattttttgagacggagtttcgctcagactggagtgcagtggtgtgatcttgactcatggcaaccaccgcctcctggattcaagctattctcctgccttagcctcctgagtagcggggattatgggcatgcaccaccatgcctggctaattttgtatttttagtagagacgggatttctccatgttggtcaggctggtctcaaactcccaacctcaggtgatccgcctgtctcggcctcccacagcactgggattacaggcgtgagccaacgtgcccagccaaatcttcaaactttttaaaaatttacttctagttatatttactctttaaattaaaattgaaagattttctaagtcataaatgttatatttataagagaaatttattaatacaacaatgtttagtttccagatatcattagggttttttaaattatatgtgttaggaaaggagaatgagatgaagtaaagaagagatatggagatgggatataaacctaagcataaaggacatatacgtcttattttttttttactacaatcctcttttgctctaataaaatacttttcactgattagaagcccaaacttgcttatactttctcctaatgtatctgaagagcaaataattgttgcgtaatttcatgtcttgtttgattacacacagtgaaagttcagtgcaagtagaatggttttttttttttaatttgtatctgctacattttcgtaatttataaatcttgaagtgttacagaatagcccacgtttttcaatcattgttttatctctcactaggatattgtgccaactgtttttcaggaaaaattggcatgtttattttctcccattgtatctattataagatgaactttgtagcaaagcaaggttttaatgtggtcttttggcagaatgtacaaaactgaaataaagagaacgtatttggaactatgataggcttcatgaaaatctttgagagagagagagagagagacagaaaataatctatgtgtaatgcccacccaaactctggcaaaatttgaaacacatagttcaaacttctttccttataatgaaagcccttaaaatgtgtcttgatagtcttttgggaccactattttgtaggtttgacatattcatgaaaagaaaacaaaaagcaaaaagaaaaaaaatgtttctggtaaaatatctattctcatcctgacataggcatcaaattactctctccataagcagttgtaataaatgaatattgatttactacaggactttcaaatattaaatgtgtttatatgaactctcagttaattttttttctaactttcaagccattttcctgactctgtgtaaattgttcacacaaataggcaaaggaataaagcaatttaaccaaagtggggaaacaaacaatcgtaagtgtaggtggcagaagagaatggatttttttccagttattctgtatcaaagctgcatggatctatttgaagacacttttacacaacaaaaggagatttgttatcactaaacctagcaatttggctttctaaatactgataaatcctggaaaattgtaattctttatttctgttttctctaaaagtaagccactcttacttttaggcacccagtggattagatgtcatcttttttatattgttcctaatggaacatgaggatggcttttaagaaggtgccagatgtgtgagttctttattgctgagcaagtgttgcttctgtttctgagtctatcaaaagggttcacatgaagaaatacagctatcatttatatgtgactagcagaatatatttaaggaacatattcttttttatcagaggcaagccttaagatataaatcaaaagattataatgaaaaatatggcatgaaataataaattaaaaatgagaatagtttgttgattctaatgtatcttcaggagttggaatggcagtttaggagaggaatgagctaatataaatgtatattttaaaataaatatgctcaatatgcttgctttatttttttaacaggatgaaagaagcaggagtagaccataggcagtggaggggtcccatattatccacctgcaagcagtgcccagtggtctatcccagccctgtttgtggttcagatggtcatacctactcttttcaggtaaagacacctacagttgtttagtttgaaataagggatgcatacttattagtaaatgattaaaaccattgcttatccaatgtgataattcaaattattcatttaacttataaaataaattaataatctcactggtttggaatatgattcaatgtgcatttgttttttctatatcagaatttttaaggtttgaaatactaaagctatgaaccctcagatatcaaagccaacctttcctttgttgctactatgaaagaagtcagaaatgttagcatgctgtacaatagctttagtgatcaatattattttaacaacaataaatgtgctacaatctgtcattagaattattttttaatctcatattttatctcctatattatctcatttaagccaccaaaaatctctttaccagatgaaaaaaacaggatcagagaggcaatttgacaagtttcacatatttagttgacattgaagctaggatttgatataatctctgattcaatgcctttgctctctcttctacattgttgttcctcccaattaagtgtcccatattgttaaaatattttgggatttttacaaactttgcctaaataagacattgataaatttccttagcttatgtaacagaaagtaaggagttcaggttcactgtcttttatctgaaaccctagggactgcatacatttaaaaatttagatttaaaaaatatatattttagaaaggtagtgtagcatattatgcagtgtccctagaaggagcttaccctataattaaactattaagccaggtgcagtggttcacgcctgtaaccccagcacttgtgaggccaaggtgggcagattacctgagtcaggagtttgagaccagcctggccaacatggtgaaaccccgtctctactaaaaatacaaaaatgcatcaggcatggtgttgggcatctgtaatcccagctactcgggaggctgaggcagaagaatgacttgaaccagggagacggaggttgcagtgagctgagattgcgccattgtactccagcctgggcaataagagcaaaactctgtctcaaaaaacaaaaaacaaaaacaaaaacatattaatacatttttaagcaacaatttaaatattcttattaaagagtatacattaaatctataaataacctttcttcagttcatatctgattgtgcttactgcagttatttccagaattttcctaccttttatatgttttggttttgtggatacctgcttatgaatcataatctgtctgagcaaatatttccccaaaacttccacttgccttttacaattacaaatctgggaaagtgcactacaatgctcttaattaattcagtcactaaatacatagtacacactaggtgccaagtactgtgtatccttagtgaagctgtcatatgtctacctgctaaacttttatagatgtatatagaagcggagttatcgctaggagaggagtgtgtcaggggtcctttcaacatggtcttgatcttggtgaatttaacatggtataggtagggccttggctttgcaagtttagtgaattcctgttgccagtacaagggagagtgaatctatctcatattataaaattccacatggaaatgatgtataaatcattttgctgatttattgacttataatgaaggatgcagattgtaatattcaaactgataggaagaactacagaggaagtaaattttaatcctaattttatctggtgagtgtagatgattgaataaattgagtcagtggtagagagattggaaagttttactggcatccacctaagtagaagtatgtctttctcaacattggaaatatgtgccagaagtactgatatgtttgtgcctagggtgtcatcatccccagagagtgctaacagaagtctactggcttctgctgacatttttgggactcttttgaggttgctcctagcaggtgatccttcctttcccaatttagtttcataggacaccaagttacaattataagtggaattctacttgataagacttgattgatgatgttagagttacttagcatgtaagaaatagctctcatattctcattcaagactaaaagcacgtattatacgtagattaattcaggtatatcttcaatttcatggggtttcctcattgttctccttgggcgtgaggcacactgtgataccttggcttataaatcatctaattttattagtagtatcaacaaaaccaatcttatagataatccatatttgaattattattttaatatttatttacataaatgtcacttttaacaaatgcttttttacatagaaagacattacaaaaagcatgcttcaagtgaatatgggtctttaataaccctaaatcatcatttttatttctgttaattctaatttaacttaatgacttttccactttgaaccatccatcctaatcttaaacttttgcattgacagcaatgagactgagctatataaaacaatgaaaaactaagtagaactcttagcccagtaaagatttaggtgaaactatccttactaatctttttttaagagtttatttgatttgaatctcaaattaaggacttcaatatgttggtgtttttttgttcccccctcataagaaagtattgccctaggctatttagctactgatcaaaaacaaagaccacaaaggccagtaccttcttgtaaatgtcattttattatgttcccaacatctgcttatgagagttgaaaatagaatatagataagagatcacaagatctttcttctggctcttggatcactaaattttgtcaataaacttgcaaattatgacaggtcagatttaaacacatttgaacaataatgatgagctccaaattctaagctcagtagggtccatgaagctccttgcttgaagttttaaatcctcccctgagtagtcctgatatgttaaagattaatcagaagccagatatgatgagtcttggatgtggggccctacattcagtgtggaagtgcagtcttgctgtggaagcctttcctattcgtctgctgaattgttgacccatgcattgatacaaatggtttttttttaatactacaaataatattcctacaagttctattttagacccacaatgtttgttcattactttcagcttattttatagagaggagattataaatgatattttcattgcacatcttaactggaggtgaggtcaggtgcaggagctgggggatgtggtgggaaagaggaatatcagaaggtacacaaagaaagactttagccaaatgatataactaagatataattttaaaaggtaaacctcattatgcaatgtgaccaattttgaataattattttatttgagttcaagctttgaagttaatcagcgtttttagaaatcctcagtagagtattttaaaaatgcatacacaaaaagaaaaatgaatagatgaggaactatggataaataggcttacttgaaaaaatcttgggacatttgtgattttcataaaaagtatttttggaacattgccttttttcctgttaagaaaaattatttactttctttagaagcctatttaatctttctttttaaaagaaccagtgttctctgaattctttcaaattcagcaatgccagaaaaataaaaatatagttagtctgttcaaggttgtttgagaggtaatcattcttgaaattgacacaaaagatgaaggccttcatttctttacttcaggcaaagtctattttgattgtattgtcaagctgcggtaagaactaggaatgttcttcaatataccatttatgttagatcatggatgtatttcccactttgttatgtaaagtgtacgttacatttgccgtgagcacaagtcaataaataatattaaccttttagacttgagtagaacatgtgtaatataaattccctgaggacaacagtggatgattttaaactcttttctatcatatttagtgatgcagtgcttggcaattgaactaaacaatcatgaattccttagaaattagtattgttcataaaattgtgtgtgtgtgtgtgtgtgtgtgtgtgtgtgtgtgcatggttttgaaggaaggcaaatataaagcttacctattttagactgcagttttcaaatccagctgtagagatgctacttaaattgatttggaatggggccccatgaatttgaatttttaaaactcctcatgtgacttttatgtgtagccatggctgagaatcactgtgcatcccttcaaattattgcctttgaatacttaaataaaaggtaggggtgtgtgtgtgtgtgtgtgtgtgtgtgtgtgtgtgtgtgaacaataacattagcattaaaggggaaggcctaatttttttattacaattcaaaaactttctattttaagtttcaacatgctactataatgttttaacctttctgtcatttattttttccatatttgaggcatgttcttactttctcttaatagttattaattctagcaactatatgaacattttgaaaggtagataatttctgacacctaatcatgagaagtttggtatgttatactttttagtatttagttgttctatcttctttcctctgaatatttagagctgagatcatttgattttggaagatccactgtcagaaatggatgtgcactctttctatttgacttgcttttccacttaggttgcgtttgatttttggctgaggtatgccaactcgatcaatattacagcaccagaacattatcatgatcatttatggggatactttcttattacagcactgaacattaaaggaaataatatgaatgaaatttatcataaaatttcaaatttaaaaggaacttaaaagaacatctaggacaaatgtctatgcaataaagtccctggtatgaaatcatattctgcgaggtaaacctctatatttgaggagtgttctaattgtcagaaaagccttcctctccttacactgattttgtttccaacactcgctatccttactccctggaaccatgtgctgaagcacaaaatacatcctctcttgtcttcagttactgggaaaaatgtgaattcttaaatttgccacttacagtgaagcaaacaactaaaagacacttgcaaagaagcttcacaggtaggaaaagaactcattttttgtgtgtttgttttgttttttcaaatccctgattgctcattgacttgatcaatgactggtgcctttgaatagaggcttctaagagaacacagggtacattgctccaggatacctccaccccagtccctttacttttacatgcatttctagatactaagttcttttcctaatgctctgatcagtgtttcccacagcttgttgccagtggtctatctgtagggaagatataatgcaatgagttagagacacaggtgcctgatttttgtctaccatttacaataacttgtgttttgatcttgcaatatgggaacccatggccttttcactacattaactttcataacctcatatatacacttgtgtgtgtgcatatgtataatgtgtgtgtatatatataaatcaaacatttatgtagaccatattttctggcaaatactttaaatattttaaatatgttaactggttgttatccctcctttatagatgagaactgtgaagcacagagaatttaagtcatttgaccagtgttactcagctaagtccagagcccatgttattaattgcatttcaattttttaatgtaaaattgaagcaaattcattttctaaattaattacccttcatttttttctatattgctacacatgatgtggtgactacctttatttgaatcactaaaaaaaattaaaaaataaaaatatgtggcttttaaatttattgagttgtttctcactgaattagagcctgtgatatcagattaatgataaaaatatatttttagatattatgcatgataaataagcctatattgtcaattttctgtgattattactcgttgcagaaaacaatcttctgtgtcttctagaagctttaaaattttaacttttagggttaggtctatgatactgattagtttttgtgtatagtagaaggtaggtttttttttttttttttttatgtagccaaccaggccaggcatggtggcttacgcctataatcccaccattttgagaagcagagatgggaaaattccttgagcttcggagttcaagacaagcattggcaacatggcaaaaacccgtttctacacaaaatttttaaaaaagtggccaaccagttgcagaatcgtttatagcatcttacttcattggattgctttgatgtctttgtcaaaaatgaaatggtcctaaaagtgtgggtctgtttctgtctttagtatggtcagtgaactatttatccttaagcctgtatcacatgtctaatttgttgtaccttaatgctgacttttgaattcagatgcaaagtctaactttgttatacctttttaatattgctttggtgtttaccctttgcatttccataagaatttcagaatcagtctgtcaatttctatagaaaacaagctagaatcattttttagatattgtgcagtactgaatcttcaaatccacacacttggtatatctctccatttagttatatttcattaattaatgtttggtaattttcagtatagaatttcataatgccctttattaaatttgttaagtacttttttattagtactattgtaaatttaattttaattcagtttttaatggtttgctgatagtatattgttatattgttaattttctatactgacttgtatattgccactttgctaaattcacttattatttctagtaatgttttgtcatctctccagatttttttacatataatatccttctccatgaatacatgcaggtttatttcttccttttttatctttctatttcttgccttaggttttggttaggacttccactacaatgttcaatgtatctccttgccttagtcccaatttataagaaaagtgttcagtattttcaacattaggtatgaagttacctatagatttttgcatgtaaaaaaagaaaagttttaatagtgcttaagcccgtgttaattaagttttctgtagccatcacagaatagaacatataatatcagtgtctacatcttttgttactatatactaaaaaaggactaacaccacatatattcagttgtggaattttcatgttaacttttatatcttagagatcttgtagtttataaacagtccatctagtttgtatttataaggaatgcatttatctaaaaaatcctaaactatgtagaacatgtttaaatatacatgttctttaagagaagtgtaatgataataataatactaggcatatactagttgtggtaatagaagttctagtaatatttgtagtaattgctaaaataactgtataataatatcagttaatatcctaaatattttatgtgtagtaaattaatctttaaaaaaaattacaagactttttttataatgtctacaaactagggataaagaaaaggaagcccatgtcagccataaagctggtgaattacaatgctggaatcagagcccagttaagcgcacacacagttaaccacagcactgtactgtgcaataaaactcccagcaagaccttaactgatgcatttatcacatgtgaattttacctgaatgatgtcctttgtaacattaattattcatcactttgccaaggaaaaagaatacaggaggtgatgggagagatataaagaaaccatatatatttcaactcttcaaaaaggttatagaaaagtaaataggttatccatgtgtatctgtaaaccaacctctttttatcctccctatttttctccccttctcagacactaacacccccaattctactctctacttccaggggctcaaaatattttttaaatcccacatatgagtgagaacatgtggtatttatcttcctgtgtctggcttatttcaactaatataatgttattcatatgtaaagataactatagcatgtgccatccttactatgttactagaatttatttcagctgagttactcaaaaagtttctaggtaattaagtaagtgtatgtacagtacctttggaagagttctgtaatctttttgtcagaggcacccaactcatatcaacaaacaaaatattcttttaagaaattaacatatcatgattgcataatgtgtgttaataagtattctaaattaatgtattaatgaatgactcaattaagctaatgcgttaatttttatatgcattaacttcttaattttaacaatgctataagatatataacatacactaacatacactaatattgttcccattttaaacataagaatttgaaacagagagattttaaattagttcatcggggatagaactagtaaggagcaggactaataatatggctatgaataaaaatatagattatataaaagtaataatataataaaatgattttgcataatatgtaattaaacatgctaattttatatcaacaactaatacacaaatgatttcaaaattaatatgacaattatttttctagataaagaaaaaatagtatgccatatattgtatctatctatatcagtttataatcatttgaattataaaataatagaatgtgactgtcatatcatttttagggtatctgagcaaattatattcttcccacaatcacactggatatactctatgagcactgtatgttttagtggcctttaaccgcttcccaccctaaatgcactctaccaagaaaattagtcttgttatgtgaattgacagtggattaagtatgtttttgtatctgaagcaagccaaataaacagccaaatgaaactagaaggtaacaacactaacacagaaactgagacaggaaaaaacaaaacacctgtcaataactacaatccggaaatattaagattaatggcctgtgaaagaatggtagagtaggctcgatatgaaagcacagtcacgtcgatgaattagacaacccctctgaacagctgtgcctccagtgaaaagaaagcgggaaatatttgtcatcaggcactagaaatctgaaaagtaacctacaggtccttccagtagcatggggtaataataccattattatggtataatgttgatgcttttgagctgctcttgcatgggtctggtgttctgaattacactacagctgagcagaggtcaggcaagcccaaagctgagaacatttaagggatttcatatattaagttacaccaagacttggaagcctcaatatatactttctctgtagaaatctattattaattcaaacgtctaaggattccacagagtttgttctgccaactcaaattcacaatttatttaataaattttaatatttattaatttttaataaattaaattataaattatttataatttatattataaataatttataaataaatataaattaaataaatataaataaaggggcacactaatacaatacaaataaactaataaacaaaatgaagcaagctaacaggagcaagagtgaacaatgccaacagcaagaacaagacaagatttgtattttaaatacttaaaattctaaaattgttagagacaaattattagtaacagacatcaactgtataatatatattaatgtatgaaacatttaaacatttaaaaagatattgaaatattcaagcattaccaaacataatttcagaaaaaattactcagcttttaaaagagccaaatagcatttaattaaaatattatttaattaaaaattaagtcaatagattaaacagcagattagatgaacttcaatcaagataatgaactataacttatatatatgtgagtgtacatgtatatgtattatgtacgtaacatagaataataagctataatatatgtaaatatcatgttacatatgtgtgaaatatatgcaaatattatatatatcatatatttatgtacatgtatacacatacgtatttctgaaaaataacccaaaaaggtagaatatatagactatagagtagaatgagaaagtcaaaagtttaatctgaaatatagagagtaatcagaagtaataacacagagaaaatattagaagagaatttagttgagaattttagttgagaactttccagaagtgatgaaatacatgattccacaagtacaggaaacacagtgtataccaagtaagataaataagaagaaacccaagtctagacacgttacagtaaaatgagagattaccaaagtaaagtccatccagacaaaaaagccatattacctaccaaaaatattgtaccattataccaacaaaaagcatctcagcaagattaatgtgattcagaaaacggtggaaatgtacacttaaaatattgaaagaaaatttttaaaattcaaaagccagtatttcagaagaaaataccttctaagtccgtttgctacataaacatccttgaaaagagtgcacggaacaaaagctgtcagtgcctctgattgcatgatgtgcaaaaatgtgagtgaacccaggagatctgcctccaaacagtatctgccctttgtttccatatcttggcttctagagaatgttcctctacgtaggccactccatcaacaggtgtttgaaccaaatctgttcaatttatctcatgtagcttttaattaaggatatcatcaagggaactctaagcaggaggatgataaaaacctgcaagcaaaatttatctcagcagtgtctccgaccccccactccagagtctcagaaccaacctcctggacacgtcgcataaatcatccagatctaccttatacatccaacgtggcttttgccttatgtgtttgtcttgggctttctacttggcctgtggaattaagtcaggtgcagcaggatacactagtgattgcatagatgtcactacttgacctacagagaggcatcctggacaattgtgtcatccaaaatatctggtcagtggactgtgactgacctgaatgcctttcagaaacaatgtcctgtcattgatcacttcacttcgcaaaatgtgttagtgaaacatttattatcaacttttctaattgcatacctcctgttacgaaaagaacttcctgcaaggtatctataaatgatgagtctgttgtcccattgatgtgactttgcaggtgggacctatatcgttcaggggacatagactgacagtgcatcaaatatggctctccagcctgctgtcagatctcaggtttcccaattcagttagaataacagactctactccttgtttttggagtgatagctgagggaagtgtgcctaatttgtcttggtttttctagcaaccagactggtagcattcattcaccccacagaatgagaggggaggtgggaaagacgtctgatggtgttgacaggtgatttgcatgggaggttcaggagctggtgccatctcctgtttctagacttctctggtaaggttaagtgaaatggaaaaaaggaatgtctggggaagtcagacacagcacgcagttaactttaagacacttgcaacactttgagagacatacaaggacatttccttggggaggaaagatgtcagggtggcatggaaaaacaaaagctcatgaatgtatcttgcccctctatttatttcagagttgaaggtgttccctctccaggaatacctgttgttgttccccttctattaccacaagattagtgggtcccattacgatcactaaaatttttctttctttccatcaactcctaaactttacacaagaacattttatccataagagtatattaggagggacaagggaagttttataaagagagacccattatgttttcgactatggcctgcatatactactatcagtggattcaaagagcagcgtgatccacaattgagtttgaatccctaaggcctcctttggacaggctgccaactggagggcatagcgaccagggcagcctgcagttgctggcagggaaagtaaagagaaattctcaatgtttaaaataggtatatatagcctccttgcatcttattcgctacctaagagccagctgagagggtatgctccttttctggggacagcaaaattcagggaccaaattgccttactaagatatgtgaaccatgtggaggtgagggaggcagagacataaatctttttgagtttattttttaagagccaatcccaatgcccaacaatatcagattcttgtgggtggtcgggagcatgaaaagtgcttaactaccttgccggccaacacattactgagtagattaggtgataaaaagtgcactgttgtcagagtgcaaatagcccaaagagctaaacatatgacacagattagttttaaacggtacagtgatgctgtcagagacagctggtaaaactggaacagtggcagcattaccagaaaaagtctcaatagaggtttgtagctcaaggtgctcatgagggttgtggagtcccacaggtaggagatgtgacacaacttgctgagtggcttccaaatcagtctgttggtttagttgagttgtaaaggaccaaggagaatgcctaagtggggaatatactctctccaatacccaaagaatgcaataagattttgggcctacattttggtggtaagaatcaaagagatagcagtttttcttcactgttagagagataagcattgtaaatccacctgcatagctctaagaaatatagtaaacaggggctgggcacagtggctcatgcctgtaatcccagcatcttgggaggctgaggcaggcgggtcatgaggttaggagttcgagactagcctggccaatatggtgaaaccccatctgtactaaaaatacaaaaattagacgggcatggtggcgtgtgcctgtaatcccagctattcaggaggctgagggaggctgaggcaggagaatcgctttaacctgggaggcagaggttgcagtaagctgagatcatgccactgcactctagcctgggtggcagagcaagactctgtctcaaaaaaaaaaaaaaaagaaagaaagaaatacactgaacagatgccaaactttgttagagtttatcagccatctcttctgacagaggtgtaataatactgtagtcagagtcatggagatagaggctttggacttgccaaacaacagggtatcatctgcataggaaaagctttaggcatttaaggtttgttaaagttatccagagaattacaacccatagggtacatagatagatagatagatagatagatagatagatagatagatagatagatagatagatatgaggagatttattataggaattgagtcacgtggtaatggaggctaacaagtaccaagatctgttgtccacaagcaggaaagtcaggaaagatgatgatataattcagtccgtggcccaaggtgtgagagtcaagggccagatggttaagtcccagatgtgagtccaaaaccctgagtggaatgagtgctgatgtcagagggcagaagatagatgtctcaagcagagagaggcaatttgcactgcctaggccttttttattctatccagaccctcaaccaataggatgatgcccacccacattggtgagagggtcttctgtactcagtccaccaattcaaatgctcatcccttctggaaacatcctcatagtcatgcccagaaataatgtttgaccatctatatggtatcccttagcccattcagatttacacatgaaattaaccattgtatgaagttacacacacctatttttggcaaacgataagaggtttccatctcccacaagaaaacttctttacacatgaatcttggctcactcatggtaagggagaatctcttctaccatttaccagataaaaaagtacaagtatatagcacatcactacctaatgtgaattcagatgtggaagtaagaatagcatgcattgaattggccccaaaagcctcacaggaaaggtcacgttggcttaccttccttattaccttttatagtgtaaaccctgcccagatattatcagttgaatccagtgccaccttctccaacagaaccagacataacagtgacttgggttgggtgcctgcatccaacacagtcttaaaagcttgtatcaccccctatcgcaaagttcttcagtataggtgaatgagtgtactgggccttctgtctcacttggagagagagaaaccttgagcccattgtcaagataacaacccttcctccccctgcccagaggttagtgagcaataaccaaccaaagcaccattggaacagtttgagccaaacctactgtccagacatgaaaaatatttttttttcttttttagggagagggtctttctctgtcacacagctagaatgcagtgatacaatcacaggccactgcagcctggaattccggggctcagtgatcctcctgcctcagcttcctgagtagctgggactacaggtgcacagtaccagcccagccacttttttttttatttttatttttgtgtagagatgggatctcactatgtttcccaaactggtctcaaactcctggcctcaaagtgctcctcctgccttgggttcccaaaatgctgggattacaggcataagccatgacacccagactaggcttgaaacttttaataacagagaatatggttgagcctttcactacccttgttcatgatttgggtgatataattcactactaggtcttctaatatggtctgtgagacttgtgttctttcacttacagaaagccacttctcagccagcatctcatcatcgttgccaaaaaccactagaactgtgaagggtctgaaaattttatcccatttgcaagatgctgcaatttcttggaggttggcagaagacatgataccctgggccagagacaaagaatattgtacttagtgcacgggcagcataatctttgatgttcgtgtcagttctcctttgctcacaagtcccgcaggggtaatgcacagtggcatagtttgatgttcttcacacattgattttgtgttgcagctaaggaaatcccaatattttctaaaagactgcaaacaatcccacccaacctttgctcatgcagagatattatctttttttactggacaggaaaaaaaccctcctctctcttctagaaggagacactacctctgtcttgcaactatatttcctaaacaaacaaaattgaatagataatacagaacaaaaggctgccagtgtctctgctcccacaaggcacagcaatacatcgggtacttgtcccccaacactacacaataatagggcaattctattaatattagacaaactagattttcacataaaagccatagaaaatggcggagagaattactacataatgattaatatgttaattctcctggaaaatctgatacaatagttccaatcatggaagtatataataaaatagtctcgagatatataaagcaatttttaccaggacaaactgtcatatctcaacggcacatagtgagattttagtactcttagtaattgatggagctatgggggaaaaaaaagttaatcttttcccctgccctccctggctcaaagtaaatcagaggggccccccagttggtgaaggggggaagggttgagctctctaatatagtcctgatggtaaacccacctgtatttaagaacatgggccatgtagttggaaaagttcctagaatttttatactacagaggaaggcagcaagaatgtaagactgattctattgcacatttaagaaaattggttgaacatataactaaatgtaagtttctcattcatggagaaagtatttacaaacatggaaaaaggcaatcggcaaagaatgttgacacattggattggcattgaggaaggcagtctcatgtgcagtcttctgacccccactcatccacataaagatgggccatgagcctggaacacatccttaccgagagatagggaggccacacagcctgtgcttggcttagcaccttgtgtgggagtatctcttcctgtttcaaatgtaatgagtgttcctttgttctgcttaagcatgcacctcggtggcccccaggcaggcccaaagctttctggatttcagattacatgtaagagaggatgggtccttctactgcagcaggaaacaggtgcacatcagttgccttgtgtcagctgctggagggtccattagccatgggtgggggcagggcacaaacacactgaagccgatcttgctctgtctcttcttgatgtgagtaaagcattgtttcttccagggctgccttgtgaaaatttcccttggtgactcccatattaagaagcaatagacagaagtgtgtagggttctcccctgagattgataacccactctctgtttcactttatcctcatgtttcttcctttttatactcactttcctatagaaacttactcttaataatgttctaactgctctgattaacagttccttcctcttcgctatgccaccattgccaggacttcttcccaaatgtgtgatctgggccctggtgtcagatgtacacattttcttgaagtgagtcaacagagggcattttagggctcaggaaatcatggctttttaggttaatccctcagatttactcaaggggagactttacacagaggaaacactatgttttatgtgtttgtataattgtgccaaagctaaattcaccagctcttgcccatctttctcatttagaaatcccaaaatatactgttgctaccagtgcataaaacagtttggtgaccattgatcatttcacatgtatcttggttataaaaatagtacatattttaaaataagcccttggtatttcttaagcataataaacaaggaatttcttcacattttatatattttaaagcagttaatgtaacaatttagttatgtaaaccacatagacattgaaatgtatgtacaagctatcacacttcagtatttttatgtttgggtaaccattgaaatcatctactactttgaagtattcaaagtcttttctttgttagctaaacttaaccttctgccctgaatctttccgctacttgcattctttttttacaatgcatcccttcttgcttactcccattcttttaaaaaattgactctcatttatatctgtatagttaatttcttctgaaatgctatactcatgaccttctattctcatcttattttttattatttttaacaacacttgtatctctttgaaaaatcctcttagttgttatttggcaaatctcgtattatatactaaggtaaataataaaaaatgtaagttaagagtaagtaaaaatgattttattaatcatatgtatcataccaataattaaacaacctatttttataggttttattttacttgaagctattttaattgaaagcaacattaatctggaataattcaaacaagaattttgatttgaatgacaaagtttaattaaacaaataaaatgaaattattataagataaacctactagccttttgatctttccatttttaaaatttattacattttgaagtttaggatcatccatgtgtccagttgttttctttttggcattttctgatattccactgcaggctattgtgagctttgtgtcaaatgagaaatttttgcagagtattttgaggtgtgtttagttttgggagaaaaataaaatattcgtattaataattcctgtttggaaaattagagatatactggtccagaggatatagtacatctgagagaatgggtttagtaaggtaagggttaggtatggttttgttactttttttcccggaagttctccttggtcagttaatctggttaccaactggagcagtattttaacttgttcgtgactacatgacaaggattgcacacttactaacctgggttgtcgtgtccttacttcctcatctcagcttagttagcttaaattcaactagttctttacaattgccagtttctagatgccattttgaatgcctaaagtttgaagtataaggtaaaatgaaaaattaacttgtatatctgtgagccttagagactgcttgaattaagaactttaatattctcaggactctgtgggtccatttctcattttcagtttgcctaggagcacctatgctcacatctctagtgttacccttgcaaagggcttgcctctcttccctctgactgaattaagaaagcaggaacatgactctcacctgccctatggcacaagattttttttccctgtggtggggccagtatgatatattattaatataacattttgtgatataaaaagaagtttttcgaagtcaagtttctggtgagaaaaggaaatgctcctccaatgaagcagggtgttattccgtgatgaaatgtagagtgttccacaaagagaaaaatggtgtagtgtccactgtggtgcagagggtttttaatgttgttactatgtttaacttcctgtgtgtgtatgtatgctgcaattaagacattttgtgcaaatgatatatcctgattgaatgaacaaatggatttaaggctggagtcctcatttcctcctgtggttatgtttgaatggagaacaccattcaatagggatcagaagaactttagtgaacggtgttttcttgggaaagggttagctacagctgaatatgaggaatgctgtttatgagagttcaaagcatgtctttgatattggctatttagagcattaaaaatataatacattagtcagtccaagatagattaaaatggggaataaaaaagtgactcatgacattccatattttctgatttgtttttcacttgaatgaaaatttgtattgctaccataagaaaataacattgctgctatttctattgctgattacatacttgttctacattagaactataaaatagtgcttgaatcccatttcagccctatatttttttatcagttgcataagctctctaaacttcacttgaaaaatttattgtaaaaatatgtcttgtttttatgatcaaaagaataatacatctaaactgcttaacacagtgtttgacatatagtagtgcctcagtgaaagtaggctattgtcaactgtatcttttctcgctttagctgatttgtattttctggtttctctagataattaagttggtttgtagaattgttattgacagttggtttgtagaattgttattttatatggattactttagtgaatgcccaagaaaaaattcctaagggaaatatggaagggatcttgagaattgaattaaccctttcattgccttacagtagactaatgcctaatcaaggcttctcagtctaggcactgttgacatttggggccagataaatctttgttctggcaggggggttgtcctttgcattgtaagatgtttagcagcattcctggcttctaactagtagatgcccaaacaatcactctcccttctgcctccagttgtgacaaacaaaattgtctcaaatgtcaattttgacatttgaggggggagtgaaattatccccagctgaaaacctctgctttaagccatgtagcagggccatgatgatttcatcagtttgaaagctggtaacaacagcctgtcgcagtgtttgctgaccctgaaggttgggctctttttcatatgccgcatttttttccaataatatgatcatattttcttcaatcctcttattaaacaaatgactgtaaaataactttccgtgactagtgtcaaaatcattctgcaggcttgcttttcacaagaactcgtaacttaagtgatctcaatactcggggtcttagataatcaggaaagcattaatcatgtctttctctacattatttgcattttttggtaattatagactaatgagcatgccctttatgtgatattttagttcacatatacctttataaatatttcagcttcgtggtaattaagtaaattgaacattattaattagaaatgcaatcagtgggtatagctaaaaaatattttaaagtagcattttttaatgtcctaatattctttgagtaaaattctccatggaatttttttccaattttaattcataagtaaataaaactaagtagctttctgataaaaagtagctaaaatcatatgattatatacaaagggcatatttgctatacatctgattctgttattctttatagaaatgcatagaaaaaaaggtgttgagtagaatcattctgaaatcatttcacatataaagtaacttttgcaaagctataattttatcatttcatgaaaatcataaagacagctttgaaattttaaattgtaattatgccaaagaaagctacaagctgaaacatattttgatgaagaattaaccaaatttttataaagattatgtaattctcttgtaagttattctcctagtgcctaatgatataaaaaatgaatcatcaacttttgggcagaaaatatgattcctgttattaataaactaatagttgttgtatgtttgttgttcattcaagtattagccaggcttttatgttgtttatattttaaaaatcactactaaataaactacatttaaagcataaatgagtgtggtataacacatctatgaagggagataaacatatattcaaatggtaaaatgtaatattagctataattaatattgacttttggctttgtctgctcctataccactcacagttgctcctgaactttccttaaattatgtcatgaatcagaattattatatgagaaagttcagggttctgaaatattaagttaacagaagatacagtgcagaatattaaatttgaagttataattcatttggctttcattaaaacattcataattgcttaactatttatgtctaccttcgaatagattttggacttttaaattacatttaaaaatgcactgtgattttactgacaaaatcttttttttcaatttttgaagcattgaataatgaaaaataacaataccattgaaagtgttctcttgaaaggatgaatatgctactataaacatgttcaaagtccttaataatttttaatcatttgttgcagggctcgttaagaatttcaactgtccattaaggagtcacttgacaagaaaaaataaaaatattgtagagacatgagtaatctgattagctattgggtgcattcggtgcttcttgatatcagctaaagctgaattaaattagtcactggtgcatttgtcgattggagccagaaagtctaccctatttaattttaaaatcattttctctgagtaaattatggcagtagccaccaaagaagtcatattacttcagaattagcaagatctatttcttttagagtaggaagataattattgactcttaaaagatggagcacacataggctcaaaataaagggatggatggaggaagatttaccaagcaaatggagagcaaaaaaagaaggggttgcaatcctaatctctgataaaacagactttaaatcaacaaagatcaaaaatgacaaagaagggcattacatggtggtaaagggatcaatgcaacaagaagagctactatcctaaatatatgagtacccaatacaggagtaccccgattcataaaacaagttcttagagacctgcaaagagacttagactcccacacaataataatgggagactttaacacctcattgtcaatcttagacagatcaacgagacagaaaattaacaaggatattcaggacttgaactcagctctggaccaagcggacctaatagacatctgtagaactctccaccccaaatcaacagaatataaattcttagcaacacatcacactttttctaaaattgaccacataactgggagtataatttttaatcatgtcaaatatacagttataaaatattattctagaaataaatgaaaaatacttaggcttaaaattctaccaggagtaatgtttacaaagaaaatcaagccagatataagtaaaactaaactaagaagttagccaacaaatgaaaatatcatgtgtcatagtatttttgattgtttaagagtattcagcttttactagcatttaccgagagcctggttcatgatagctactgcgtggggaaaaactggctgtttggttcttaaaactctggaaattaggtatcattatcccagattttttaatgggaaaattgaggctgagagcatttgagcaactagccctaaatgttacttttaggagatggtactcagaagatttagattcaggcattcctctcttctagaccacttatttatctttttccattacctgtgtggtggaatcagaaatgcactgtcatcaccatcttaagtgctttcaatcctgtggtcatacaagcaccgaagagaggcatgctatactgttttttgtaaaacaagtgaaataaactctggggcttgtagaaacgtaagatatgtgacaatatcttattacaaatgcacatttattccaatgtaagacctatgggaagttcagtctaaaaaccatttgcacacgaggattagagagacactaagcacatcatcacaccaaaaatatatgtgaaatatatatacatacagagtatattatataaaggctacataaatatttggtttattttgtatgtaaatatatatgtttgttctctatgtgtatgaatgtgtgtttgagctatggtgctatgtttgtggaaaatcacaagtaactatagaactatttaatgaacacatcaatttacatatatatattttacaattctttgcctgggggatacaagatgggccatttgatgctgtgcaagtcactggctaaagactgatgcatagagtctctgtagccaaaacttagagtccaataagtaagagaagacatgcttacttaagtaaccaaaaaccgagattatatttgagaagctcaagagatgtactgtcaaactctatgtcatgcgtctctccatttgattctaaaatgttctactcatgtcatataatagatctgacaaactaagaatgacttttaaacctattatatttctcagtgactgttcaccaaaatgatacccaaagcaactgcatttctgcctcttttacgaagtagtaatactctacataagtgtgtaatattgcactttagtattggagacgtattacctggtggaaaaatctccaaattatatgcatcaaaaattacctttctttctaaaaatttcttgagttttactgatataactaaagcatttgaattactttttttttctctttttatacagtgcaaactagaatatcaggcatgtgtcttaggaaaacagatctcagtcaaatgtgaaggacattgcccatgtccttcagataagcccaccagtacaagcagaaatgttaagagaggtaagtgacaaaaatatatttataattttacattcatcactctctactaaaatgttttgcaatagatgttgtcattaaatacacaatgaagtttgtttttatacaaatacccaatatcatttatatttttattgaagatattttcctgttagcctcaactattatagcaagaaatgattttctttagatttctatttattttgatagtaataactagatacttctttcctatgtgctcatcatatataagaaatctaaaccaatgcattctataaacagttgtgtctaaaacatgtgttttatatcatttttttcttttagagcagaaaactgattattgataaagtagtaagtaattaagtggtttgatcagatctgcaactgctcagtcaattaatactaaccattttaaataaagatgtctaccccatgtatacagctggtgtttcataatttcctgtgtaataattttataagttaaacttttttttgaccagatgaagtctttaattcattgtttttattggtttactatctaataaaaataaaatgcattcaactagatatgtactataatatataacttgacttaagattatttattatagtttacatggtatcattattatatttgaaatattgtttatgcctttttaaaaagtctccatggctgctagctccagccctcagcacctctagataaagaaggaagtgtggagaatagatgcttaagtcaaaaaatattttacagcattagagcactgtcatcaacagttatataatttattactattgaactcttctaatctaataattattattggatgcccttattagtgtggataagtaatttttgccctttttcctaaaaaatgtgaagaatggatatgcaaataggaaaaacgtattgagtatgaaatttctttaatataaacttatgtatttcattgagcatgatatacttgttattccatattaaagtaccacataaatattttattacagatataacttccaaacttcagttatgccacttatattggtattaactctttaagaaatatttaagatgaaaaaacaaaataaaactaaatgttatagcattacctttaagagagactatttttattattcaaaaataaattagccgatttgaaaattaatggtaaattagtgctcaatcattagatcctgtgaagaatgacaccagttggtagaagagagatgccacgctgcctttcaggagctctcttctttttttttttttttccataagttattggggcacaggtggtatttggctgcatgagtaagttctttagtggtgatttgtaagatcctggcccacccatcacccgagcagtataaactgcaacatatatgttgcccaggagccctgttctttaagcctcatccttgctgacatgccccagtctaagtttaactacccagtgtggttccttctgtagtcctcagccctcatctcctccaatccactctcttcaacacagcccaaataaggactttcagtaccaccttgaatatactaattagcccccagataatcaaaaagctacttgtggtttccttttaactgaaattctttgatgtttgtgccttcctcattcccacttctgatggagtacattttcacaattaaattgaagacaaaactgaccacatttatctttggaaatcacttcaggtgggaaacaaatcctaccaggttcactatccatgagccagttttttcactgaaggctattaagaacaacatttgagatgtggtcatagtaagtgtatatctctaatgtatcacagactttgaaaaagactttacttcaatgagatttcccgcttttaaactttgttttgaatgaaaaggtattgctgatgtagtattaatttatgataaccaatcacaagctgcaaaaggaactctatgtgcattaaagatggaaggtagcacatctgagaagaggatctcttgtgaataaacaataattatttttcatattgtcaaattttctgtatagtgtgtatattaatatatcaagaaagaaacttttaaaagtcatatcatcaagggataaagatcatttgtgttcaattgtgcgtagaaagagaggcaagaagaatttaaactaatcctcctctgacaaattgtcagggcaacgcaagtacaggattttgctacctgctgtggaaaagcagtacagtcaattttgagtgtcatttctacacagtgccaaaggctgagagacaggggaaatataaaactgagtttagtatcatttctaatctttcaactgtcatttacattagaagcatgccttaggtagactgtgcagtgcaggaaattctatttaatatcttctctgttctagaaaaagtgaggaataaactaccaacaatgagatatttcttaaatctttctgacttcctatatttaaggtcaaattagcaccatagtatgttttcctatgttaagatcagaatctttaaatctacttgaaatgcattaaaactaataaatatagattttcttcataaagtatgaataaataaagtttttctctatttctctaatgtacttattaagaaatgtgcataaattggtccaaatacatacattcaagtattttaaataaataaaaacagataaattccatgttttaaaccctagattctgactttacataagtagataagcatacacccttcagttagtaacttagctatacagttttctcattttctaactcataaatttagtattacacaggccagtgttttgcagtccctttaatggattccctccttttcttccatctttttttgttaacgtactgttcaattgcaaataaaaaagtattatttgtaaagtagatcaaattcattcaaaggatattgacatttcagctgatttttagaggcctctaatatttttatggccaggaaaatgtgagattcatagttgtgagcatggtctatgaatagaccattttctacagattttatgtatgtgtataaaatgcaatcctaagaattagaaaggacttgcaaaacaaaagttcattgaaaaagaacattgaaaaatattgtagaaagcatttatttttaagtaggatttttctaccctagacaaatcttaaattgtctacacaacaatggtacataagcacagtaaactttagacatatgacacatctaaagtgctccattggtttactcatttcactggttagagtcaaaagatcattttaattaacattttctgtttgtttcaaatctgggtattccaaagttcaaactacttttcttatgattatgagttttatggttttatatatctaacctcttaaaatttaattcatttcaaattatatcattttgaatattttaaccccaacatgcatttaaacacatactctttatgcaccttgtagtttgaattgttgagtttcagtgaagcctgaatagagaaggaaaataacctattttaaaaagtaacaggtgaagctgggtaaaaaaggaggaagtagaaaaggaacgtggaatcctaaaggccttgggcaccttcaagaaagccatcccttgcttctaggatacagagtactttcaaggaggatacagtgcaaatcggtcattgccagacatgaagctttggaattaatttatctgagtcaaacatatgaaaatgtttatgttcttgagcaaagagttaacatttccaaaactgtttttctaagttttacttgaaaagagttaacagtttctagtaaatcttagagaaatttattatgttactgagacaatttttttgtttgtttgtttgaagttggggtgggtggttattttagaaataaggcaaccaagtcccagcaaggatactagatgaagaaataacaggaaaaattgaattggggtaatattgctgagatgaaattcacaaggctttaaatccaattgcatatgatggacaaggaaaaagaatccctctaagattattctgaatttagtaatctgggtgatttatagaatgctaaccaaaaggactagcttatttttctggacctgtggtttgtaattcctactaatcctcatctgcatttttaaaaatactagaggtttcttttattgggagctgagaatcatgtaacatcatatttctcgttttgccttattcatataactctgttatcctacatactagactttaatactaagtgtgtgtgtgtgtgtgtgtgtgtgtgtgtttaaccagtttatggaatttctttctggtttgtgcattgttatcctgtggagagcctaacttattcattaagggtataaattttagaattccagtccttcactgctgtgtggttcttagctatatacttaagtttatgagtctcatttcttcaactgtaaaatataaaatatataaatcattaggatttatggatgtatttcctcaaatttaaccaactttgcatttctatttcatttcaaaagattatacctgtaaaatgctgctgaatcctagtaaattacataactttttcacatattaaatgccatttgtaattttatttctggtgcttttaacatcatattgggtggtaaaaattgaagagatttaattttttctatacttaatagtatgtatttgcatattttgcaaaatatttgtacattgagagcttgaaacaactcatcagtacaatcctttagcctgaaagttattatcggtcattttttttttcatttttttttttgttgttgttgttgagatggagtctcgctctttcatccaggccaactgcagtggcgctatcttggctcactgcaagctccacctcccgggttcacgccatcctcctgcctcagcctcccgagtagctgggacaacaggtgccagccaccacgcccggttaattttttgtatttttagtagagacggggtttcactgtgttagccaggttgatctcgatctcctgtataggtcattttctttgacaagtctttcacattctttcatagctactagccattgcaacatatatttccagacacagagagagggatatgtagccatgtatgtagttatatactgcttcttgatacaattactagtctaaatgtacattataatattttgtaattaaaaacagcttttctaggtgatctaggtcatcaggaaagataatagtgaactaccatgtggacacatttgttaatgcctgtactcccattcctttatgttttagcggttataattttgtgacattatttaaattttcttaaattctttagtacttgatttttgacaatttctatcagaatgtgtgtattaaaatgcaaattaggcactgttaaaagaaagcagttttaatgattcatatgctgttgtcacgagttactaaaagacatttgtttcaaaccttggcccttgatgtgagctacgcatttctaagtacaatgggtccagcaataaagtacaaaaatcttgtgcttgcttttattctttattgggacccacaccagacacaagtttgagacagatttgtaatgagtccttctcacttcagagatcattggtacccatgaaattttggtatgaggtcagagatcattcaacaaccacaacataaacaaaaagatagctgtttatttaacaaaagatatctcatctgagactgattgtattatttgtaaatggatgtggggacaatgagtataggtttgtaatcattagcttcctttccatattaaactgcaaagcctgataatttttatttacagtatgacaaggtatgggactgagttattctataatctgacacagtcattttttccattattcatttcagtactctgagtgctatggaaccctatcaagaaacaaagtttatttcattattgtgctatgattataagttaactgatttaaggaaaaagtattattgattaagaattaatgtatgccattttccaagtgacaaataatttagttttaacgtttaattttgtatgatggaatttttttatatcctctgaattatggaatggattttcaatgagaaacagattaacatcagtgtattaatatactcttgcaacatgcatgcttctccgtaactaatatagtgtattcataaatggtaagttcttctgtaattttgtttaattggagccatggaaaaataaaattaagtcagtttattggcaagtgttgcataattatttataataaaaattaagttttactcatttggattatttgaaatacattcttggattaaattaatgtgtctgaaaacagaacataacctgaaagaggagttttcaatgtcttctctgaagactatttttgtgttaaataatgaatttcatattttacacaaatattttacattatctgtgaaactgatgttggactaaattttaacttccctactaattttacttagaaattttgaattttgagcttatgtagttgtatgttatcagatataaaagtgaaaaatagctctgtattaattcttgtagcactaaaggacgtttaaacttattccttctttaactcctttccaatacataatatggcatgttcttttaagacaactatttacaaaatgcagtataagcactcacctaaaagcagtggtcatagtcaaaatatttaacaggtttgaactgggtcccgacaaatcacaattgatgcaagcccagacagcaccatggtacagtgtggtttggccagaagatgaaatcagaaactgagcatttcttggtttaaaatggatatgttgagatatattaagaggttgatatttgtgaactcttttcctgagatctgtatgttaagatgaatacatttcttgaaaaagcacataaaattaccctggagggagtgatactgtttttcagactatctctacactttaacttatatcatgctgaccttagcttaagtgtgctttacacatgttaattctaatgtagaaaccacatgccattcaagcttattacaaggaaggagacaaataataattatatgcacacaaataatagtgcaaaatcaaatattatttctataatgcacatggctgtcatccccctttccacccagtacgtatcttaaaaaatatgatctaccacatattcaacagcatttacttgtaccaatattaaatataatgtacgataataaggagatgtttgctattccacttctagtataggacgtattagctttccaaatatataaataaggtcaattgatttgtatttagatcttctgtgaaatccttttgtgcatggaagattaatgaaatatttgaagtttagcatcacacattctgaacagtctcttaaaatgatatttgagcttatagtttctttatgtaacttagcagcttaaaaaagtctaggaggatttcaggatctcatgataattttaagcctcaagataagaaaggaaagcaaagttaaggcagtatttacagagcctcataaagaaattgttgatttgatatttcagaaataggaaaaaattctcaaagactgtcaattttagatatagtacaaatattatctatgttttgtggagcgaaaataaatcatgaagccatattgaattaaaagtaataaataaaaatgaattctttttctgtaaaatatatttgatacaagtaagttagttgaagtaaagacactgtatgtacaattctatgcttttttattttgtaattatactttgaaatcacttggttaattactattaatcaatttactacattaatttatcgtaggaataaatcatttctgttatggatatatcattttctgttatttgcaaataacaaactttagacattttgcaagtgactaaataagaaaaggaaaaaaaatgcaattatgtgactgatgtttctatttacatgttaatgtaaactatgcctgtgaattttttaatttcaaaaacattacaaaagtaaaattgtattacattttattctatataacaactaatttaaaagtatatgttgaaagtttgtatggttttctgagtttttacttcttttcagtattagattatttagaaatcatattacaaaggtctatgaatagatagggaataatataacaaagatgtaatatatttagcaaattattgaacataccagtccacaaagattttcagtgaattcaacatttatgaggaatgttatatatggatttttaaatacttaatgagggatatataaaggttaaaccggatggttcaagaatggaggagcatgagcagttaggaagttggtaagaattgaggcttgaaatgattgtgattaaaatattagagataggaagcagatgatagattcaagaaatgtttaggaagctaaatggttatgccttgtcgattgactttaggaaaggagaggagaattaatgataactcctgagaagattatggtgataaaaccgagatggaaaaattgttagagaatcaaacgacatgggaaagttgttaagttcaatattggacacagtgtttttaaggtgtcaatggccaaaccaagtatagacacatttgcctttacacatctaagagaagtagtctgggttcttctaaagtaaacgctggagaatttacaggtaatacatcaaatcatgagagtgaacaaaatccactgagggacagaaagtgagaaaagcagtggctcagttctggaaaagactatacatgcatgggtcagaaaaggaagaagaatctgtggaggacttaaggagaaacaggagagaacagtgtaccagaagctgaggaataattctgacttgaaagagataaagagcttgactcttgactacagaaggaatgttcagtaatatgacacctgagaaatgaccacagacttcagctattagaatatcagtagtaactatagaaaaagcaacctcagtctaccaggagttcaataaaataaagtgaacaaattacttggcatatatagtaggtatctgtattagtctgttcttgcacttccataaataaatacctgagattggtaatttataaagaaaagaggtttaattggctcacggttctgcaggctgtacaggaagcatcagggcttctgcagctcaggaggcctcaggaaatttacaatcatggtagaaggcaaaggggaagcaggcatgtcttacatggccagaacaggaggcagagagagaagagggagatggtacacacttttaaacaaccagatcttatgagaactcgggacagtacccaggggaaaactgcccccatgatccaatcacctcccgccagatctcacctccaacattggagattaaaatccaacaagagatatgagctgggacacagatccaaaccatatcagtattcaataaatgtttcttctcccactggtcttccatcccccattcccaacatataatttgtttcagtggagttcaaagaacacagtacaaatgtaaaatatgagggaaagtggtgaaaataacatttatctggcatctactatatgcaaggtaatttgcctttgtcatttcatttagttctcaaaatatgtacatattttttaaatcttacacttttttttagagacaaagtcttgctatgtttcccaggttggtctcaaagtcctggtctcaagtgatcctcccacctcagcctcctgagtagctagaactataagtgcacgccaccatgcctggctaatttatttttatttttatttttgtagagacaggatctcagtatgttgctcaggctggtttctaaatcctggcctcaagtgatcctcttacctcaggctcccaaagcgctgggattacaggcatgagccatcatgatcatgcctggctataactcttattggtaaaccagctgggaacatgaggaaactgaagttccaaagtgaagagacatttccttaatttaaaatagttgccagatagtctttctgccttctccatctacactctgcatatatattttttttaattaacaggctgattttaccccaggtttgtcacttttctaaattttggttaagattcttaaatttgttaaacataaatccatagccattttaaagtaaaagggctagattaatatcattttgcccttattagtatatgctggacactcctttagctgcatgtattatttaaatgtcttatttcatctagtcctcacaaagccctaggatgtggatgctatttgtatccttgcttcactttacaaatgattaacctgagccacggataagttaagtaaccagtctaaagtcacacaactaataagcaccaaagcaaggttttgaagcgatgattgctgcctcctaattacagtgtcttaccagccctttggagtctctctttctgttatggtcacaggtcatgtgctccttcaataacagtatataattttggtgatatgtgtgaaataacttagagtatttgtattatttttaccaagcagagatatataaagaattgacattgtatttttaaaatgaacttactacaagctatgagttaaatatacattttaaagattttttatacatttaaaatatacattttatacatttaaaatatacatataaaatatacatataaaatatacattttaaaaattttaaaaatttattggcctatgttgcctatgattttggccaacttcttatagtgtatatatttgggagccaaattttcatgaaatattacataataaacattctgagatgccaacaagtaaacatgcatcatttatttttctctccttagaagtgttgtttataactttgtttcaattattttttgagatggagtcttgctctgtagcccagggtggattgcagtggcgtgatctcggcccactgcaaccttcgccacccgggttcaagcaattctcctgcctcagcctcctgaatagctgggattacaggcatgtgccaattcgcccagataatttttgtattttttttagtagagatggggtttcaccatgttggccaggctggtctcgactcctgacctcaggtgatccacctgcctcggcctcccaaagtgctgagattacaggcatgagccaccgcgcccggccattttgtttatatctttcctggtagcatttttcatatttccaaggtgatgcaggatgatagctatggtagcaatagatgatttacttaatgtattactaattaatcttttctgtgcatttcttgtaaagtatatttataccaaatttctacttattggcaaaattattactgtttctactatttttacataattagtaacatcagttaaatgtaaaatcacttgtaatgaagttgttactacaaacaaaaaaatcagttcaagaattttaatatatttttcccaaatcatctctaagaatgaaagtatggtttatctctgaacaaaaatgacctgttaatgagaacttttacattatagtgtactctgaaatggattgtggaaacattttacctcctgcttactgttcttttgagattttcattcttttttcttctatccctaccaaagatctagtatttaatagcacttgatttaaatactgttacatttgcctaataatacgtttatatttatttgtatttagcttatgttttctgaacgtgagagctctaattgcttttattttctgtaatggaactctttacttaaaatttggcagttttaacaccataaaagaaatatctcaactctaataacagaatttacccaaagcaagaataatcaaggaatgttcaatgataccagagaaaatagctgcagagaaatctactttttgaatcacaatcagtaagtctaaaatggctctgaaaggttcagaattttggtttctataggagaatattttgacacaaaataatttgtgtacatggtaaaatactaactagtacaaatcaaaatataatgagatcaactgttcttgcacaaaccctttaaatcctgttttattgattagaggtagccactttaaccactatggtatttcattcttttggttgtttctattgtaactttgatgtgtgtatcccttcactgataatgtatcaattagagacaatatttactattttgaaaaataaatatttatcttatttctctaccccaaacttcccatagtgaaaataaattattattaaagttatctcactgataatttttaacctttcaataaatgtaaacttttttcttgtttcatcaagttcagaaaagtgtcaccagcacccttaattttgcaacaagttctgctcattcatctcgacttccttcacctacatatattttatgttttttacacttaaatatttaactaaaacaagtcttccatgattagtctggagtttgatactaaatgttaaaaatcaaaagatactattaatatcgtttgtaaataatttttgctataatatagtatattatgctctatatacatgttcatcaccactataaaatgctgtacatccttgtgccaataaaactagaatgccaagacctgatggatcatctattcaacattatcgtttgcttaaaatcatgccaaattttagttaacatgatatttgatatttttctgcttttacttttatgtgtatttattttatgctgattgttttccccaggccataagtttttgtttcttcagtttcttaactctcttccacggagcttctaaatagctttctttttcatcaagaggaaagaaaaaattccattgccatattttcaaaattctttagtctcaaattgtaagaaaacaccagtcacattcgcagcggtatgtaggaaagcagttcttcacagtgttcccacaagtcttgaactaccttcccaagcaaacattcttggaataatgtttcccttcaagtgagtgggtggagttattgaattaggctataacaaagcccctcacttctctgaggagatttgtttaattctcgcggtagtaaagataatgccttcttccaaggcaacagcgagttaagtttgctcccaatcccatataggttgtgcttttcctgagccccgtgctcctcagctgtgccacagatctgtgtgctccgccttccactgggctcctgttgcttctgtgtgacttgagggggcaatgggaattcatgtgaacaagaagaagcttttgctacctgctgtgccatgagtagtaaactgtctacattctttcagagttgtttcaattactgaccaaatttctgaaaatgtggtaacatcacagctttctgctgcctagaaaccgcttgctcttcacttggcactttgtctattctagacctttctacattctgatccagtccagtcctgtctggtcctaaacctgcacaaattctcatctgtaacacttgtaatttccgctcctagtttatgtccataattactctaatttaatattttccattttcttatattgtctcctttggttttcttcactacagctatatgccttaatattttcttaaagagggtgtgggtatggtaaactttttaggagcttcaatatcagacaactctttattttgaacatagaattgttaaatagtatggtaaatagaatttaataccggataaaatagcatatttcctcagtatgtgaacgctttgatcatttgtcttctagcttctaatattgtagacagcaataatattatttacattatagaaaatgatgtatgaataactgaaaggaatatcatgattaagtatttcaccattaaaattaataatatagacaaaaatatcacacctactagaaaatctgaggctatataaactaacttgggatttttgaactattaactttttctagaagtaaatattttaataatacatagtttcagcttcttattttttaaatatgcaaaagtgttgcagaaaagtgatactgattatcaaaagtaataaccaacctatcataaatatttatatggcattagtgatttacatattgtaaatatgacaaatatatctatatgtcctttaaaaaacttgtagatcactcactcctctatgagataattttcttaaagattttagccatatgtaagcatagcacaaactaaggtgcacagttatttgtttaagacaaaaatgtcttacaatatgggcagactagaacaactttctgatattctagtctatttatataaatagaaggtattgacataattacttaactaggtcaggcaaaagagttactattaaaattctactactttagggattactttttccaataagatattaaatttgcatctgccctaatttctgtcattttgcatatacgtcatgtaccaaatacaattctacaatctacttttccaaaacttttgattatcataaagtcttctatttaaaacccaagtgtccagggagtcacttgattcctgtatttaaactcacagttgtaggggccacacatgtgtgtgcttacatggtgatactgccactgacctgaagtttgacattgaggagattagcaattacatgctaattcagtttcctcttctacaatgtaggtaaagtaaaatccactgagtatttgtgaagatcaaattgaatacacagatacgatgtccttagcacgttatataaataatcaattctacttatcaaagacctatatttttcaagggtctgatgctttttccctacttggaagctaacaagcctgcctgccacaatctcacagatgctggcagcatacaggagactttgaaatcagagatataggactctgattgttgttcacaagaacttcttgcttgcgttcattctccttggtcacaagctcacaggtgggattcagctcaggagaatgctgtatacatggtggggttgagtattagctgaggaacgccaagcttaggtaacccccatccttataaagaggatagtagcaaacttgtacaacctctaccccagagaaagacattatctttaccattctggaaagcaacagattttgttctctcccctgcatggcgacactacttcaatctcccaagatcatttgctatacatgcatcttcaaaatgacagtctgggacaaaagctactacaaggtgcatgtacacacgagagacacttgggaaattgttcttaacaatattattatcaaatccattccttcttctgagtgaatacccacatgcttttgagatctttgatgccaatttgccttcctctttttcctttagaatctgtcccttttgtttctattgagttctatacccttccccaactaccaacctatgttcttagcatctacagtgcctagtgtagagaaaataattgttcaaattaaatgagttgagtttatgaatttattggtcaggaatcaaactaatttagtagtaacagggaatcttaaagaaaggacatcagaatttatctacactatgattctcaaagtccaatatatatctcctataagtatttgaaatgaaaactttcattttcattaaaataggctttatttgtgccgcagtttatgttcacaacaatatagagcagaaggtacagcgatttaacatataacccatacatccacacatgtatagcctcttccattatcaacatcctccatcatactgcaattgcatcatttgctgcaattgatgaagctattgatatatcattatcacccaaagttcatagtttacattcaggttcactcttgttattgtacatattatgggcttggagaaatttataatgacaagtatcagtcattgtggtattatacaaagtagttcattgccataaaaatactttgtgctctaccttttcatccctctcttctccaagccctggaaaccactgatgtttttttttttttttaacttcttcatcactcttcttttccagaatgtcattgctttggtttggtttgtccccaccaaaactcatgttgaaatttgattcccagtctggtggtgttgggaggtgagggctagtggaaagtatatgggtcatagcagcagatccctcatggagactaatgccctccgaaaggcgtgaatgagctctccctctctccatgatggatgagttcttgagaaagaaggttgttaaaaagactctgccttcccctgttcctctttcttgcttcctttttcaccaggtgatcgctttacacatgccaccttcccttctgcattccaccaggaattgaagcagcataagaccctcaccagatacagatgcccaattttgaacttgccaaccaccagaatcatgagccaaataaagctctttgtttaaataaactgtccaatctcaggtattctgttacagcaacaaaaaaataactaagacattcatatagttagaatcatacactatgcagcctttcatattggctcctttcacttagtgatgtttatttaagtttctttgatgtcctttcatggcttgatagctcatttctatttggtgttggagaatactgctttgtctgaatgccccactgtatttatccatttacatactgaaggatatcttggtttcttccaagttttggcaaccgtgagtaaaactcttataaacatccatgtacaggtttttgtatggacataagtttatgtgtatacccatatgtatagtttgtttttgtttttccgtcttgagtttcagtttgtcattgctagtgtttaggaggctcactttatatcctgcaacgatgctaaattagcttattaatttcaggagacttttgtagattctttagcattttctatgtagccagtaatgttgttagtgaataaagataattttatttctctatatcctatatgtatactttctaccttctgttacatattctattactcattcttgtcttattacactactaggacttttactgtactgtttaatatgagtgatgagaggatatttttcttgttctgaaccttaggggaaaatttttcagtttgtcataattaaaatacttaagattatatatatatatgtgtgtgtgtgtgtgtgtgtatgtttgtgtgtttgtgtgtgtgtgtgccctttattagatagagaaagtttttctttataccttgttttgtcaagagtgggtattaaactttgttaaattacttttctgcctcaattggtatgctcaatttttttttcttatttggtattctaatatgttacattgcattgatttattaatgctgaaccaggcttacttcttggaatactgcttactctttttatattgttttatatataaaataatttattaatatttttaaatatttttttgctaaaatatcataagatattttagtttgtaattttcttgtaatgtctttatctggcattagtattagggcaaagactgtcttatattatttgtagtgtttctttctcttcaaatttctggaagattttgtgcagaatttgtaattgtttttttctaaatgttccatagaattcaccactgaagtaccttggcagatcttttctttgtttgcaacgttttaaccaagtgttcaatttttacaatagatatacggttattcagattatgtattgctccttaaaagagttttggtggtttgagtctgccaaggacatggtttgttttactaaaattatcaaatttatgagcatatagctgttcataatactatcttgttatccttttaatgtctatgaaagcagtagtgacgaccctttggtctgtcccaatattgctaattttgccctctttttatttcttggttaattcatctctatgcttctcaattttattgatcttttcaaagaatcaccttttggtttcattgattttatttattgatttattgttttagttacattgacttctgtttttttattatcattttcttccttttacttgtttatatttaattttttcttctttctctagtctcttgaggtggaattgtattagtccattctcacactgctataaagaaatgcctcagactgggtaatttatacaagaaagaggttcaattgactcacgattccacatggctggggaggcctcaggaaacttacaatcatgatggaaggcaaaggggaagcaaggaccttctttacatggtggcaggagagacaagtgtgagcaggggtaatgccagatgcttataaaaccatcagatcttgtgagaacttactcactatcatgagaagagcatgggggtaccatccccatgatccaatcacctcccaccacatccctccctcgacatgtgggaattatggggattataattcaagatgagatttgagtggggacacagtcaaactatatcaggaaacttaggttatcttcttttctaacatatctattcaatgcaataaatttccctctaaacacttctttatgtttcaaaaatttttatgagttgtattttcatttagctctaagtaatttttagtttttcttcagacttcatcttgacttgtgggttacttagaattattttgtttaattataaaatatttagggctttttcaactatctctcttattgatttctagttttattcttttgtgttctaagaatatacttaatatcgtttttattatattacatttttattgtgtgttttatggcccagaatgtattctgtcttggtgaacgttccatgcacattttagaagaatttgggtttgggatggagtattctgtaaatatccattagactgacaagattggtggcactttttaggtccccgatacacttactaatttttttgtgctttatcagttactgataaatgttgaagtcttcaactataatagtgccactatcaacttattactttgatagctttggttccaactaagctgatctcagctgtccctcttttatgggagtagagcagaattcccatccctgaaatgggatactggaccagcattgccctctggtgaagtccttctcctaaagaccagggattcattagtgagaatagtctaagaagatttcatgatagccacacttcctttccttcttccagggtcatgtggagaactttctcagatcctccccatgaggacatcgtagggttcctagaggacaaactgtaaaatgtgagcctttgattgtagccccaggagcttctcagtttcaagctggatcacactcagcctccagcaattaataaaaattactgtttaagtgtttctacttgtttatggcattcatcaacttatgctttaagtaaaaaatccgaggtgctgtatctctatgaaattgcccgactctccagatttcgtgtgatgatttgccctataatatcagttatctgaagggtgccaaaagagtcagtgttttccagtttcttcaggttttcttagtataagtatgggaatgactttgaagctccttacatgttggaggtaaaactgtaaatctcaaacacacacacacacacacacacacacacacacacacacacagaattctattggttataattacataatgtactggtgtataatgctatcagttgccttttgaatacaaagatggcactgtgactcagtgtaaactgtttttactagacatggtgccatttctttcatataaatattgtagatgttatagtattgttatcttctcacccagattttctggaaaccaagagcacaaatatgccaaaaagctgtgctccttgagggtttagtttggagctctgagagagaaaagggagagccaaggatcttaatttccctggtttacttagatggccttatgcctactgctttaagacttttgactatataatttggcatgtgtttaactctgattgcttgaactgaaaagaccaacatatcagcaatttacattttgtgaaattagcagcactgtccttttagctattcctgctgatcctgcaagatcaggcaccagagagtcctcccaggcatttgtctgtggttgctcagttgagtcaaatggagagctctgctccattagcctgggagcagctttgtaattttctgaataattaatgaaaacaccaacagttctcccatctaactaaacatttggttttaattgattttcttagcatacagttctttaaaactttatttccaaaaattaggcttgattatcaaaactataaatttcgttgaagccactaatgtctaaacataaaatcatgctagtacatcatagcatagaaaaaaaagataatagagaaattttgtaaattttggccagagaccattccgtttaatttaaataggccctgattccaagtagtttgagaaatgtacacatagcatgtagccattgttttattttcgcgggattaagtgaagaaaattatattgatatagtttgactttttcaacaatgttgtccttttcttcttatgtttaaatagataaaagtatgcataagctagattactgtttctcagagaaatgtgagttttcctggatttattttatgatctatacttgaatactatggtcatcctcctgagattacctggacataggttttaagaaaattcaacttcatacttccaaattagttcaggtgacactcagtgtaagatttatactcattgtaagatttaattttttagagacagggtcatactgtgttgcccagggtggagttcactggcacaatcataaaccatacctcaccatagcctctattcctgggcctacgcaatcctcccaccccagcctcctgattagctacagttgcaggcctgtgcccccatgcctaggtttttttttttcttttcttttctttttttttgtagagataaggtcttgctatgttgcacaggctggtttcaaactcccggtctcatgtgatcctcccatctcaccatctcagcctcccaaattgttgcgattacatgtgtgagccatggcacctgggtaatttttaaattttgcttccagaatgtgtaactagagtagcaagaaacaacaaaaactcaaaattatatagtggtttgcagttagctaatttatttccttaaaattacaactgaaatggaaataaagaagtttaaattctcaaaacttatttttaaaataatgccatttatttcttaatccaacaaatcaaatggtagatgtaccatatacatatactatatacatataaaagtaattaaatttaaattaaatttaaaacaaactttttttctggaacatatatatgttggcagtcaagaatatttttacttcaacataatgtgtttctcaatttcagtttttcctttcacaaattagtatctggtacttaagattaaaaacatcataatacttttatggcctaatttatatgcctactattaatgttttgtaactatgcctaaatataattattttatattacctttatatgagcatatactacacatttgcctaatctttaaaaccattaaataatttacctgtaattaattatttttacttatttaatataattcattagtcaataatcatttaaaatttagccaaataacttttccaaaattagggaattcatttctagtgtattatgcttataaaccattcatctcaacatgtgattacttattaaataataatagtgactgttttatgataatcatagtagcttaaactcagacttcatttgtactgaaacctgtccattatatcctataattttaaataacattttctttttctcacgagtatggaacactcttctctatctctttctcatgcatattaaaactttatggatggaaaatataaaaataacttccatcactttatccgagaaattattatcattattatctttatagttattattattgtgatattcatccagaatgtcagaggaaacagtaatttgaaataagactgtagactgtgttattccacagaatctcactaaatcacttcactctcaattctgcaaactgtgcattaaaatgatgccttcatcagatgtcttctttactcttcttatatggggcttctaacttaggttaagcttgcagagaggaaggttcaatttgtttgctcttagtagctccagagtcatggtctaatttagttagaactgaagtattcatgattatatttattcagaagctcagttttgtgtacgataaataatttgttttaaggatcatgtttttaactatatttatcttgaagtatttcaacctagaaataacacggacatgcaatatggagttgatgaggtaataatgcattcatgaagattaaaaatgattttcaatagagaaacctatttatatttgcaggtatttcattagctcatttctgattggaaatataatactttccggagtatatccttttgaaatactcaattttcataaaagttgtcaaccagactcctagtttgatcataagttaatactatactccatcttacttctcttttgagaagtgtctgttcatatcctttgcccactttttgattgagtcattttcttttttcttgtaaatttgtttaagttccttgtagactctggatattagacatttgtcagatagatagattgaaaacattttctcccattctgaagtttgcctgttcactctgatgatagtttcttttgctgtgcagaagctctttagtttaattagatcccatttgtcaattttggcttttgctgcaattgcttttggggttttagtcatgaagtctttgcccatttctatgtcctgaatggtattgcctaggttttcttctagggtttttatggttttaggttttacacttaagtctttaatccatcttgagataatttttgtataaggtgtgaggaagaggtccagtttctgttttctgcatatggctagccagttttcccagcaccatttattaaatagggaatcctttccccattgcttgtttttgtagggtttattgaagatcagatggttgtagatgtgtggtgttatttctgaggcccctgttctgttgcattggtctatatatctgtcttggtaccagtaccatgctgttttggttaccatagccttgcagtattctgtgaagtcaggtagcaatgatgcctccagctttgttcttttgtttaggactgtcttggctacaaggggtcttctttagttccatatgaaatttaaagtagttttttctaattctgtgaagaaagccaatggtagcatgatggggatagcattgaatctgtaaatcactttgggcaatatggccattttcatgatattgattcttcctatccatgagcatggaatgtttttccatttgtttgtgtcctctcttatttccttgagctgtggtttgtagttctccttgaagaggtcctttatgtcccttgtaagttgtattcctaggtattttattccctttgtagcaattgtgaatgggagttcactcatgatttggctctctgtttgtctgttattggtgtataggaatgcttgtgatttttgcacattggttttctatcctgagactttgctgaagttgcttatcagtttaaggagtttttggcctgagatggtagggttttctaaatatacaatcatgtcatctgcaaacagagacactttgacttcctctctttatatttgaaaaactttatttctttctcttgcctcattgccctggccagagtttccaatactatgttgaataggagtggtgagagagggcatctttgtcttgtgccggtttcaaagggaattcttccagctattgcccattcaatttgatattggctataggtttgtcataaatagctcttattattttgaaatatgttccatcaatacctggtttattgagagtttttagcatgaaagaatgttgaattttatcgaaggccttttctgcatctattgagataatcatgtggtttttgtcattggttctgtttatgtgatagattacttttattgatttgtatgttgaaccagccttgcatcctagggatgaagccgacttggttgtggtggataagctttttgatgtgctgctgggtttggcttgccagtgttttattagggatttttgcgtcaatattcatcagggatattggcctggaattttctttttttgttatgtgtctgccaggttttggtatcagggtgatgctggcctcataaaataagttagggagggctccctctttttctttcatttggaagaatttcagaaggaatggtaccagatcctctttgtacctctggtagaatttggctgtgaatccatctggtcctgagctttttttttgttggtaggctattaattactgcctcaatttcagaacttgttattggtctattcagggatttgacttcttcctggtttagtcttgggaggttgtatgtgtgcaggaatttattcatttcttctagattttctcgtttatttgtgtagaggtgtttatagcattctctgatggtagtttgtatttctgtgggatcagtggtgatctcccctttatcatttttattgtgtctatttgattcttctctcttttcttctttattattcttgctaatggtctatgtattttgttaatcttttacaaaaacaggcttctagattcatggatgttttgaaaggtttttcgtgtctctatctccttcagttcttccctgatcttagctatttcttgtcttctgctagcttttgaaattgtttgcttttgcttctctagttcttttaaccgtgatgtccagtgtgtcaatttcagatctttccagccttctgatatgggcatttaatgctataaatttccctcttaacactgctttagctgtgtcctagagattctggtacgttgtctctttgttctcattggtttcaaataacttcattatttctgccttaattttgttatttacccagcagtcattcaagagcaggttgttcaatttccatgtagttgtgtggttttgagtgaatttcttaatcttgagttctaatttgattgcactgtggtctgagagacggttacaatttccattcttttgcatttgctgagaagtgttttacttccaattgtgtggtcaattttagaatatgtgctgtgtggtgctgagaagaatgtatattctgttgatttggggtggagagttctgtagatatctattagttctgcttggtccagagctgagttcaaatcctgaatatcctacttaattttctgcctcattgatttgtctaatattgacagtcaggtcttaaagtctctcactattattgtgtaggagtctaagtctctttgcaggtctctaagaacttgctttatgaatctgagtgctcctgtattggatgcatatatatttaggatagttagctcttcttgttgcattgatccctttaccattatgttctgcctttgtcttttttgatctttgttggtttaaagtctgttttatcagagactaggattgcaacccctgctttttttttgctttccatttgcttggtaaatattcctccatcactttatttttaagtctatgtgtgtctttgaatgtgagatgagtctcctgaatacagcccactgatgggtcttgactctttatccaatttgccagtctctatcttttaattggggcatttggcccatttacatttaaggttaatattgttatgtatgaatttgatcctatcatcatgatgccatctggttattttgcacattcgttgatgcaatttctttataatgtcattggtctttgtattttggtgtgtttttgcagtggctggtagtggtttttcctttccatgtttagtggatgtgaatatggaaagagctcctttccatattcaggagctcttgtaaggcaggcctggtggtacaaaatccctcagcatttgcttgtctgtaaaggattttatttctcctttgcttatgaagcttagtttggctggatatgaaattctgggttgaaaattgttttctttaagaatgttgaatattgacccccactctcttttggcttgtagggtttcggcagagagatccactgttagtctgatgggcttcactttgtaggtaatctgacctttctctctggctgcccttaacattttttccttcatttcaaacttggagaatctgacgattatgtgtctacaggttgttcttcttgaggattatcttagtggtattctctgtatttcctgaatttgaaggaataattttaagtatataaaaattataatatttgtgaccacaaattgtaaatgataatacaaataaaaccaatgagtaaacataaaagttatgtgataaatagtaaatgcttgttgaaagctcttgaaagaaaaataatgataaggatttagttcaatcttcatttttacttgacttatctgctagaaaaggggaaaaatcagcatcatcaaataaaatgatttgtgtagtattaacaaagcattttattgactttttaatggctactcaggaagattaagtcattttcccaatatttatgtatttaacaaacatgacaaatatttgtaaaagagaacacttaaaatgtttaaagtttagattattttgtaatgtaagataaaaaagttagtagcaatactaactcttaaccaaaattggttatttttcttatactctctcaatgtcatgtcacttgtgtatgagcccatgaatttgacaggtgcattccctctttgttactttttattcaatttgctacattcaagtctttttcatagttttactggcttcctattttttatttttttttctttccaagactcctaacttggttaccttcaaacatcccaaggcacaaaagccatatcaagttcatcgagtaggaagcctacttcccacctgctttttctaaatttaattactgcacttattttctaggcttctatttctgtcttttgatccaatctgaacctacttgctgcatgaactcctgaatttatacacacttaagcatcatttaaattgctgtgctaaaaaatacagccaactaaaagtgccaaggaaaaacttaatttgattaagcaaaatatctattgaacaaaatgccatcattcagatttgctaggatacactgtaaatttctagaagggcaaaagggaataaaatactatctggggattgctaaagtggagctaatggatccacagatgtaaaagcaaattattataatatagaaaagcaaaaggaagagtgtgaagaggaatcccacaccagacaaatgttgaaaaaatttgcagctgctgccaaaaaactctactttgtagggactttcctgaagttttcattgcaacacagattgcagttaaaatgtccaatcagaaaaggaaatgtctaatcaggctcttaggaaccccagtatgttgtggatgaccagcatgagttcagaggtcagttcttcagggaagtgctgcctattggagcacctggctggagagagccacacataaatagcacaggaagggcaatcgggatcctgcacactacaaaggaaatttatttcactttaatcttcaacaaacgtattgctcaaggcactcttggcattatatttaaacatctactgaaatgggttattttgccatttttaagaagtgctgacctagaattttgaagtggaattcaataaattgggatttgcttttatccaagtatatctaagcacacatgtttttagtattgctagtaagagactttgagaaatacagaaaggcaggagagagagaaaaaaagagagagagagagattgactggttgctacttaacctaaactacgtgagagaaagactcttattcttttgcacagttgccttcaggacaggctcttatccaggtttttaattttatcatttacctttacatgatcatattctgtggcttgaaatcaaactaattaaatgtgttgcttactgcacttatcatatggaaaggcctatatgtagacattctcctagtggagattgaatcagagtcatggcttttggatgatcctaattgtttatcattctgagtcgggagaactaattactgcagctacttgcctaggaaacaaaaaccaataattgacagttaaggctcttcccattaaaatatttatgtgcagtggtacccaaaataataattttattccagacgttatagtgttcccagtaaagactgagaatcaccaaacccacattataacaagtattctatgaggtttacaaagcaattaaacatggagttatattttatgcatatatatatatacatatatatatatatgaatttgtgtgtgcatgtacacgtgtgttttcctgtgttctgagtgaggaatgtagtgggaggttctgaaacacctccagtctcttcccatcatctacttattaacccttagtaataagtggtgttgagaagtgtatgtatgctgggcctcttctatcttcctgattctttattgaatgtgtgtatgatatatcaaacatcatttgcactccttgatcattgattttgcttgcactcctttatcattgattttacacaatttaagtatgcatctcagtatttctatttgcagcacttaaacatttataatagtctcattaactatttaaagtctctctagctctctctcctctttctcgcttcctttttaaaatttgttttaaagctgtgtccctcatgttttctcacagtggtgtaaaaaattctattgctgctaaatttttcagtaataaaaaattttcctgaataattatacttaaaatgtctctaccccaggtaagaggtgatcagcaatatgatacttatcaaacaaaagattctaatgcaaacaacaccatcctggctaaataggcatcaatgctaatgtgatcattccatgcataatcttccctagagagccctaaaaattcactgtcaatagatttcttttatttgacttacaacactctaggtgatatgataccagctacgcctgattcataagaacacagaaagtctgtcactcattcctgcatagttgagtgacttgcagttgtattagattatcttacgttctcttacattccagtggcaagataaattctagtcactgtggttaacctaaataggttatggtcttcttgatagatactggtaaatatttgctcttgtcaccgatacatttgtaaactctcttcacagattacttataaaatataggatacttctgctgttgttgactgtgtaggattttcctagaatgtctttggaaagtgttattttcaaatgtggtgccctatttctgaagatgtgtcctatttagtacaaggaaccccctggatgctaattatccttaaaacattccccttctgatctttctttacaaagaaaaattatagtttgtctattttcccaaggcccgttgagtgaattatctgattcataataataattttattccagtcgattataagacacgtgaattttctaagaaagctcatatactggcatatgtgtgtgattacaaatataaaaatgctctggcactaaaaatagtcactgtttatcatatgttgtatctattgtgtgtcaaatattagctgaaatatccaagaccagtttgttttctttgtaattgatgattaaagaagagtaaatacatttgtgcaattttaaactcaagttgacttaatagaattgctcccacagaatagatgtggttaagacataaacctctattagaaataatatcagtgtttattttttatatttgtatatcagtctaggccttctacatgtctatgtttatgtatatttttataatacttaataacagaactatattttgagaaatgggtcaggacgtgatttcttcattgtgcaaacaacatggagtgcacttacataaacctagatggcatagcctgctgcacatctaggctatatggtatagcctattgctcctaggctacaaacttgtacagcatggtaactgcactgaatactgtagacaattgtaacacaatggtaagtatttatgcttttaaacatatctagagataaaaaaggtaaagcattgtgctataatgtgacaacctctattacattaccaggggatacaaatttttcagctccactataattttaggggaccaccattgaatatgcagccagctgttgactgaaatgttatgtgacttgtgactgtgtatatacatatagcaaattgtgtgagtgtgtctgtgtgtataaatttatttctgctcacaatgaaaagagcccaacagtgagcaggaagaaaataatgtgcttgtatttgtttcattttaaaaatattgttacatttttgctcgtgtagtacctcagctgatagtcctcctctgtcttcttataatttttctgaattattttattttcaattttagtaaatgatctccattccacatgtatgatcacatttttatgcttgatattaaatacaacatatttgcagggagtttaaagttacctctacttgatatttatcaaaaatctgttactgaaagttaagacactgtggcagatgcagtttaggaaaactctagatttattgtagcccaagaagtcttagcctatttactctgtacttacatgctatactatgaggtaaaggcaaataagtaccataaaaatatggagacaaaattgtgttgaagtttagaagaaatcagaatgggcttaatagaagagtcaccatttgacatagaccaaagattgcatattgagatagaagcatggagaatgtagacagagcaaagaaccctatgaaattcacagcaataagatttcacaaggagtttgggaaaatagggagccttccaaattctcagtagaattatttatacctgatgctgccagatactaactcttatctatgtggtattaaattgggtctgaaatggtcagtgagtataatggaagaaatcacattctattaaaataaatctatcaagtatcgctcatacccaagtgctgtgctaggtactacaggaatacacataaccatatattgtccatgttctacataattatattacaaagccagctttgttaatgttagaattcaaaatgttggctaaaagaattggccagggttagttttacttttggactataggttgaggagaatttattccattgtaatgttatccccaagatacatagaaaaggagaatacaattataagaaaataggataatatagatcactgctttttggcaaggcaaaagggctaaaagcctaaccatgtacaaacaaatccctgaaggactgtggttagcctgtctggcagacaattcctatactactttctcagcatatgaatgagttacttgaatgactttatatttggagctggaaagacataaattttatctgtgaaatatcttcagaaaagtttttttcttagtatattcaaaccacttataatagaaaatttaaattcaacttttaaattttcttccaagttttacctcagttgcaggaaagaagatgactctgaaattcctatcttcagttatttgttgaacaagtttgggtccaagacacactgggacctccataatggatgaaaagaaagcctagttcactttagataaatgaaataccgaagctggagcaacaagactttccagctggctcatgcagatttctgaaggtctctgtccagcagaatcccccttgtgcccaactgtgtcccccatttggtacaggcctctacacccaccagtgtgaatgcagctcagcttcctgccagaggtggggtctgagccttgggcggtgatatggtggccacattccctgaggagctcagtgcagctcttgttgaccgttgagtgaagaccatgctatctgcatgagtgagctggataaacagagagaaactaccacttaaaattcttaaaactttaaaagacaaactatcttccatatgtaaatatgatatcatttacccattgtagagtcagaacaagaagtcagtgtctctgagtaactcattttacccttgaatcctgcctagatgtgacttcagatgatatgatgccttgtatttggttagtgcagcagatgtaggaatccaggcatggctttgtagaattagaaaatcaaactgccaaagaaaaatactgctttagtgtacatatgatttcaattcagtcaatttttattgacctactaatgggcaagacactctttttttccagtcgattgcatatctatctatatatagagagatatctagatatctagatatctagatagatagatagatagatagatagataatttttttgagaagtgccttgctctgtcacctaggctggagtgcagtggcaagatctcggctcaatgcaacctccgcctcccgggttcaagcaattctcctgcctcagccccctgagtagctgggtctacaggcacatgtcaccacaccctgctaatttttgtagttttagtaaagacagggtttcaccatgttggccaggattgtcttgatctcctgacctcgtgatccacccacctcggtctcccaaagtactgggattacagctgtgagccaccgtgcctggccgactgtatatatttttatgatttttaaatgacaaataacaattacatatatttatggggtaaaatatgatgtacaatgtattcattacagaatgatcaaattgggctaattagcatagcctcaatattttatcatttctttgtggtaagaccattcaaaattccctcagctattttgaaatatacaaaacattattattaactacagtcaccatgctgtgcaatagaacatcagcactatttctcctatctaatggaaactttgtgcccattggccaacttctcccctatttctacccactccacttcctcctcctcctcctcctcctcctcccctcagtctctggtaaccaccatttcattctttacttctgtgagttcagcttttttagactccacatataaatgagatcatgccatatttgtctttctttctgtctgccatacttatcttgctgtacctgccatatttgtctttctgtacctgtcacttaacataatctcccctacattaatccatttaaccttttcaatagtcttccactagaatgtaaacttgatgagaaaagatgatttgtcttccttgcccttgtaactcctaccccataagagtgtcaaaatgtgttccccagataatcaggatcagcatcacctgagaaagtgttagaaacttggtagaattagaaatacaaatttccaggcccctccccacacctaatgaatcagaaactcaagaaacaggggtccagaaatttgtgttttaattaccctctgagtgattctgatgtaagattttcctggcacatgatgcataaactacaagttaaaggaattaagtaaggttaaataagagtggtagtagtgaaaagacagtaagaaccacattttttgttttttttcttttttcctgtgcatacaaaatattgaataaaggcatttattttacagcgaaaatattttttcctgtgtataaagagtagctgacccaatttaataagaaacagtttgtactacatggaaaaatgttggttaaaatttcagagcaatcaggagctggtgctaaccctgtgttaccaataaagatcagctgcttttagggaaaaaaatagagtcgctttgtctctgtaggtggctatttctctctgctctctttggtttgtatatcacaggttgctgtgaacttaagctgcatttttttttattttttgtctgtatgttttaaaaatttatgttgcatttctcaatgaaatgtcaagatcataaaaatttgtgtgagaagtgctgagctgattgttggggggtcagggggaaacttttctcttggccctctgaagatttgctgaaaattcactgacagcaaatttcactgttctctttgacagtgtataagtctgttctggtgtggttacattctggttttaaaggaaaaggaaaacaattgttcgcagggatggttgtggatcttaggcagataaaggaacatcaacttctttgagacaggcagtggggcgggatacagttagagactttgaggattcttcagttcagcatgtcaatgcattacggtttggagtattggtttctgagtcccaacgtaatactcctggtgataacagtagaaagaactttcctagcacttgatcaacagaaaaaatgcactcaccccttagaagctgctcagggattgtatgtatttttgtgtgtgtgtgagttttgtcaacagctcattaacttattaattacctcttggctattagaattccaactggaaaacagttttgctgtatctgaaactctccagcctctctccacctccaaaaatccccttcctacttaattgagtcaacagtataattttgataacatatttttcagtaattaaattcttaagttatataaaaatagcatacattattttaaatattatggacagtctataatatgattgacagaaatcttgagatgaattatagctgatgatgaggctgtacatttttacaaagttttttaacaaagaatccaatttattgtagctatttgtgtatttcttaattattctgttcagtgaacaaagctgaacaaacagtaccaaacataatctgttagttaaatcaggatttggacaattgaaaatagaatatgtttgtatttaaaatcaaatcacatatttattcagagtttattgtgtacagattaccatgttaaagtactgttggaaaacaaaatgaatatcagaatcctcctctcacatcaagaatctgcacaaaacatgaacaccaatgcaatgaaattctaacattctaaggtttgctgatgtaggacagtactcttctttgctttgggagggagagtttatttacgtataagttcaatatatctataatggttagaatgctactaagaaatgcaaaatatattgagttgagctatgtgaagttgcctttttgtaggtaaaaatcatagaatatcagaaatttcatattgctcaaactaacattgttttaaaaggctgatttacattttgtagaaaatggtgctttgtttttggctaattttgttattgattctgtctatggccgactttggagaccatctttttttctttttttttttgagagagagtcttcctctgtcgcccagggtggagtgcagtgatgtgatctcagctcactgcaacctccgccttctgggttcaagctattctcatgcctcagcctctcaagtagctgagattacaggcacgtgccaccatgcccagctagtttagtatttttagtagagatggctttttgccatgttggccaggctggtctggaactcctggcctcaagtgatccacctacctctgcctctctgagtgctgggattacaggagtgagtcactgtgcccagcccaccatacaactgttatttagttcattacccatcctgtaaaatgctttgaaaacttctgagtgaaaaattgagagagagttttaatgcctttgtgaacaccaaattaaaaggtgttattgtgaccttgaatagttgtttcagtttcaaaagaaaatatggtcctctatgaaaataatttataaaaataagaggagatcagcatgtaggaaaaattttacgctgcttaatatttccatttttatgttataaaattgatgtaaaccatttagaaaaaagtcttcatacttattcttacaataaaataactattcacctatcttacatttgactttgaatttcacctattaccagttttagttcttcttctattactgttttttgtgttgaataaatttaaaaatatgtcttaattttcagaaatactagcaacctatttcaatatctaaatggatacaattttaaatgtgacatcaaattttagattttttcctttgagaatttgtaattttggagttgatattaggtctttattttataaaagaaaaaaaatcacatcataaaagtaagaagaaaataaccagcctagaaactgaggttaaaactgaaagctgcttacatctagtccaaaggtggtctcactaattcagacttttacaggcagttcatatacttcttttctcatggttatgttaatattttaataccagcaataaaatgtaacagttaccattttaataatatgttttgagactttcttctactttattcaatcccacacaatgtttccatatcctgtatatacctctttcctttaaaacctctgctaacttctgtcatctaaagaatgaagttcctagatttggaaaggggaggtttatttctcattaaggtttgttgcatgcagggtgccatactgacagcctgggaagcatagcctctggtcagaagctagaaacaaacactttgaggaaggaaagaacaagatggggatttgtgactggacagaatccctctatggttggtggtctcttatcagaaaagaatgctagttggttgttttatggaaaccacagtagagcagggcagtgtcaggagtggtacaggtctttccaaagggttcgtttctgtttaactcttagtgaagaaagcctaatggtggttagggatggagggggtttaatgggtcctgtctgacctcctatcctatcatggcagcacctcagttttcaaggtttctctggaatcccctttgccaggagaagaaattcaaatttcttttttttaattattattattattatttttatactttaagttttagggtacatgtgcacaatgtgcaggttagttacatatgtatacatgtgccatgctggtgtgctgcacccactaactcgtcatctagcattaggcatatctcccaatgctatcgctcccccctccccacaacccacaacagttcccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccaatctatcattgttggacatttgggttggttccaagtctttgctattgtgaataatgccgcaataaacatacgtgtgcatgtgtctttatagcagcatgatttatagtcttttgggtacatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactccatcagctcctttaagcacttctctgtattggttattctagttatacattcttctaaatttttttcaaagttttcaacttctttgcctttggtttgaatttcctcctgtagctcggagtaatttgatcatctgaagccttcttctctcagctcgtcaaagtcattctccgtccagctttgttccgttgctggtgaggaactgcgttcctttgcaggaggagaggcgctctgctttttagagtttccagtttttctgctctatcttttccccatctttgtggttttatctacttttggtctttgatgatggtgatgtacagatgggtttttggtgtggatatcctttctgtttgttagttttccttctaacagacaggaccctcagctgcaggtctgttggagtacccggccgtgtgaggtgtcagtctgcccctgctagggagtgcctcccagttaggctgctcgggggtcaggggttagggacccacttgaggaggcagtctgccagttctcagatctccagctgcgtgctgggagaaccactgctctcttcaaagctgtcagacagggacatttaagtctgcagaggttactgctgtcttttcgtttgtctgtgccctgcccccagaggtggagcctacagaggcaggcaggcctccttaagctgttgtgggctccacccagttcgagcttcctggctgctttgtttacctaagcaagcctgggcaatggtgggcacccctcccccagcctcgctgccaccttgcagtttgatctcagactgctgtgctagcaatcagtgagactctgtgggtgtaggaccctccgagccaggtgcgggatataatctcctgttgcaccgttttttaagcccgtcggaaaagcgcagtattcgggcgggagtgacccgattttccaggtgccgtctgtcacccctttctttgactacgaaagggaactccctgaccccttgcgcttcccgagtgaggcaatgcctcgccctgctttggctcgcgcacggtgcacgcacccagtgacctgcccccgctgtctggcactccctagtgagatgaacccggtacctcagatggaaatgcagaaatcacctgtcttctgcgttgctcacgctgggagctgtagatgggagctgttcctattcggccaccttggctcctcccgaaattcaaatttcttagcatcacattcagagtccttccaaatccagaaccctattatatcacaaatttattgcatagcactttaactctagacatcttttattccattcaaatttttttattaaaacatagcaaatgacccacattgagatacaccaccttagacacattcatatgtctactgcctactgtcaaaaaacagaaaataataagtgttgataaagatgcagagaaattggtacccttgtgtacagttgatgggaatgtaaaatgatgcaattgctatggaaaacaatatggcagttcctaaaataattaacaatagaattaccatatgatccagcaattccacttctgggatatacccctgcaaaaatgaaagcagagtctcaaagaaaaatgtgtagatctgtgttcatagtagcattctttccattatttaaaaggtgggaagcaatccaggtgtccattgagagataagtgaataaacaaaatgtgatatatacataaatgaaatattattagtcctttaaaaagttagagaattctggcacatgctacaatatggatgaacctcagggcattatgctaatgccagtcccagaaagataggtactatgattccacttacatgaggtagctaacacaaattcattgagacagaaagtagaatggtagttgacaggaactggggaagtaagggtgaatggagagttgctatttaatgagtacagagttgcagttttgcatgacgaaaattacattgttgtaattatacaacaatgtgaatgtacttaattctacagaaatgtgtgcataaaaaatgatgatgctggtaaattttatgttatgtgtatttcaacacaattaaaatagatgttttataatagtaaatgaatatagatgcctttaaatttcttgttctcttatgaaaccttccctggccaaacaagtattaaatgatttttctctaattgtgcctattattagtggtctctcctgtggggtgcagactccaagttacttacattacttttaatgacaaaaaaaaaccacacaattacttttgcatcaaccaaataagacaatccactatagtacagaatgaacagatttgaatttctttttatttttactaaatgaattaccatctcctttatatgtaatatacagactgacagaaatataaatgcacacacataaattatgtgtatagaaacaggaatgaatacaaaaaattcactgatcaagataccagctagttatcagccctttaaattgattgtatatactatttttctaacctacttgaaagactatatgcctcatttcaacaacccatagtctcaatgacaaggcctgtgttttagatattcatgtatttctaaattctctgaatatattcatgtgaaattaaaaaacaacaagttggtaaaatgttggcttctttacttacacgatttcttgagtttctgaataaaatgaagtctaatgatgcccatggtgttggtaaatattgaacagcaatcaacgacatagtttacatcacctgttagaataaagtagtaaacaaaattatccatgtgatagtacagaaagggtacaacattgcacttggaactaagggagtaacaaaaaggaggaaaacagtagcatacagggagaaattacaccaggaactatgcacatgccctcctcaaacactggccggcttgttggctcccagaatcttatcagtgatcacctgcacaagcgcctcacatttaagctctgaaccaaagagtagcaaatgtagatataatatattctgttagtacatacacaagagttcaaatgttgggtcacttttgttcatctgtttttgaaggcaagtacttacttcatgaggtatccaacctggaacactcaaagcacctggcagctcaccaaggatttcaaaagggaatgctttcctagtacatccagcaaaagacacttattgaccatttctctacattgtgttttatatctcagagcatttcaaaacatcactctagcaaaaagaattctgtctgccttagagccaactgattggccccaaggatgctggaaaccctgacagaggtaaacggcaggcaaatgttttagtattttttccccttttcctcaaattcaaagtttctgactcccttttctagtcaacaaaagtacatctatgctgtagtcatttgaagagttaattgatcaaagctctactgtactccatcagtttgtaagtaacttgcaatatgagcatttataaactttaatgcaagtaaatactgaaattattatggtagctataatgtactgcttcaaaactgaagtttggcttgttataattttttagaagtttccatgagaacaccaccatccaacattctgaattttaagaactattgtgtgtaatttgtaggaaacttgattgtgatttgattttgggttacaagccagatggtttctagctttgattttagtaggttcatgaaatgttcacagaatgcagatgatacaaatcttctgccagtttggctgcataactagaagtctttgaattattacgtgcttgacatctgaattatcaaaactttagtgatgttccttttgtttttctgttttatttcattgtatatagagcaatttctgcctaatcagtctttttaaagctgacctatacagagatggctggtgttggattattaaaataatcctgaaaattgtcattgcaagctgtaaaaaaaagtaaacatgattcttatatatatatatatatatatatatatatatataaactaggattttccttttgaattgtggcttaattttacccaaaaatgctctactttctccaaattctaggacagcatgaaggtagcttactaatgtgttatgagcataatctccagtgctgctcataccatcacaacactgtgtccaggtataaatatctgcatattcctgaacagagcatcaatgctttttccctcagaattgcaagtttagtgtattcaggtgccttatgatattagaaaatataacatcttgatatgttgcattcctcagaaacctttaatttatataaataattggcctgaaggcagaaattcagtaaatgtttaacaagtctccctatactacatatctgactgaataataaaataaaaggaatctccaaagttgcttagctcctcccaaatggcctgccaactggtaaatgaaaagcacttagcttgaaaaagaaacttacatctgtcttatttcctccatcatatgaccagacttttgcagtacaggatgacatatcagtcttccattttgatgtaaatgaatgcttgatttttgttttcttctttcacttttctttttaatagatctcttgatggctagtgggattattttgcttactcacagggtagcattttacttttgtcaaaaggcaactttttgacaaaattaagcacaggctttcttcctgtgagatagatttggtttaatgtactttataatttaaccacatttttggaacatttacctgggttgatactgttttgtgtacatttcttggaaaatcaggaatcaattttctttttaaatcttctggttcatttcttaaatatgtcattaaagactacaatattctgttaggctattgaaaatttttaaattgccttgcaaattaccagagacctaagaaattacacccaaatcattaaaatataaataaaacataacactacagtattaagctcttattatttacttagggtattacagtataccaatttcaggtatgtgaattaaagtgagctaatgtccaaaaataaaaacaggctttaaagtattttaccaactgtctgacaaaaatgtatgaccaatgatgttttggtttgtgcctcaaatattaaacattagacatcttttttgtcacttaggatgaatcacaaatattttttcaaccatatttattcctattcactgttaggatgtttggactacagtattagtccaaattaataaaaaggataatctattaatctacaatatctaaaattatatatgataatattacttacatttatatcatgtattttttacataatgaacaaatatgaatctgtcacttaaaaggcaaatgatagaaacatactaaacatttttttgctatattcttacacctttagtatattaatagcatttctctaattttccttcttagccataatccctggcagaccaaaaagaagtcaggtaccacataacaacgtttcagtcaaggatggatggcatatataaagatggtctcatagattataatggagctgaaatattcttatttcctagtgaggttatagccctcatttagtcttagctcaaagcattaccttttttatgtttagacttgtttagatgcacaaatagttaccattgtgttttaattgcctacactattcagtacaggagtacaaacttgctgtgcaagttcgtagcctagcagcaatagcttttaccatacagggtatactctctaggcttaggtaagtgcattctgtgatgttcacgaaaggaccaagtcacctcaggatgcatttctcataacctattcccataattaagtgacatgtgactgcataccattatacagctaattttattgcatcttaaagtaattttttgtcccattgctttaaaaatcacctagttaataacttggtgggaaaaattcagaagagggctttttagattacgtgtttgaagttgttgaactattgcttggtaattacaaaagagatgttctggccatttgcaaactgagctcccaaccctgttttctaccctctggtaaagttggtttgtttgttctcctagagacattgtttacaaaatagaaactacttcaaaattccttcaatcacttaaacagtactcaggaagtattttttttctgaaatatgagaaaaaatataagattataagttatagcacaaagtgaaatatttaacataatttaaagccacaattagatttgtagtttttttgtacaaggaagtgtagttgtatagggcatacggtttttctgctaaaatttcatatgcccagtgtcacttttttacattaataaacatgtattaaaatgaaaaatttattttggtttaccaattgttctttttgcaaatggttcagtcataaattgctaattattatatgatttcaacattttagaattataaaatatgatttcttgtagctaatttatccttatctgtgatatcacaaagattcataaattatttaatgtacaatattactgaataatgtgggttacagtagaaaattttatattgtttaacataattattttagattatagcaaattcaatcatgtttgtgaattgtcatactaggttacacctattaacaaatcttttacctttgataacagcacatgcatttgtattctgcctcagcaatccaaatatcaacaaagaaaaaaccacggacaggtaagattagaaccagatatcactaagcagagagctatttcagcatattttgagcaactatagtcaggaaaaatgatgatagttactcattgtatatacactgtattagccagggttctccagagagacaacaaataggatctaggtaggtaggcaggtagatagatagatacatagatagatatagatatagatgtagatatagatatgtatagagatgtatatctgtatagatatgtatatctatatctacatctatctatctttatctatacatatatcaagaaagagacagatagacagacagacagacactggcaggcaagacatccagaaaagtgttgcagtttgagtccaaggtggtctgctggcaagaagtcaaccttttgcttgtatggtcttcagctgattggacgaggctcaaccccactatgaagggtaatttctttactcagagtttactgatttaattgttaattgcatctaaaaaaatgccttcacagaaccatctagaattatgttttatcaaacatctggataccatggcctagccaggttgattcatagaatagactatgacataaagtatgtgctaagacatgtattacatcaatttcctgtagtcactacaaaaatactctaaggtaggcatatcataccctatttaaaggtgggggaaaagtggttaatataagtcgagtaactagtaaatgacagtggtagaatttgaactcaggtagccattctggtaccttttgtttatttgtttttgacccaaagaaacacaagacatcagtgggcttttctaagtaacttcccaaattgtagtggcttagaaccactttcagtctgggctggctcagccgcactctgttggcccacattgcgtttatgcttagctggttgctgggctggggctgaattgtctaaaatggacacattcacatacctggtcattagcgcaacgtaatctgggatgatgaggatagctaggccatgtttctcatcacctaggaaactagctcagccttttctacatgatgatctcagagtttcaagccccattatttaggatgctttcaagcctctgttcatgtcacctttggcaacatcccattgacaaaggaagttacattgccaaactagagagagagacatgtattattttcttattgcataacaaattacgacttagtggcttcaaacaacttgcatttagtacatcacagtttctgtagattcagagccaactggatcctttgcttgagtactcacaaggctgcaatcaagcatgggccagggctagggtcgtgtgggagtctcagggctgtctttcaagctcccagatggttggcagaatttatttccttgaaactacaagattcatggtggcttattttttcaagacgagtaagataatttttgctgctgtatcttgtcccttaattctacaccatttttaaatgactcactattaggtgaggtccaaacgtactgatgtcctttttgattaactcacagtcagctgattagagacttaattgcatctgcaagatcccttcacctttgccagataacataatctaatcatggtgagaggggacaatgtgctggtggccgtcgctcgctctcagcgcctcctctgcctcggcgtccgctctggccaagcttgagaagcccttcagcccacctctgccctgtgggagccaccctctgggctggccaaggctggagctggctccctctgtttgcgggggggtgtggagggagaggaactcgcgggccagtgcttgttctgggtgggcacgggcttggcgggccccgcactcagagcggctggcaggtcctaggcagtgaggggcttagcacccaggccagcagctgcggagggtgcgccaggccccccagcagcgccggcccactggggacacgctcgaattctcgccgggcctcagctgcctccccgcggggcagggctcaggatctgcagcctgccatgcctgactgtggggtcccccgcagcccaaaccccctcgatgggcaccatcccctgctacacagcacccggttccatctactgcccaaaggctgaggagtgcaggccggcagtgcgggactggcaggcagctccgcccacggctctggcacaggatccaccaggcgaagccagctgggctcctgagtcaggtggggacttgaagaacttttatgtctagccacaggattgtatatgcaccaatcagcactctgtgtttagctcagggttggtggatgtgccaatcagcactctgtaactagctactctggtggggacttggaaaacctttatgtctagttaaggattgtaaatacaccaatcagcactctgtgtctagctcaaggtttgtaaacacaccaatcagcaccttgtgtctagctcaaggtttgtaaatgcaccaatcagtgctctgtgtctagttaatctggtgaagacttggagaacttttatgtctagctagaggatagtaaatgcaccaatcagcactctgtgtctagcttagggattgtaaatgcaccaatcagcaccctgtcaaaagggaccaatcagctctctgtaaaatggaccaatcagctctctgtaaaatggaccaatcagcaggatatgggtggggccagataaggaataaaagcaggctgccagagccagcaaaagcaacgtgctgaagtcctcttcctcaccgtggaagctttgttcttttgttctttgcaataaatcttgctgctgctcactctttgggtccgcactgcctctatgagctataacactcactgcaaaggtctgcagcttcactcctaaggccagggagaccacaaacccacccggaggaatgaacaattcccgacgcaacgccttaagagccttaacactgactgagaaggtctgcagcttcactcctgaagccagcgagaccacagacccaccagaaggaagaaactccaaacatgtccgaacatcagaaggaacaaactacagacacaccatctttaaaaactgtaacactcatcgcaagggtccacggcttcattcttgaagtcagtgcaaccaagaacccaacgattttagacacaatgggagaaatatttcatcatagtcactgatgttgctcgtactcaagaaggcatcatataggctgtacagagcaggaggtaggagtgttggagaagttcttagaattctgccttccacaggcacaggggaagatttgtaatattactttgcaataacatgtatgcaaaagggcatttatggacatttttataattttccatagtaagaaatgaaagcaaattaaggaaggccatatttataagaactagtgaaaagtgacagacacaaaaataagagctagaaagtacaagaaaactaaataggtttaaatttggaagaagcagagaatgattccttattttttaacaatagaagccagtgcataatgtaaaataatctttttttcttactttaagaaatttttttaaaaattattgtaaaatgacaatttgtaattctataagtctatgtgaaattgtttttcttttgcttgcatctacacttattattcttattctgtgacatcctactggtatggctaacatctggaactccacagacagaaatggaaatgattgaagaaattaggaattgataactgaccttcagttaaattgccacagctccttaaagcgtttttgcacccacgtttctagcgtgtttatgtcggtctccaataattgaagaggtaaacttcagacccacaacacttaggcttgcttctttcctctcaaagaatcactctaaaattagtaaaaaaaaacttctgcgggccgggcgtgggggcttacgcctgtaatcctagctctttgggaggctgaggctggcggatcatgaggtcaggagatcgagactatcctggctaacacggtgaaaccccgtcgctacgaaaaatacaaaaaattagccgggcgtggtggcgggcacctatagtaccagctactcgggaggctgaggtaggagaatggcatgaacccgggaggcggaccttgcagtgacccgagattgcgccactgcactccagcctgggcgacagagcgagactgcatctaaaaaaaaaaaaaaaaaaaaaaaaaacttttgcttctgggaagatgaattagacatagcttttcctattccttctcttaagtgcaactagaaatttgaaaattatgtgtctgaaaatcatgagtctgaaatgtagggagaaggtggacaactagctagggacctcaggaaccaaggaataggtgagttccctggtttattttattttattttatttgcattgtataaacaagacttggagctgacaaactagaaaacccaaaaactagaaagcccagaaacatcagatatgatgagcacagataaacaaacagaaaagtccaactaaacccttttctctttgtagccaaagggcaaggacaggtaaagctaggaagagagaaacctttagacaataattgctctcttgcatctaaataagattttaaaaataatgtagacgatattcacccaaatcagagaaggctgaatggggaacctgtactttcagcattttcaagtgattgtgaagcacctcaactatgtcccaaagtactatgaaaaaatgctgtgtagggagctggaattttcctctccactaggtggaaatgagtctccctacactcaagtgtcaatacaaatcatacggagaacttagatttcacttccgctggagataatgaggtaccactactttttcctactgaagatattactgggaattctgcattgggatagaccctttaactgaggaggtcaatggagctgaagctctgggccaccaatctcagttcttgtgatagttagcaaagaattgcaaacactaaaacgcaagctcaaagcaaagtttattgaagcacagtaatacaccctcagagggagagtggacagatttccccgaagtgaaattagcccctctttacaaaacccaggggacttttatgggggttttctggggaagagttgtggtttgggctgtgtctgagtgacaggatgatggcatttgattggcagtttatggttatatagctaaaattaaactgtgcacattcatacccataatttgttaagaaaagcccacaggcaggaggtaaaaccacatgtaaattgattataatgatggtaaatgagcttagggtgaacttgaggacacagttctatgttacttgacctgtgccattttaagagattttccctagtttttcgttctccgtgatgtgctggccacagactttaccaggaacttcatccattagtgtggagttagggcagttctgggactctccttaagtgggctggccatggtctgccttagtgacagccttttttgccctcttctcttaccctgtgctaatgtctatctaactaccaaacagagtggtataagaggaagtctagtggaaagtcaagactttcactaccacccagtggtaatgagaccccttcttcctgttgtcagtggaggtaattttagcaacaacaatgagacattccatatgagtggtggcctactaaggaataagaactcccctctcactcatccataaccaggaggcacaactcctcagggtcaacagtgatgaaacagtgaagcaggcttctgacaccacctggcagtaatgagatggtggccctctgacttctgccagagcagtgtcagaaaaagccaactaaaatagaactatgaatcagatccagagtcttacaaattagtaccccaaatgtctaggtttcagtaggaagctgctcatcattccaacaaccaggaagacaacagactgaatgaaaaatgtaaccacagacactaatcctcataagatagatatgttagaactatatgacaaagatttttttttttaagatggagtcttgctttgttgcctaggctagagtgcagtggcacaatctcggctcactgcaacctccgcctcccggattcaagcgattctcctgcctcagcctcccaggtagctggattacaggtgtctgccaccacgcccagctaattttttgaatttattattattattattattagaggtggggtttcactgtattagccaggatagtctcgatctcctgactttgtgatccgctcacggcctcccaaaagttctggggttataggcgtgagccaccacacccggtctatgacaaggattttaatgtagcaatgataaagatatttcagtaaccaagtatgaacatacttgaaacaaatagtttttctaaagtcccagcaaagcaatagaaagtctcagcaaagaaatggaaaatgtaaaaaaataaccaacggaaattctggaattaaaaaatataaaaaccaaaataaaaaactcaatggattgactcagtagcatagtgtaggagacaaaggaaaaaataatcagtgaacttaaagatagagtaataaaattatacaatctaagcaacacagagtaaataaaccaaaacaaaaaacaacaaaaacacccagatccttaggcatctgtgagactaccacaaaagacctaacatttatgtcatttgagtctttgacagaaaaggaaaaccaagtggagctgaaaaagtttttgagaaaataacagtggaaaatggcacatttgacaaatgacataaactaattcaagaagctgagcaaaccccaaacaagataaagctaaagaaatccacaccaagacaaatcaaagtcaaacttctgcaaaactaaagatgaagaaagaatctgggaaacaatgagaggaaaacaacatttatctataaaggaaaaacaatttgtttggcaatggacataacattagaaacgatgagggcaagaagaaagcaacacgatatatatcatgagatgaaagaaaagaactgtcaacccagaatcctttgtcaagtgaaaatatctttcaagaattaagggaacatcaaaacattttcagatgaaggaaacctaagaaaatttgtagcaaccacagcttccataaaagaataactataggaaagtctggaaaaaagaaagaaaatgctaaaggaaacaatattgaaacatcagaaaggaagaaaggacatggtacaaaaaagtaaaagtcaataaaattgactttccttttcctattgagtgttctaaattatgtttgaggatagaagcaaacattataactgtctaacgtgattctaaatgtccacaggataaagaaatatttacgacgttatatctcacataagggaaggtaaagtgatgtaatgggaagtacaatttctatagttctttacaactagtgaaatgataatatcagtgcaatctattgatgctttgtatatataatgtaatggctagagcaagcagtaaaaagctatacaggccaggtgtggtggctcatgcctttaatcccagtattttgggagactgaggcaagaggatcactggagtccaggagtttgagagtagcctggggaacatggtgaaacaccatctctaccttaaaataaaatagagctcaagtccagaaggtattggtgggcttattctgaaattattcacaggggcattgaactattaaggtttaatggctaaagctggtgtgtctaacttcacactactcagaaagaaaaaaaccaaaacttacacacctaaaatcagccaagaatcttaaagacttcccaatctttaaagaagaatgaacaaaactcctgccaactttttatagatgtaataaggaaggagaaagtcctctctgggcacttattaaagatggtgaggcagtctttattcaagaggtgccattgcaacaggtataggaaccatggcaatgaggtcttgcaatgggagcgagattgaactcaattccaaatacagtatggacaagtgggaattgatagccaagtagcaaggtccagttaatgaatggaaaattactaagataaaacatcaggagtaagggaaatttttgtttgactcatcagaattatctctgaaagtaggccgaggtaataagatacagatggtagtcagataccaagatcggggaattttcactaaattgatttagcagaattctttctcaggctaaggtcgaacctggtcagaaagtactcaaaggagagttactaaaggtttgatggaaagagtcttttcaggaatggagtgccaggttcaacagaaatccatagggcactagatgaggcaaaaacaaaaaccactccataggggccatttttaccacctaggaaatggaactgccacaaaaaacaatcttcactgaggtaaattcacagggcaaaaaatctcaagtcacataagaaaaaatatgtcagtagattcaactaaaataaagcaacaacaaaatttcctctcaacccctacaaacaacgatgccttgtggcagttttaatataagttcattgtagttgtttatttatgccattaaagaaaatgaaaagaatgggcaaccaaaatattagtaatatgctattttaaaaataattcttagaaagctgaaaaaaatgataaaatcgtgttgagaatttaatacatgaatctttgttatattattcttgcactgttttgttctttaagctttcagaaaataactcaaaagactgagaaggggtactataattagctaaagtacccaggatatagtgggtcctcacttcatctatttattagacacagacaacttgagagcagaaagaccaggataaaagttataataaaattgtactccgctaagattcatattgttaacataacaatacacttttttaaaggcatctcaaaggtttcaatagtaaaacagaattttttgtgtgtgtgtgtgtgagacaagagttttgctcttgttgcccaggctggggtgcaatggcatgatcttggctcactgcaacctccacttcccaggttcaagcgattctcctgcctcagcctcctgagtagctggaattacaggcatgcaccaccacatctggctaatgctaatttttttatttttagtggagacagggtttctccatgttggtcaggctggtctcgaactcccgatctcaggtgatccgcccacctcggcttcccaaagtgctggcgtgagccaccatgcccggccaaaacagaattttttgaacgaatatttatattgtctcatgaaattcctctggtgatgaagaaaaagtgtctacaaaggataaacaacgtttagaacccacaaacgtatagcccactgaagctaaaatacagaacaacatacaagataactaacaaattagttaagaaatagtttgacagaagaggaatagtgaaggtttcatacagatgtatgaaaaatgaaggcctagtttcacattagctattccctttcagcctttttttgaatagtttaagatacaacacaaaaaataacttcagatgtttaaaaaaataaaggatttgttttgtttcctttggtgtcttctacttaaatattgtttttgaatatttctaacaaaatgctgatgtcattgttgacactagaatcattcttggctttatgaattctgtaaatagacaaaagttttttgaacattataatatttaatagatgtttaaattgtaggaagaaataatctcagcaatgataatagttctttacactctaaggtataagtcagtatagccaattagttcagaaacctttactattctgtgatgagtaacaattttatagataaatgtaagacatcgttactattaacagtacttatataaatatcacagtagaataacagaaaaatatttttattggtaatcggtttatactttgcaaattcagatttttacatattaatggtaaatcttcatagatctagttcaggaagagtaaaaaccatccaaatttacctaggaaagtgttgggatagtaaaacaaaaaataaagatttgtttatataactattattgagaaatcagagtacagtggaagtacagattgatcaaaacatagtcaaatttttctaattaaaagagagataaaaaagatgggggagaaagagagagagaaaaacattacttagaatccctaactcaaaaaaacttctcaagcaaaatatagaattctgtggtcatatatattttgggaaacgggattcattttctagactaatatttttgttcaatttgtttgttttttctcatctaatttccaaaactatttagcagttcagatattttgtgaaacacacttgaataaaagataccaaagaaaatgtcctattagactcacatgagaaagcagacttgggcttctccttggcagtagaaagcgctagaagaacaatggttcccaattgaattttctcacctgaccatagagaaaaagcctggtactctaaaaatttttaatcttcttgagctcatcagagagcagtggtggcaaagccatcaaataaactgaatttcaaagagaagcaagaactctccaatgaagataggccacagggctgtttcagatttggcaaagcgtgtgagaaaaaggtggctacctatgagcgatcagaagctggggatttaggtgagttagcaaagcccaattacagcaagatgagttggtttgagatgcttgggagccacagaaacaaagagagtttgcaatcaattctaggttattttccgtggactttcattggtgctcaagagaaatatctgagacagggcaaaagaccagagaagtgtgcaatagtgttaagtctctgggggaacacatttctctcacccctcctccccaaagcaggaaaaaaactcttgattcttggggaggagtagaaggaaaacgtttttgctctgagtaagatattggaaaccgtcttagccagtttccttcaaaagctgaagtagaagcaaaatctctctacatgaggaaagacaagaccactcttgagcagaggaacaaaccgctcttgagcagaagaaccacttttcctccaagagggggcaggtgacatgacatgtgcccaaacgcaaccacagatagaagacagagtttggctaccactgggaggagaagcaagaatgctaaaaaggacacaccacaggttctaggtgcaccaggcaagactaagagatttaactaataagccattagtggagaaaaaaggatatcataaaaattcagttaattcaaaaggcagaaaaagaggcaaaaaagaatggggaatatgtggggcaaatagaatgtaatgagcagtatgtaactagcacatggtagctttaaatccaaccatattaatattactataagtgtaaatgtaatgccaaatgtgtttgcacctaacaacataattttaatgcacacgaaccaaaaaccgataggaaccaaaaggaaatacacatacccactattagagctggaaactgcaacatttgcctcttagtaaccaatactacaaaaattgagaaaatcaataagtttatagaagacctgaataatactatcaaccagcttgacataactgacatttattgaacatatcaccccaaagagcaaaatacacactctttttaagtgcacacatgatagtcacctagtaacccatatctggatcattaaacaaacatcaacagaattgaaatcatgtgatgtatattatctgacaaaaatataattgaactaaaaattattaaatatttggaaattaaacttctaaataagccatggattaaagtggtagtcacaagtgaaattaaaaagacacacacacacgtatataatatttgtttgcttttttaaaaatgatatcaactttaattttagattcaggggtacatgtgcaggtttattacatgagtatattgcatgatgctgaggtatttggtacaatcaatcctgacacccaggtagtgagtatagtacctaatagttagtttttcaatcctcgtccaccttcttcccaccccactctagtaggacccagaatttattgttgccatctttatgtccatgcttacccagtatttacctcccacttataagtgagaatatgcactatttggttttctgttcctgcattaatttgcttaggataatagcccctagctgcatctacgctgctgcaaggaaattactttgttctttttcatgactgcatagtattccatgatgtgtaagtaccacattttctttaatccactattgatggatctctaggttcattccatgtcttggctattgtgaatagtactgcattgaatatacgtgtgtctttttggtagaacaatttattttcttttgaatatataccactaatggggttactgggttgaatgttagttctcttttaagttctttggaaaatttccaaactgatttccacagtagctgaactaatttatattcccaccaacaaagtatacatgttctcttttctcctcagcctcaccatcatctgttgttttttttttgattttttaataatagccattctgattggtgtgggatggtgcctcattattgttttgctttgcatttctctgatcttgggcatttcattgctggctagccatattcagaagaaagaaactggactcctacctttcaccatatacaaaaattaactcaagatcaattaaagatttaaatgtaaggcctcaaactaagaatcctaaaagaaagcatgggaaacatcattctggacattggccttgggacgtaattgatgactaagttctccaaagcaattacaacaaaaacaaaaattgaaaaagggtacctaattaaactaaagagcttctgcacagcaaaagacactatcaacagattaatcagacagcctacagaatgggagaaaacatttgcaaactatatatctgacaaaggtctagtactcagaatttataaggaacttgacaagcaaaaaacaagtaaccccattaaaaagaagacaaaaagcatgaacagatgagtctcaaaagaagacacgcgagcagtcaaagcttttcccttaagaactgagagaaagaagaggaaattaaatataaagcaagcagagggtagggaatattaaagagaagagcagaaataaatgaaatttaaaaaaaaaaaaacaaaaatggagaacattgatgataccgaaagatgttttcgaaaaaaaaaaaaataggtccatataatagacaagactactcagattggtcaagaaaataaaagagaagacacatattaccattataaccatagatgttatttaataggataatgagagtatgttgtgaacaactaatttcaatgaatttgatatgttaaatgaaatagacaaataatttaaaaagcatagataactaatgcttactcaagaagaaattcatatcttgaatagccgtatatcttttttatcctatatagtttaataaaatttaatttgtaattaaaaactgtcccacaaagaaaactccagacccagatatcttcactggcaggttctaacagacatttaagaaaaaacaaaaaatgataccagtttctaccccaaatttgctagacaataaaagataaagaaatacatgccagctccccttatgaggttaactctttgtgttgacacaacttactatgttaaatgaaagctacaaacattaataagcaaaatcaaaaatgacttaacaaattcagatatatataccatgttaataaatctgaagactcaacatggctaacatgccatttctcccccaatttttcagtagattctacacgataacaaattaaaattcctacagatttgtttttgatattttgctagtttgtatgtttttggtagaagttgaaaaattgattctaaaatatatatgaaaaagcaaaacagaacaggcaaaataattttgaaaaaaaaagtgctggagggctcacatcacctcatttcaagattagagataatttttaatgacatttttacaaaccaatgaagaaattacaaaagaattaaatagtttcttccttgaggaagttctctagctttttttagatgttagtctgtccttggtcctaccttgttgatcacactttcccaaaaacataggaaaataccgagaagatatgattgtcggatctttttttcgagcggggcggggagggagacaaagtcttactctgtgcccaggctggagtgcagtgacacgatcttggctcactgcaacctctacctccagggttcaagcaattctcatgcctcagtctttcaagtatctaggattacaggcatatgccactaatttttgtattttcggtagacaaggtttttgccattttggccaggctggtgttgaactcctggcctcaagagatcctcttgcctcagcctcccaaagtgctaggatttcaggagtaaacactgcgccctgcacttgtcgaatcttaatatgatacaagctgaagaagaatggttcctttaatgaatgatacagtgagattcagaattgttaaaataagttatgaaatatgtttaaagtaacaagttttaaatgaagagaaacatttatttagacttatattcagagtcctaaaaatcatttctgaaatgacaaaataaatgatctgatttgaaagcaattcatgtaaaaaacaaatttacttataatagtttccaatatgcaaattaagagacaacagttactattaggttattaaggcaaccttgtttaatgggagtgtctagattaggatacgcaaaccatagagtagaaagggtggtgattgagagatatcttacgtaaaatgaagagtggtataagaaattaaggtatttagtctgaagacagtgaaacattgctggttcagaaaggtgagcatttaaaaattcaaatacttgccagataaaagagaaatgagattcttaaaattctcacaaatacaaattttcaagagacatagatgatacagtcaattccaccacagtgtcaaggaggaagctttttccttagaatcttatctgtttttatcttatgataataataatctgtgtgccttgggagataagtaataagatactattagacaactcctggtgtaaaacagtaagtgggaaaaaatcttgcccacgtgttatgataagctacacaatattatctaagacaatattatctatctgagacgtagatgatacagtcaataagtcctgtttgtttaagcaatttaaatttgcatcaataatatggactgtcctaccaagcaggaaacttcctcaataaaaatttgcatagaaagtatttctgtattgagacgattagtaagttaaaagatctttccaaaatgcttgtgcttttagaattgttttagtatttttagcaaataactaaatagtaaaatgcaatcatgctctacttgattaaaaaagtggtaaatcaaataaaaaattccaagttggaaagttggaaaaaacagaaaaatagttctaatagtctttttgccctaaatgtataaaatattcagccctatttacaaaagaaaataccatgttagtgagtagaaatattttctgccacctggctagttatgaatgctgtcattctttacaaaggtagtctttatctgctaacttttacatagtgtaatctccagttaaacaaaattactaccattttggatgtgtcgagccatgttaatctgatatgttatgtatactttataatctatatcaacagtatctaatctaatctatgtctgtgtttgtgcttgaatctgtgtatgtggtgaggttacatcatttctgtaaagatttgtggaaaccacttgcaaaaaccaggtagacccactatcagttatgtatatcatttaaattggctaattaaaatcctcataagcaaacacagaagattttcaatatttcagataaaattatttttaatagggaaacagtagatgcatcatcgttcttttcagtagaaatattacatctcagcacattcctctctattaaaagcaagatacatttctcttgggggattcaagcctttttggaaaagcttgagtgaaataaagatccatggtcaaaagaaatacttacttcattgaaatgtaacatttgtatatccacagtcactgtgtatgtgatatcctatattctgtagacatttttgttcttaatgtgttaaaatgaacaaagaattgacccaggtaactgcttattctgcattttcacaatgcaaaacaatcattttcctaccaccacaatgtcaaggaggaagctttttatcttagaaatatggttaaactctatgataatataataatagtgtgtgtgccttgggagataagtaatatgaaactgtgagacaactctgggtataaagtaaaaagtgggaaaaattgttccccacataatatgataagttacacaatattatctaattcctatgtattgctgataataaatatttttcttccctgaaaatagtcaaacaaaaatgtgtaaatgcaagctaaattacatttggaaaataatctaattttctaattgaatacaaaggaaattttgaaaaatttaggttataaaaatttattatttaagtatgaaattgtagaagaaataatgtatcatggcactaaatgtataaactgtgactagttgttttctatatttttccatttataaggaattaatattcagtctagttctatggtatttaaaatatatgtaacaagaaatctattggacatatcaaccaacaaattttgaaaagctgaagatattatactaaaactaattaagcttgtaattataaaaaaagaaataaggggaaatgattaaaccattgaatgctgtgctgcttaagtatttttctgatgtattttcttttaaataacaattcagattcaatgatttggagaaatttaaatcatatttatgggctgctaaaagtttttcattaaaaagagagatgctctgtaatatatgaggcatatttagcatatgtcctcataatgtggtcttagaatgatttacattcagtcatacagtttttttttttttcccttgatgagtaaggtatgtataaggaccattattctcactcccagatttgaagtgggtgtcaggtgcaaaatgctgtaatgtatggggaacacacttggtttcagcaaactctgcagatttactgctaatcagagcaagtaacagccaagtcaagccggccagaatgtacagtcctaatatatttttctcacttaaaatgatgctgttatagttgtttttgctgtacttttctctgaatactgacctgagccatttatttttcccatgggaaagcctagtggtaactgagggcagctctgtgttgctgtaaacaaaataaaacttgctactagagaattcaaatccatagcacagtaagtgttgaataaatgttattacattttattcaactcaatgaacaattgtaatgactgccattcgttggctgcttatctcatgccaggcagtgttcccagctgctgtacacatccatatctcaggtaaacagcaaatctcttaattacctcttcttatctcctttccaaaaggcaggaggtggttcttaggaaggagatatatagtaattaaatcccttgtcaaagattgagtattcaaggaaaacttcacttagaattagttcatatagtttgacactattggttctttatcaaaaggtaagttaattctaattttcaggctatacgctccagaaaatattggcaaagtaaaagcaaaatgaaaaacactattggaaagataaagtttgattgaatatagggaccactgacagagtctgtacttcctttaaactttagattactaataaacaaacaaagcaaaatgaaataaagtcatgtttttatttttttaatgggcccagcaaaatttttaagaaggtctctaattatttcagttttgtcttagtctcattccttatctgatctctgaaggcaagtaagactggacaatctgattctctgtccaggccatttgccctcttcgagggctagaggtggatcagacctaacttcacctaaaacacaagatgactacaaaggggtgagtgacatagatttaaagaaaagaacaagaaaggaatgccacaaagacaaaaatcatactcatattaaggtactgtgctcccagaaatatgggatgtgggcattcccacataatccaaggttagaatgtaaattgaaaaaaaaattttatttattgactgtaaaattatacgtgctctttggcctattaagttcatggcttggaaattatccttaatatccatttggagagttctccacaaaaatgttagccacaccacatgatgtggagtcagaacaactagtttggccattctctttttgaaatgattgctctttcttgttatttgaatgaatgagtgaatgaataaataaattttgatttgacagtctattaaattatcatattctattgactcagagatgaacagatgatgcaccattattttatatgccgctaagaagttgcttattttacttttaaagcaccttcaattgccaaattgtaaaacacttaagtgagaaaaacaaagtgcatcttagaattgatgacatacgataacacacagtacaaaatacagctcggtattgatgtctgctttgtaggctatagaaaaatatatctttttttgcaagttatttttaaaaaatgtttacaatctctgttctgcttttgtttatttgaaatatgaacagtctttgcttatctaatccttacccacatcttggctcttggatcttacaactctactatattactgtctttcttaaaaaatttaatagtttttggggaacaggtggttttggttacatggataagttatttagtggtgatttctgagattttggtgcacctgtcacccaagcagtgtacactgtacccaatatgcagtcttttattcctcactcctcccttccaaccttccccctgagtcctcaaagtccgttctattgttcttatgcctttgcatccttatagcttagctcccacttataagtgagaacatacaatatttgattttcctttcctgaattacttcacttagaataatggcttccagctccatccagttgttgccaaggctgttgttttatggctgaatcatattccatcctgaatataccactttttttatggtatattccatcctgaatataccactttggttgaagggcatttacactggttccatgtttttgcaattgtgaattgtgccgctataaacatgaatgtgcaggtgtctttttcatgtaatgatttcttttcctatgggtagatacccagtagtgggattgctagattgactggtagttttacttttagttctttaaggaatctctgtactgttttccacagtggttgtactagtttacattcctaccagcggtgtaaaattgttccctttaagttgtgaaaggtgttttttgacatctgttatatttcagatgagtatagataagatttgcagtaaaataacttaactatacaataacaggatattattgtagtaaattaacgtaacaataagagaatcttaatagttttacttctcaggtcagaaaatataaaagaaaaacactggaacctacggtaaaattagggcaagatcaaatctaatgttacttgagacgtagaccttcatcaagtggattattttcttaggtaccttatttgtcacataatagtgactttttatttccatgggtcatatatatttgaaatctttagatttcttatgagtataaaactatcatgaataacataatgtctgaataaatgaaatatttcaaggccaaattattattccacagttccatctaattaaatgtgattccattcttacgggagactaatattgctaatttcatgtattcatcttcatagagtaggtttaaattgcttttttccccactggcaatacaactgtagtaaagtgtatcaattagtgtaattttccctgcaaggatatgagaactccagtcaattacgtaaaaataatgggattgatgatctctcatagtatgtatagtgataggtgacctgggattgataaatttagttaacactgtcatcaaaagtgaagattctttctatttttctattcttgtatctttagtcttcttctcaagctaacatgtaacaaaatactggcccctgctagttcaggaatcatgggaagaaacagcaatgatcaataaaagtatagggctgattcttcctcatgtctttatttcattttttgtgtgttaaccaaagaaacctttcacagacgctcccagcagacttagtgttctgcgtctttggccagaactggatcacatgctcattcagaaatgtgtcagtagcaaattaacttagatcagtcagatattatcatactagagagagaagaaatactctggaataagatctaggctctgtaagagtggaataaaagggaaacaactttgggatggcagcaatcaatgttggcttcagtaactcaatgttccaaaggctctacttttttagttataagtgggataatctattggatgtattgtagaatacttcgagggatttgaggctgatcaaggaaaaagatgtggtcactagagttagtaacaaacaagctttattgggtagcaattgaacaggttgcataagatgagaaatccatcacagcatgagacagttgagaggctatggctcccaggggtcactatctagaagggaaatcaatgtagaggcgcactggaatgggactgacccgtcttggtgatgtcactcaggagcagggcaagggacactgggtcagagaactccctggaagcagcagcttagggacttaatactgcaaagccctgtctcattaaccgataacagctgttgggtgaggtttgatagattatgcaaaccaggaaggtactaaaggcaaaaacttgcttgcttaggctattttctaaaataatgggatgtttataaatttgagtgtggtgccagtgggctttggaggtaatgagtctcagcctgccatcaagaaatcaataacttagaggcaaaaaaatagaagttatctttggctcatttatataacacctatctcataacaccattgagttggggccaaatgaaaccagggatgtagatgcaatgcatattcacaaaggaaataatggatattcatattttaatattggtgagaattcattcttctctctagtgacttgctgcaggatcacagtgctgctgccagtgttccctgacccttaaatcgtgtttattgttgttgttgttttggtaaagagtgagtcagaattttcacagaaattataaaatgacttatgtcagtcagcataagctaagtattgcaataagacaatacctaaatctcagcaacttcacacaatgaaagtttacctctttctcacatagcagtccaataaaatatacatcagtcaacttttcatgttgtgactcaggcacccaggaattttttttatctagtgtctctgcttcagagtcctgtatcaagtcctctggatttggtcagaagataaaggaaaatagtagagaaaagggaaagctgttttcagttgtctcagcttgaaagtgtttatcactttgactcacattccgttggtgaaaacccaagattgtttttgaaaaaatgaaatgtttatattttcacaatgaaggttttaaatgtgttacaaaataagaaaccttttcggaaagtccaaagaagaatgtgagtgttcatcataatgtgaactcttgggaaggaatgagttgaattcctgaatatcaactccagtcacatatgcatatggcttcctaagtatgtatttttggttacttgttagccaagataaacttattttttgctagtttaatgttttctgtttttgtaccataaacagcaaaagaaaaaatgtgagcttctctcactttttaaaagaagatattaaaccaaatgaaagctgcttaataaacaagataaattcaaatccttaacatctgtactttcatattaactttctagagttaaaggcccagaacttactcacatttttctagatggactgaacagaagacatatgtacttaaggggaaaaaaagatgataaattacaagaataaaagattttaggaaccaattgttatcaggatttcaatcctgtttgaaaaagacagcttggagtgtacggagtgcaatagtgcctttgaaaatgactgttattcgatccaagaaacaatcagcttagctgccagttctccgcatgagagatcagacatcctatgagtgccaaaaaatttctcaaagaaattatgaaactgcttctatgggtgaatctatgcatccttagggctgaaaaatctcagagacatttaaaaataatagccagaatttatcgagggcttctgatggccaaagagtgttcaaagaggttttcatgggatagctcctataattcccataatgactctgtgtgacaaatactgatccacattttcagagagaaaattaagagacagtgagattaagcaatttgtttgagttcatttcgttggtcagcgggaaaacaaggataagaaggcagagcattaagcttcagagcaaataccattcatgactgtgctatgtagactctcactagggaaatatggcagcttcattgtgagataagcactgatatgattagtgtgattatataattcaaaatcaaacctcaatattatttttattgttaggatcaaattacgtttaaaaaaagacagaaatatttccagaatattctatttcagaaagcattttaaaaatgctattctacttaaatacctactcgatcatttgtatatttttttcacatatttgatagttaattgatctatcctataaacaataacacatgcaattttaacagttatatttagataattgatataccataaagttcactcgtttcacatatacagttaattttagtaaatttacaaatgtgtgcaaactttactaccatctaattttagaaaatttacattatccccaaagaaacctcatgcttatttgtagacattgttaattcccatctccatctcctggcaaccactaatctactttctggctctataaattttcctttctgatctctggtgtctggattcttcttagtgtcactttttttgaggttcatctatgttgtagcaggtttcagtactttgttcctttttattgctgcatagtatttcattgcatggatatactacattttgtttatccatttaccaggaaatgaaaattggataggttccactttttggttgttgtcaataatactgctatgaacatttccatgcaagtccttgtgttaccatatgttttcatttctctaacagtgggattgttgagtcatacagcaagtttacagttaaatttttgaggtactaccaaaccaaaccgtttttcaaaatgtcttcaccattttacattttcaccagcagtgtatgagagttccagttgtgacaacactttgtatgctccgtaacaaattgtagctgtgaagtggtatttcactttatttcttatttgcattttcctagtgactaatgatgttgagcatctttccatgtgcttatcagaaatttgcatatcttctttaataaaatatttattcaaatgttttatatttttaatttgatttttctatttcaactggattattttaagtctccttattgaattataatatttctttatgttttctggcagttcattatcagatatatcatttgaaaacatcttctctttctctcaagctgtgacctaccttttcacattcttgataatgactttgatgtgcagacatttttagtttttatgaggtatgtcaatttttcatttatcgatagtgtttttggttttgtagctaagacgtcatcatctaaccaaaggtcacaatgatttacttctttttttctgaagcactttatagttttaattatttttttaaaaattttgagacgggtcttactctgtcactcagacagagtggcatgatctctactccttgcagcctccacctcacaggctccagcgatcctcccatctcagcctcccaagtacctggaaccacaggtacacaccaacacacctggctaatttttacatttttgtagagatggggttttgccatgttgcccaggctggtcttaaattcttgggctcaagtgattcactcaacctcggcctcccaaagtgctaggttttaactcttaaagttggggatacactcgctttaagttaatgtttggtatgagagttggcatctttgtaaaaaaaaaatcaattgaccataaatcttaacagctgtatgaccctaaatgtaaggatttatatcaagactgtcaattttcttccattaatctaaatgtatatctgtataaacctctactgttgtactataccagtactacattgctttgtttatttttactttatttttagttgatgaataatagttttatctatttatgaagtacaatgttttgatatatgtacatggaatgactaaatcaaacatactaacatatacattgtgtcatcacttttttgtgatgagaacatataaaatgtgtttttataaataactgtcaaaatatatagttattaactatagtcagtatgctgttcactgttttaattagtcaacttgcttgtttccgaaaaagactctcctgagaatttgataggcattgccttccatctgtacatgaatttgaagagaatcatcatcttaaaaattcattgtccaggctgggcacagtggctaatgcctgtaatctcagcatttgggggtgggtgaggcaggaaggtcacttgaggccaggagttcaagatgaccctaggcaatatagctagactctgtctctacgaaaaattataaatattaatctgggcatggtggtgcatgcctgtagtcccatctacttggaaagctcatgcaggaggattgcttgaacccaggagttcaagggtgccacttcagcctgagtgacacagtaagaccttgtctccaaaaaaaaaaagagtcttccaattcatgaatgtggtatctctcaatttatttaatctttaatttcttacagcaacttttgtagtttcagtgtgtacatgttaaatttatttttatttcattcattttgatacttttgtgaatggaattgtgttcttgattactttttggattgtccattgttaggaatatataattatatttgtgtatattggttctgtatcctgtgaccttactgaactcctttattagttctattaattgtatgtatgtttatgtgtattccttaggactttctatacagatcatgttgtctgtaaatgaggactgttttactttctcctttttaaatcctgataccttacgtttatttcctttgcctcctttctctgactgaaagccccatcactatgttgactgtaagtagtaagaacagatatcttggattgttctttatgttagagggaaagattcagccttatgccttcaattatgatgttagttgcaggtaattttttgtagatgccctttgtcagattgaggaagctccctctcattcctagttttttgagcatttttcttgagaatgaatgaatgggtattagatatgttgcatgatttttctgaatctattgagatcatcatgtgatcttctttccttaatatgtgcaatttaaaaataatgacaagggtaagcaaggatttggatttgctttattgtttgtccaaatattaccaggagagtatttatatgatttgctaaaaatcagtggtaatttcacaagtatacaatgtgtgggaatagacttttatgtctcaaattattaaaaagtctagagactttaaaaatatcttgtgttcctattaatttttcacttattagtcactttcagttataaaaatagaaaattcgcaaggttctgttttaagtcctgttgattgaaaagcattttaagagtcttatctgtagttgcaataagacttaaactaagctggaatgttttaaaataaagtttagtatggatataaagttatactttaacagaagaagttttgaaagaagtacaagtcttaggtgcaattttcaacaacagcttttaccattagttgtgataagtgaagtatgtgcctattttaattggtaatgagagagagaaaaagagaaaattactagatatgatgttttaagtttatattgtatagaaagcaagtatagctagtaatttgtgatccaaataaaattacataaatcgaaagtaagttacacttaatcatgccaagggaagaaaaattgaaactactttttaaaagattactgtataagtactcatcaaaatgtttttactataatgctagttaaggtattggtgtattatactaaacaagagttttgaatcacataaaaaagctaacatttattgaacacctttataattataggcactatattgagagatttaaaaggatcctctttgattttagttagttggcacataataatacacacacacacacacaatggaataccatttagccacaaaaaaggatgaaatcctgtcattcacagcaacaggaatgagccgggggaatattatgttaagtgacttagatgaggaacagaaagataaatatgacatattttcactcatctgtgagagcattagctattttgttttcaaaacagttatctgacaaaagtgataagtgtgtaatcttggacatattatttaactctttgaatcttttttaatttaaaaaaatgaacattataatagtaacctaagtcatacggttactgatattatttttaaaagttggtaattttaaagagttaagaacaagaccagacacattacatgcattaactcaatgcccttattttgtgttttagggctgtataactatgtgtgtatctgtcagtcactgtcacagtttcttaatccactcctcctcctgaaatctgtattatatctctctctgcccttgaagctatttttcttcttgtattatattttgtttgatataaatgttgttacctttgttttctttagattttaattgcctgtttttctttttacattccttaaattggattctttcttagagctcctctttctctttatttaatgtctctggactcaggatgaggaagtgttgaccaggggacacgcagcagtggatattgtgtttgcatgaaacaaaatctacttttcacccaattttgattcttgtttcacttgatattactctgtgaccctgaacttctgctactatcagttgggatacaatactctacgggtccctcacatttaagcccatattatgagcaaaggcactgtctaccctcattctgaaatgccttttcaaggatgtctacatggtgaacagccttagaagaagatgaaagtgtctcccttgagagtaaaaaggtttgcttatgtcctggaacataagaggtaatgtttctcacccagtgaaaagggaaggtttgtctacagcccattacaaaagatacagtttcctaagctcaagtttcctttcctgtagtgcaacacactatacaggcaggtatcacctgtccttgttgtgtcatctggcccttatcacattgccctgtgaatcagaccttcgggaaacagcaagaaaatgattatcctctgactgctcctgtcgctgtgggtaataaactgaccttggtttcttgccttgagtctgggccttctgccaatattcataaaacgatgtcaggctactgtgtaagtagggtaagcattcagactcatcatgttcttgacactattcttctaacacaaagtggaaagaatataaaatggtgcacccagtacaaagttaagataaaagggcatcaaacccctcccattgcactgggccctcgacctctgggctaagtttttctgcttaacaccataccacagaggccttctgtcttctaggagatttttaatagtgttttccttaatgtttttatccatatttgtttcttacttctgtggtttctctaggtttgggctctggaagagaataaagattatgtgccttttcaatattttgtcagactgcatagaatttctgtgatttaaaattagttatgcattcatcttaacataaagtgtttgacttgtatataatatcctctccaatcaacacagtgatattatgtgtctccagaggaagcttgtccttgaaggaaaaaaaacaaaacaaatttggcagactgcaaaattgcatccttacaaaacacacaaaatgctttataaaaatgctacttgatggcaatgaaattaattaaaaatcctcagggccaaaatgtacacatacataagaatcaattttggcatgaattagcagaatgaataatgcagtatttagcaccaattacctaggatatataaagaaggttgagacagcctagaaggacagcacatactaaaaattacatacatatacacagttgaaatagaatctgtgaacaaagcctattcatttttaaagctaaaaaattttgaagcataacttaatttttagcaaaacaggggctctttatataaaaatgacattaaatgaatttgaaatgaattactttcatttccaaagaagacagaaaaggacaaaacgaactgcaattaaaccagaaattatttacattcattttctagataattactttatcttaatagaggaattattaaatagttcctaccagattacgttgttatatttttaacctctgtaactataagaatgcagtagcatagtagcaagaacaatgtgagttgcaaagcctttaataacaggatttgttacatttttatgcaatttagctagctgtatagatttgagttaactatgtacataatctaagtctcagtttcctcatctttaaaacagtgataatgcctcttagggttgattaataaaaacctattagtagaggtaacacttttttattatttatttattatttaagagagaaggtcttgctctgtagccgaggttggagtgcagtggcaccatcatagctcatgtaacccggaattcctgggctcaagtaatctgcctcagcctcccaggttgctgggcttataggtgcccaccaccaagcccagataatttttgttatttttggtagagagagagtcttgctatgttgctcactcctggcctcaagtgatcttcccaccttggcctcctgaagttctggtattacaggtgtgagccaccttgcttgccctacatgtgttaaatcctaaaaatatgcacatctttttaatagatcatattcaatgtatgtaggtgttttatgaaagacataatttattcagaattttataatcacatcaaataaatgtatagttttccactactaataaggtcagtatggtcagtatttaagctacatttaataccattataatttttttattcactttttgtaattatacagttttgtggtcataggtcttttttttactaattagttgatgggcacagtatcatcagtctgataatgtggggaaaattcccaaatacagaaagggtttccctgtacatcagttagatcttagttttgaaaaagaaaaaaattatcatgaagttttaaaattaagcctttccatactcattctaacagtcattttaagaaatgaatatgcatacacaagggaacttcaaaaagttcatggaaaaatggaatcaaaagataaaagtaaaaaatatggattttgttttccaacataagctccatcaggttcaagacacatttgtagcaatgatatcagccatcattgagtccatccctaaataactgagggggctctgggaatttaccatgcagtctttttacatttttaactagagaaaagtgggtgctgtattagtcagtgttctctagagggacagaactaataggatatacatatatatgaaagggagtttattggggagaattggctcacacaatcacaaggcgaagtcccagcataggccacctgcaagctggggaagaaagaagccagtagtggctcagtccacccaaatcctcaaaaatagggaagccaacagtgcagccttcagtctgtggccaaaggcctgagagcccccaacaaaccactggtgtaagtccaagattccaaaggtcaaagaacctggagtctgatgtccaaggtcaggaggaatagaaggaaacatccagcaagggagaaagctgagagccagaagaatcagcaagccagcttatcccaccttttcctacctgctttgttctagcagagctggcagcctataggatgattcccacccacctaatgagggtgggtcttcctctcccagtctactgattcaaatgtcaaactcctctggcaacaccctcatggacacacctaaaaacaatactttacctatcagccatctaggcatccttcaatccaatccaattgacacctaacattaatcatcacaggtgtcttttaaggattttttaagattaggaaacaaaaagaagtcagaaagagccaaattcgactctaagctggatgcctaacgatttctcactgaaactttcacaaaattgccgttgtttgatgagaagaatgagcaggagcattttcatagtgaagaaggactctctagtgaagattttcagggttcttttctgctaaagcagaaagttatcaatttgtaagttgctgattttaaggtgggggatattgttcctgtaaactttttgtaaggcatcagtaatttcactattcttttactcaagttttaccatcaatttgatgtttttttgtgcttcaattttagcagaattcaagttgctctgatagggactctttgcaaaccaatgccttatcctccttagtgcctcaaattagattctattcagacatgttataacaaattagtatcagtttatttatttgtattttatgttttactttttttcataccttctctgtctgagaatatgagtttattttggtacaaaagaattttgaaatccatgcagtttttttcataatatgcaatttccataaacttactgaagactcctctatatgcaatataaaatatatattttcttttttacctcaaatttaattgatatctaattatattttacaatattatattgtatatgcagcatatgttatgttataaaaatatgtaattattactctgatttttcccaattatatttttggatatttctttttctgataataattcctcactgaaatgaattattatttgagcaaataaatatttgataataaacttctagttgctatgtaataattttagagttgctgttcttcaagttgaggtaagtgatgcatggatgtcacttcaggtacattcctcagagcctgcctaatccttgagttttcatttctaacttcagatttgaatctcggggtgtgactgtgatgtgttatgtgagaatacgctgcagaccctttctaaaccttccctggatatttattgcttattcgattgtgcagttatttagcctttgtcctacaggccattagtggtcttctcaattgtggagagacaatgagatcggatttactttatgaaaatatattttaatttaaatcattttaaggtttatgttacattaatcatggacagaatgtgtgtatggaacattaatctgaaacagtgagaataagcagctgtgtttccctgatatgataactatagtatttgtgttaattatgcaatgaaatggaatcattggaatggaaaattcattatgctacattaaagagagaggaaataaaagtgcaaatatttattgattttagagtaaactcccaccaaccccccaaaagccatacctttgatgatagcatgtgaccaatgaacttgaaagaaatcataatgtattgttactctgtatgtatacatgtgtgagtatatgtgtgtatgtgtgaactttgaaaatatatagcctttaagacttttaaataataaatttaattcgtcccagtgaagaattatgatctgatggaagtatatcccaaagtagaaaagttcattccaatatcatactgttgacatattttaaatattttagttgaactaatacaaatataaatgcaatggaaatagaagcactatttctaaaaagttatccaatatcattcatttggaatctttttctgcatttagagtgaaatatttatgatgaatttgttatctgagtatgaaaatttatcttaagtgaatctctatcacctgcatacttcccttaagaggaatcacatgtaccactttatttttatgtgaatgaacagttactttgtgttaattttgcctgcgttttcttactttatgttaactttaattcttatgttaactttacttttcatataagcccgattatagtttaaatttaaattaaacagcatttgttagaatattgaagacctagctgaaagtaagtcaaatattaaatggtaatctcatatattgggtcatagaaaatcatcattatggaataaatacttgattaattttgtgcattactatgatttgggtgaggtcctaagctcattaagaacaggagttaaattatcaatgaatttgttaaatcaaagatattgcatagaaaaatgattaatacaggaaaatactgactggaaacactaatcagtatttgaaagtgaacatttctagattctttaatgttccgattaaatatttgttaaagtatgcaacaaaatgagcaaaacacagatctttaattctgagagttgactatggcttactatctttgtacaatttgaaaaaattaagaaacatccttattagccaatctaggcagtctcaatctaaataataaaatgaaaacattttcctaaaatactgtttccaagtagtaataaaaaaatactaaaagcttctttcaaaactaaaatttgattgagatataacaaagtatagctttgaaaattaaatgaggtaattttatcactatgaataagtatactgtattgcaaataatagcaattctcttccattattttcctgggatcactgcttcaaggttaggactacactccatattactaaatttagcaatcaccaatctcttatcttaactgatctctgaggagcattctgtacaagtaactttgccactctcatatgtgaatcattccatggtctctaatcatgatgcaatcaaactagaaatcaatatcaaagatgatactaaaatcccccacatcattacacattaagaaatatactaccaaataatgtacagatcaaagaagaaatcacaatggagtgaaaaaaaacatgaaactataggataataaaaatactaggttatcataacttatgggataaagctaagacagtgcttagaaagaaatctttagactgcaaactttagatgtaaaaaaaaaagaagagtagagtatcagtgagcaaataatctatcttaagaagttaaaagaaaataacaaattaaacccaagaaacaaagaaaagaataaagacaaaaggacaaatgaataaaaatgtaaaataaaaatacaattcagaggattacaaaagacaaaagttaggtaaaacaattgataatgggaatgcgaaatagaagaaatgcacaaatgaataatcgtttatagagaagaggataatacaagggtcattagaaacaaaaatataataaaattttaaacttttggtcaatacatttgaatatgaagttgaactagataaatactgaagaaaaatcttacttaaattaacaaagaagaaatgtaaaatttaaataattcaatcctatttgtagaagtagagttacaaatttacagctttctacaaataaaaacctaggcccagatttttttcaaacactaattttgtttacagatctttcaataacagaagataaagtggcacactccagtttattttatatgctcaatgttatttggtaacaaaatataaaggaaattaataggtccttctcatccataaccatagttataaaaaccctaaactaacaataaaaaatgataatctaggaatatatttttaagaaagtatgatacatcaccacaaagctggatgaattccaggatttgaaggaagttttaatattaaaaaatcagttttgtttataacactgaaaaaatgcattgtgaatcacatgcttgaaattatttaataaatttcaatacccattgatgatgaaaagctcaaggaattagtaattaaattgaaattccttaatctgaaaataaatatctataaaaacatatagcaaatatttctgttaaagaaatattgaaaatattgtttttgagaaagtacaaggacacactctgtaatgtctagcattcaacattttatctaaccgagttaggtggtatgtaaagggaaattaaataaaactaatgttagtgatatgttattatattttatttgctttatgcatgttattatattttattggcttatgcacatgtcagtttcctctagttgaagactatcagggacacacatgatgttgaacaaagggaggttgattggcttactgcaataaaggacaagacacatttggatttgtgctaaatgatttggggaagggttcaacaaagtggggcttgactctggattggatattggcagaggagaagataactggatgtttgggttgcttaataatttttatggagaagcgggtaggaatgaagtaaacctaaaactgtaatcgataaatttgtggttgttattcatattagtcaggaaaggtgttggagagacatatttgattaatttcatggtacgaagaaatttttgtttttgtctgtgctcatacatgattacagagtagacttaatttttgtcttgctccatcatggtcacggagtgggcttgtctgatgttgatgttctgagaagcactatggcttagctgggaagccagaacaacttaggaacaccaaagcttcacaattggtgcccaatcatctccagctatcaggggctgcttatctctttatctcatattatgtcagttgattattatatcaacatagcaaagtaaatgtcattagctttatcgtattgatgaagcaaaaacaaaacctgaaagaataatttgtctaaattgaacccagagttcaaacattgactgtctgactcaaagtattattctatttcaacatctcttcatttagggtcagagttcatggaatgaacataaatatgtatcagaattgtttgttaatacttaaaattatcttcatttattcattagccataggatgatgttaatcactgaacagaggagaatgacctaaatatttggaataataattgaaaaggaatattcattggaatagtatggcttaagccataaaaggaagtggccctacagtatataatctgtttaacaagagatttctgaatttcctgaccaactgtccacactgacactttataagaatagtagggggatcaaaaaaggaaggaaaataggaaagaatgaaggatggaaggcaagcaggaggatggaataaataacaaatatatatatattgagcacattagttttctaatatccacttatttattttttactgtttaaactcattattaatgagagaagtatgacagagtctacaaaccatgtaatatttgatctaactgtactttaattatcatgtttttttgtaactctggtttttatactccaaagatgtgtaagaagcaaatttatatctatttcctaataaaagatctttgtttaaaagatcattgaaatcagtcttcgtagtactgattctgatttcaagtgggaggaaaatgacttcatttgagaaataatgaggttttcacaccatcaaacagaaatattcctaatccatgagaacccatccaattttgcctctgtttgtagatgaggactttatagacaagacttagaaatgcaggaatcactctaggtatttcaaggtaatattatatgttgccataacactgaaaatgttggagaaacaaaagtcaagggtggcaagtagtagaatcagatttttactagctttcaggaagtatattagttagctcaggctgccataataaaataccataggctggatgacaaacaacagaagtgtcttttctcattgttctagaggctgaagtctgagatcagagtgcaaggcagcatgagggagtttgggtgagggctcctttcctggtttgcagatggcagccttcttgctgtgccctcacatggcagagagagagagagagagagagagaatttcttctttgtgtgaacccacagtcctatcacattagggccccacctatatgtcctcatttaactttaattacctcccagagaccctatttgcagatacagtcacattggcagttagggcttcaacatatgtgtttgggagagaaataatttagtctatagcaaggagagagatggtagataccaaaatcagctactaaatcaactagaggtcagtgacctttttgaaaaaaacaagcaaacaaacaatcacacaaacaaagaaacaaaaacaaaggggcagctgcaaaatttcacatctaacaatgctcatagttctacttgctcctactagaggaataaaaatgctatgactgtgctttttctgtgtttcaaatatagcttgagtccctgttaaggtaaaatctactctggaaatatgctgcagggattctggaaatgtgatttaaagttttgcagccttttaatagagaacatagaaagataaaatggtccctaattagaagtagttattatgtcattgacatgctatcaaaactagtatagagaagaaaaatctcaagaaaactgtgaacttctatggaaagaaaatttaggagcagagaaaatattatgtaactcaaatgccatctgagatcaagaattggaaagtatatataatctaggaaggaatacaaatagtaagaattttttcttcttacctgataaatagaagagttgaaacagatgatcgttaaattttggtttcttttttatagtatgtgtcctattcaaacttcagcattggcaaaagcaactggcagaaacgagtttaatcaaaaaggtattgttgagtgcctccttcactctgctcaactggcagcagtggtcttgacttcacatcattgaataaaataatgagacaggtcaggttttaactaataaacatttgctttgctttattaaagaacacaggacaaacaacaacacaacatgcatagcaacagcatggtgaagctctcagtgctccacgcatgactttgctaatcagtcactctgcacttaaacatgtaagaaactccttaagtgacgaagatgagataacatgatccatcgtaccttgagaatccactgaccctgttctttttttttttttttaggctttatgcatagtcactcagtcccaaagctagccatacaaccctttgaacattttatgtccagcttctgttctccaagccagctgcatcacctcactacagattgcttattacttgcaaaactcagcaacaaagtatacattcttggtctagcatacagtgcttggctgaattctcatttatcttttatctgatataactataaagtattccccctttatctgcagtttcagttacagtcctaaaatagatgagtagttataatacgatacaatatttcgagagataaagatcaaattcaaacaacttttattagagtatattataataattttatttttatattagttattgttgttaatctcttactgtgcctaatttataaattaaagtttattataggtaggtatgtatacaaaaacacagtatatataggcttagtactatcctaggtttcaagtatctactaagggtcttgaaatacatctcgcatgaataaacttgggggactactatactactaaaacttccttgagttagtgttgtaaatatttgaaccataattatagggatgtatactttaagacaatgcattaatagtatgaaacactaataatccaaagaaacaattgtgtttttccaaattttactaaaatgttgtcacctgctttacataatacattcacatatttgatatatatgtaggacaaatagtgtttaagatttcttaaaaatacatttcattttataaaaaataatattttcatgagaagccttgaaaatagctttctcaaatacctatattatatgttgccataacactgaaaatgttggagaaataacttagttcattaacatgcaaaatagaagcatcaattgtaggttaattgcctgagaaagaaataaacaatctccagggagatgaccttgttaaaacaaaattattcacttatggtaaactgtaaaatagaagatataaaaaatgtagcattatgtattgattgtaatcaaaaagcttccataatttattattgaggccttgccaaagacttgagccatgtgaagtatttgagacactaataaataacattttctaatctgtggattcaaattaaaaagtgacatacatctaaatgtttgtatattgtttatatacatgaaatttaaatagcaatgaggtggcaattaagaaaaatattcttgttttaacaatatcacataatttaagcatttttttcaacattgcttttaaataacattacttttctacaactcttaattacctttgaatccagtgtatggagtataaactcattaatgttttcttgtgctttcccgcaaacagcaactacacttgaatgcagttttagattagaccttttactatgtggaagaaaactggctaaactatttaaatagtatttattgtaaacaattttctgacacgtgtacttatggtattttatgaacttgaaaatttgtctgcttgtttcagacttacatattttgctcttgcaaagccagtcagtttttattatgtcagatgattgccaagtgtaccaacctttgagcttatgacttcattttttaccccacagtaattttcttaatggctactagaattgattgtaatagcaggcatgccttctatcaatattatgcagaagtaaaagcagttcttggcaggttcctgaatggaattcatctgattaaatatgcattttttgattactgtctaaccttctgcaacctctactgtctgtcttttgccattaaagattaatctgccagtctatcagataaaataataatctgaatggatctgcatgactttacctaatctatcaaatcgtatcagactattatttttacacattgtaggtatatgtgaccattaaattaccatcaagtaggaaagaaaacccactagaatgcaatgtttgttttatatgtattataaaacatattttctggatatttacaatttgccagacctacaaaagaagaatctcaaggaaagtttcttttaaaaagagtaacattgtattttccattgttttattcagccatccatccaataattttagagatctgtttattatcagtgtacttctattgtgaaaattaggtattcatgaaaatatataataggtgtagttcaatttcccttttgtgaagtatcatttatataaagggcatatattacacacacatatccatagaatattattgcccagaagaaaatattgttctgttgtaatgaaaaaagaaagtgttggtgatactagatattatctcaatcttggagatgcatattggttgaaagcatcttaaatatctaaataaattaacatattttcagctctggcattttttaaacttacttgactttggaacatttcctcatgaaacaacatacagcactccacagaatagtaattcttaaggatgtcttgggaaatgctgtagtagagttggctgcctaatcagtgtatttttctcagggtggctagagacaaaggcattgtttctagacatagcatcatcaattgcacttggggacaaaggaaacatgtacatttggttttcccatcactttatgcaataggcaagtatgagtgattattgtcaaggaaatgtaatatttaagattccacaagaagcacatacaaagatttctaaatgtatatgaagatttaaaatatatctaaaaacatgtatttgagaagaagagcttcttaatgttcacaatgcaagttttagatggtaacaattacatcctgtgacattgtgataatgtgcctccagctcagggcttgtctactgttatggcctgaattgcatcatatgttgaatccctaacctcttctacctcagaatgtgactgtatttggtgataggacctttaggaggtaaataaggtaatatgaggtcacatgggtgggtcctaatccaatctgattcatgacctgcaaagaggagaagattgtcttctgcaagccagacaccacaggacaaagaaaacctgctgacaccttggtcttggactgtaccctccaggactgtaagaagatacatttgtgttatttatctttcacccagcctgtggtactttgttatggcagccccagaattctgacgtcttacaaagcttatacttactaagaaaccttactactactcctaagcatggattgggccaaaccaagcaaaaggtcacagtgcaatgctgcattcacccctttgccaataaaaaaagtcttcgaacccccttcatcccatagaagctgctagtgaacccttctttctttcagttttatttattactgcatggttctgtggtttctttgagaatatagggtagctattaaagttagagaaggcctctttctctgaccaactctacagttaatttgcatttaataaaacagtaggaacaatcatgtatacattcagattaattagataagaacatctcactgctctttccagaaatacaaattagtaataaccctaggcataaaattttaatagcattttggttgcattattaaatgtcatagataaatttaagttttagtgtcatgttccattagtagaaaagatcagcagatatttgaagccacaaatatattgattcaaatgttttagattaaaaagtgtgttggcacaagctaatattcgttctctcactatcctcaggacatacattgatttatctatgttttgcaggacattacatattccaacaaagtttgtcatctttaagacgtttgcccggaataccactttttcacttggtcttgtccctagttgctcctgctttttgagagacctttttataaccccaaatgccaccagctgtcagaacataatgaatcatgtattactactgcccaaatgcctgctcggagactcatctattcaacttgtactctctaatgtctgaacaaaatgccttcagtacagaacaactccatccttaggctggtcctcaaaaggcaaattatttatgaatcaaagtttcagaaatacttgtgaacatcaatattctttaatggctatagaaattgtacctcatgttttaataaaactgcgtgatttatagcaatgctgaggactcatgcttttactttcagaatttatcacttaaaaattttagtgtggctttaatatagagcacactcagactgaaataatccttggtaaggaataatttttgaagatatatgtgcatgtgtgctcatgtgtgtgtgctttatttgtcagagagcaattggagaccaagttatctgattttacacttttgtgcaacagaaacaccactaccgcagactctactccaaatctgtccctctatgacaattcctggaggaatttttaaacggaactttttaagaaagagcgtttagaattgctcaaatctgccctggaatgaggcttatgtgcattttactctaaaatcaggcaattagttgtaagttgtacacacacacacatatgtatgtgtgtgtatatgtgtgaacatatttattttacatatatatcctgctttagattttcagttcctcttcatttaccaggctaaccttccagaatagtgctagggctgaacatttgtgaccccttcaaattcttacgttcaaatcctaatccccaagccgatggtaccaggaggtgggacctgtgggaggtgattaggtcataaaggctgagcccatgtgaatttgattagtacccttataaaggaggcccaagggagcttgttagcctttctgccatgtgaaaacataacaataaaaaaatgccgtctaggaagggggccttcaccagacactgaacctgctaaatctgccagcaccttggcacagtatgcaaactctgagaaatatatttctttttataagccactcagccaaaacggctgttattacagctgatcaaaagaattgctgttcatcaggccaaagacatgctgatccttttcccttcattcatgctattcttgtcccttcaatcttttcctaatgtcttgagcctctgcttgtttattttctcacaaagtctttattcattgatctttacagacagaaactcaaatatacctgcaagcattcagcatcatttacttattaggcagaaaatgtttgcttattctctaatttattttttctctaatttatgtgttctcggtgttttgtacatgtattgtctacctcaagacagtgatggatatattttttaattttttgggaaaaactttctgacttggctctgtgtcgaaaacatatctcacaattgaacagaatgtagaagctgacatttactttaaagcttcatgaacatattcctgggaggaattcaggaatctctctgtttctggctttctttcattgtgcagtgtctgctattctgtagattacacattctacatttatttttagtgagattgtcctagattaatatgtaattcctgccatttatgctactttatattggagaactttttctaaccttcattgagttgtttcaattgctacatacctatactacttcatttctcaacaattcaattattcataaataaattataaataaaacaatgcacattttaaatatatttgaaatattttctggaatttaaattttgtatattacagaaacgagttgtctatatgtattgagagtctttaaatatttatattatttgatccagtaactgaatttttaaggtttttcaaaggaaacacagtaataagatacagtaataatttgttgaataaaagttaatcctaggtctttttaataagcccataaactaggaactatattcttgacacaatatttattgtggaaatttttaacatgttatgatatattcatataatggaatttttgtatctaccatatacggtcatgtgttgtttgatgacaggaatatattcccctttttttggtagggaaagatggtaacttaaaacaatagaaattgttttgaattaggagtaccagatgtgctaccgaatacctatgatttggacaaagtaacatgattcactagctgatggtgttataaaagaagctgatacccccatgtttgagttgatgagtatgatcaataatatattttatcatttgttattgtgggagcatcatagagcatagttaaatcaatctacatgatgtagcttactatacacctaggttatatggtatagcctgttgctcccaggccacaaatctgtacatcatggtaatgtactaaatattgtaggcaattgtaacacaatggtaagtattcgtaaagctgaacatatcttaacatagaaaaggtacagtcaaaatatggtataaaagattaaaaatgatacatgtatataggacgtttaccatgaatgaagcatgcatgatgggaagttgctctgggtgtcactgagtgagtggtgagtgaatgtgaaggcctaagacactactgtagactctagagacactgtatatttgggctatactaaatatttaaaaatattttctttcactaatcaaaattaaccttggctactgtaacttttttactttataaacttttaatttttttaactttttgatactgtatatttcctttaacatgcaagcacattgtacactgtacacaaatttcacttttgttatatctttgtactataaatatttttctattttttattttttactttttaaacatttttttgataaacctgacacaaacacacacattcgcctaggcctacatagggtcaggatcatcaatatcactgtcttccacctccacatcttgtcccactggaagctcttcaggggcattgacaggcatagagctgtcttctcctacgataacaatgcctccttctgaaataccttctggtattcttctggagtacctcctgaaggatctgaccaaggcttttcttgaggaggtgtcactcttttcagaaatatgtctatattggtttgcttggtttatttctttttttaaatcataaattcgcttgtaatcagataatgcaccatgaatattcctctttattaataaagaccttacaatcatgaggtccatgttttcatttttttttttttttttttttttctgagatggagtctctctctgtcgcccaggctggagtgcagtggcacaatctcggctcactgcaagctccgcctcccgggttcacgccattctcctgcctcagcctcctgagcagctgggactacaggcacccgccaccacgcccggctaatttttttgtatgtttagtagagacagggtttcaccgtgttagccaggatggtctcaatctcctgaccttgtgatccactcacctcgacctcccaaagtgctgggattacaggcgtgagccaccgtgcccggccattttcatactttttaaggaacttgttgaggtctgcaaagctttctgctaaatctttcactgtgaactttcttgtcggggggttcctcttcttttttcttctcagttcgcttttattttgcctctttagctatgtgttcctgcttcagttccaacaagtcccattagtcaatttctcaggaatgacttctaggagctcctcagtgtcatcctcatctacacgcagattaaagttgtttgccatctcaactacaggcttgttggtctttgcaaccttctattcttggaaaattgtttgaaatcatggatgaaccttttaagtatcttcttcctgatgccatttatacactccttcgcaacatcaccctatgcccaagcaaagtccaggatacagtcacagatggcataatccttccagagtagcctcagtatcttccgaatgtcttcctcggttgtagcaatagcctgggcaaatgtcctcaggtattcggccttcaaagctgctgttactccttgatccattggttggatgaaaaaggtgatgtttggaagaaaaaatcctcactttgatattgggatgaaagtcaccaataaaaggaggctgtgcaggagcattatcaacaataagccaaatcttgacaggtatgctattcttcaaacagtacttctccattttgctcacgtagcaaatcagacgggcatcttggaagaggagctgggtcatccataaactattgctcctgcagtacacaggcagtgtgtgtttattgataataggcttgaaagccctggaattctcactgtgccagatcacaaagggtttcaatttgtagcctgcaacattgcccccaaacaagactgttatcccatccttaaaaaatcttggcattaaattggcgttcttagggatgaaagttctttcaggcatttgtttccagaatagggagttttcatccatattgaagatttgctcatgcaagtattttttttctgcacaatcagcttatctgattgtggaattacacaatctgatttttggaagttcccaaaattcctcagctgctgctgtcacatcagtacttgcatactcaccactcacttttacattatataatgaataactattcatgaattgtttaaaccacccagagctagcagtaaattccacattgtagttgggtactgtcttttcttagaatattgcaaacaaattttgctttggttataattatcatggtgccaagagggatgtgtttctgtgtctgctctttaatccagatcataagaagtttctccgtatctgatataggccattcttgaatttttcttagtcttgttgcctccaagaagcagattctctaacagcttctgtcactttgttcttgttgttgatcatagctatggtggaatggaatatgcctgcctggggagcaataaccatcactggttttccaccttcatagttcttaatcacttttcatttagtctccatgacaatcactctaacgggcctcttactggcagaattagcagtggcttttgcattgttaggggccgtgatgaacaaaacaagagagtaaatcaactgaggttacacaatcaagggctgcagtaaacacgagatgtgtgaggcttctgtgggcttaacacagcatactgtcttaatggaaactttttgcttagtaagtaggattacactctaaagtactgataaaaagtagagtataataaatacataaatcactagcatagttgtttattataatgatcaggtattatatactgtacataattatatatatcagactttcttaccactgcagcacagtatatttgtttacaacaacatcactacaaacatgagtgatgtgttgacattattagacaataggaatgtttcagctccattgtaatcttatgggagcaacattgtatatgatgttctttgttgcccgaaacattgttatgcagcatttgactgtattttgttttcagatattttaatgacctaaaaaattatcattttataacataacgaaaaggtgtaaaagtaaatattgtttatctaacattattcaagctatgtaaaatatgcatagcagatatacacaataaatattttatagtagctacttattgattatagtgttaaatatactggtttatttttattattgttaatatacattagaatctgcatttacaaaattggcatctcttactgtgtactcagaaaaaaaataagtttttaatactgttataaaaaatgttaaaatgtttccatcactcatgtaaagtaaagtagagtttaaaatttctaacaactagatgattcataattggcctttcaaatgaaagaaggaaaccatcattatggaagattacagcctaggaaaaggaaatagagattcttggaaggatatcataaactaaaagtcaccaaaaaataaataaaaagccaaaagagttctttgagattatgtaatttcttcttgttgtttacatatttgtagccaggtttatctgaacatgtattgaataaaaaagatcaaataaagcaaatatcaaagctttgtttaaaaaaaaaaaaaaagccacttagaaacattgcactccagcctggaggacagagtgagactccttctcaaaaaaaaaaaaaaaaaaaaagaaaggtggaaatccatgccacttaaattataaatatttattaattcccttttgtacctgtcccagtgaggtataaaaatagagttaattcaagaatatatgattatctgtacttgaataattaagagtccaacaagtaataaatcctccttactcctcttcaatctgaaataaacattgtgccatcagagcactttgtcttatattgtcattttcatgtctctaggacatcgtggccctaggtaatgggaggattggagttgacactgagagacatgtactttggacttttctttgtgtaatggacatatcttgaaagaaaataatcacattggagccaacttaagcctttttgccttagagtaattgtattctgccagattttaactgtactacacttatatacaaatcaatcccatcaggaagaccatcaaaattcctaaacattacattgttggaaggtggtggtagcaaatattttttatttatgaagagtaaggaatgatgtgttgcatttcttcacctcatagatcagacttagaaaaatctctttaccaaaaattgataagggaaaaaataataaattatgcctggtattttgtgaactaaatttactgaatttgtttaaatcaccaatacctataccacttcatttcatcatctgtgacataaagtattattttttaacattaagcaaaaatgaatggtgaccttagaagtgctttaaaaaactttatgaatcaagcctagtagagatacgagacagcttgttaaatatactattggaacaaaacttaaaaattttctgaaagataatgcacaataaaatgcggactctgcctctgatttgaaacttcccagagcatcccctctgcttggacctctgtattttcatctgagcttccttattgtataacataatcataattaacaactcatattgccagatatgagtatattcattctttaataaattcatgttcttgataactacatttaagtatgttatagtgtgtcttagtcaatttagtctactaagaataacagaatgccacaggcttataaacaacagaaattatttctcacaattctggagactggaagtgcaagatcagggcagcaccagcaaattcggtatctgatcaaagcccaggtcccggttcatagatggccttcctcttgctatgttctgacatggtggaaggggagaaggatctgagtggattccattttaaaagagcactaatgccaatcgtgaagcctttgccctcatggcctaatcacctcccagagtccctatcttctaataccataagactgtggattagatgttataacatatgaatctgggggagcataaacattcagttagtacagtgtgtgggaatgaggggacattttaagagatttttgtaataggcagagagttttgtgcctattaaaatgtaagaaattatgtaaaagtttgacacctgaaaaaaatatttattgactctcaaatacaacatgaaaatgataattactattaataaatacttcatttattagttataaaatatatcaactttattaatatttaaattttatatttatcaaatttaattaatttcagaaagtgtatggtttaaactttctaatttggcaagaatccctgttttggccaatggtttcagataaattattgccaattttaaagtaaatcggttaattattgtcaaatgaaaattaaattgaaaaattatttaaaatgttttcaaaagttttatacgtaaagtattatttttaataatactccaaagctaagatgtcctgggcttatggaagttactgaaatgttcctgaaatctctccatcaattctcattacacatgaacctttctgaataataaatgctaagaatctgggatgcgactatacagtatttctgtgtagatatattactgatatacggttttttggtaggaaaagatgttaatttgaaataatagaaattgttttaaattaggagtaccagatgtgctaccaaatacctatgatttggacaaggtaacatgaattcactagctgatggtgttataaaagaagctgatactccagtgtttgagttgatgaatatgatcaataaatgttcattgtcttctcttagatctcacctccatagtgtacatgatggagtgctatgctgttaacaaacttgctattaaacaagtgctgaatacacaacatagcgcaatttaaatgaatgtgtttgtatacatgtagtatacctgcacgatacatttttaagaaacgggccggcgcggtgactcacgcctttaattccagcactttgggaggccgaggtgggtggatcacctgaggtcaggagttcgagacaagcctggctaacatggtgaaaccccgtctctactaaaaatacaaaaattagctgggcctggtggcgggggcttgtaatcccagctactcaggagactgaggcaggagaatctcttgaacccgaaaggcagaggttgcagtgagccgagactgtgcctctgcatcccagcatgggcaacaagagcgaaactctgtctcaaaaaaaaaaaaaaaagaaagaaagaaagaaaaaaaaaagaaaaagaaacaattgctgggtcaagggttagatgcatttgtaattgtttttttaattttaaaaattttttgttgacttttgaacattaatacagctatatagtacataattcaaaaggagaaagagatgaatggtaaaaataaaactctctcacaccactttcttccattaatccagttcccttggtagttacttctttatataaatccttctagagatatgtgacgcttacacaagtatgtatgcatatgtagaattcctccttttcaagtaggtttttgttttcttgtgcctatccctttaaggggagcagaagacccatgtcaagatggcttaaacagagacagcaggctacagtgtaagcattcatatcaagagtgtgctattttttttttttttttttttttttgccttatcacctcagcctcagccatggtggaccttatcagtaaaagtgatggtttctttgattttcactgtagcttattgttttccctggatgaaaggatggcaatgaattctgtacattgctctgtccctggccaagaaatctcaatcttactgccatcttgctctgcactgggcacagagcacacactctgtaattatccttcaccagcttcctataaatgcccttcacctctctcttccattagttcttgtgacccagacatcctcttgttgatttaatctctggtgtatcacatattgtactagcatcctggggaaagattgtatggatggttagtttttcagatcctgtatatgtaaaaatttctttaccttactttcccacctgatttctcttagaaatatgaaataatttttatgttgctatgctgcctttcagtgttatttaaatattggaaggcatttctgattccttattctttgtatgtaacaattttagttaccttcccccatggaagtttatgagatcttcattttgtctccagtgttctaaaatgtcacaatgattggctaatttggtcatcccaccataccaggtactgggggattccttttaatttaggagtttatttcctttagagcaagcttgtccaactcatggcccacaggccacatgtggcccaggacagctttgaatgcgacccaacacaaatttgtaaactttcttaaaacattatgagatgtttttgcattttgtttttttcagctcatcagctatcattactgttagtgtattttatttgttgcctaagacaattcttcttccagtgtggcccagggaagccaaaatattggatacccctactttagagctaggaaatggtctgggatggtattacatccaattacattacattatgttatttatgatacatataatataatgtatatggtatatattaaatgtaataaaacatactataattgcataatttttaatcaaatggacaaatgagtattagcatgaattacttgttagttgaggaaattgcacatttacagcatgcacaagggattggtctgcagtaacaacgtcctctaaacaatgtaaattagtggctttcaaaatatattttcaaaatatttttgcagtaaattactaaatttgaatgctatattttaagccagtcacacacacatattctgctaattgcttattgcataaactatttttaaagaatataattgttgataaataatgatatctttaaaaaacaaagaggaagttactttagttccaaatgttaaagtttgccagtacaatcttttttccaatagaaacattatagtactttcttaaatattttatagttttttcctaatcacaagttatatagctgtttcttttctgtgcttaacaaatatatagcattaaatcaaataggaacagtatatatttataatagtgcattcctacatatactgagtatatgaataaataattataaattgtgacatcttacaagaggtatggccaacaataaatgtataatgatcattttggattttcaaccctttattttctctgataacctatcaccccagcataaaaaagtatttatgacataaatattatgactcaatttttgtgatgttatcaatacaaatcctccaagtgtcatattctaatgaagagcacaagtagaattccactaataatacttctttattaagtaaaatgtttttgtcatattacatcttattttaaggcatatatttaactttgaaaaagctgaaatgcagtcacacctttttcttttagtcgttcttacctttcagtttattggactaatgagagaaatagcactaacattatactaagatattattcaagacttgtgttgtttctctgtttttagcatgcagtgacctggagttcagggaagtggcaaacagattgcgggactggttcaaggcccttcatgaaagtggaagtcaaaacaagaagacaaaaacattgctgaggcctgagagaagcagtaagatttctaaatttgatcattgctactgtatctgttatgaagttttatttccaatgaaccacttagaacaaaacacatatttcagtatttattcactgcatatatactgaataaaaatcagaacgttattacttccaagcacacctgtattattttgcaaggaaataaggcatttaggacaactcttattggaggaaaagggaatgtctcctcagagggtgtttagctttcagtagactagaaacaatgggaatattcttcagtgttttattaaggtggtaaagagtagaacaacatagaaagtaaaggtaaaaaattggagtacttagatttttaaagaatacaacagaactcccccgtatggtagcctttccaagattactttgctggtgtctctattttgaccctgtgtgaaatggatcagtagacaagagaggatatctgcaaattaaataagtaaaacacagaaggaaaaaaaagagccatatacctcttacaattttttttaattatcagtataattctctaaaagtttttttaattccttggaaataagaaatacaaattgaaatagggtacttgttatgaataattttataaacttttcattttatattattttcatttgtataaaaatgtgtttatcatgtaatgcatgtaaaaggatatcgaaacacgggctgaatctttcaaagattgaagcatgtgctccaaaacacaagaaaaggggaaggagtagcaattacaagccacatctcttggctgacaaagaagaaccagatgtgtgacattcatcgcctatcctgatgtgatccatccactctcacctgctaccctcaaagtgcagtttctaacaaaatggtgtagtaagataatcctctgtagattcctaaaatgccttatttatttttttcacattaaggaattttctacaatttcaatctattttagttatgaatctaatttacatagtgaaatgatttaatgcagaagtgcaattaagccattacttttagattagtaattgtctttgaatgcgtaatgactaatccatatatttctttttatgaatttcatgaagaaattgtagtatttttcatttcctatagaagagttcctcaggcttatctctggatttattggttaattttttggcaaatgtaaatattttgatgcctttgagctttaacttgcctaatagaaataatgattcagtatatttgcctctgtatttatgaagaaaagatgtctggagtggggagaaggtttcttccatacccttacatattgattttttaaagattcatgttcacacctgtttttaaaattcatatccactcccaatattcatagatgaacatttttattgcttgcgctaaaatttctcctttaacctaagcttgagttcagactgatgcgcacttccagatatggagatagataatgaagaacatttgcaacactcagcaaggtgcctgggtaattgtacacattcacaaatattttcctttctagctttttctgtcaataaattccatgtgtcaataaattccatgagactctctaaaggtagtagattaattataagaaacttctttagagttgaatatctttggacaggatcggaaaaagtgggccacaggattatgtatactgcttgaaggagtcagagaccagctagaaaaaaatttccaaagggaagttatccattagaataggcatgacaaatccacagacaagaaatggctgggtccctcggctccctcagctcctcagatctgtgcaccctatgggtgaattcttctttgggtctatcttatttaatttgtgaaccagacctcctatatcagactcccatctcctatttttattttcccttcagagcatttatcagatctaatatagtgataatctacttgtttatttaaatgtctctgtctctctcccaaccagagtacttaaactcaatgtagtaagaggtctttattcaccactgtatttccagaacctaggatagagattgacatatactattcactaaataaaactgaaaggagttaatgaatgaatgaagcaaagaagcaatcaatatactacattgtgtacccataccatagtttagtcactcaattagtgccctaggaatgattattgataatattcattattttcatcatgacagttattactgtagtcaatttttatgcttttatttctgtgagaaagattacaagcagtggaagcaatgagtcaaaatgtgcatgcattttaaattacataagataatagatattgccagactgctttgtaaaaagcttacggcattttgcatttttaccagcaagacatgagagttaacttttccctgcatccctaatagcaaaaaatattaccattcattttaacttttccattctgatgaatatgccattatatttcattgttaattaaatttgtattttatttattagtagtgaatttgaacattaaaaaatagggggaactaaaaagcacagttttcaacttatctgatattaatgttatcacccctacattccattttatcacatttgtttaatatctttgttaaaaactttgatcagcttttctttattatattcatttaagtgtctttcttgtgaaaatccatagtttggttttgattttttaatatgacagtgagcaaatgttggggtgtttttgtttttggttttggttttggtttttttctttttttgagacagcgtttcgctcttgttgcccaggctagagtgcaatggcgtgatctcggctcattgcaacctctccctccagtgttcaggtgattctcctaccttaacctctcgagtagctgggattacaggcatgcatcaccacgcccgggttattttgtatttttagtagagacggggtttctccatgttggtcaggctggttttgaactcctgacctcaggtgatctgcccgccttggcttcccaaagtggtgggattacaggggtgagccaccgcacccggcaagtttttgtatttttaataattaaggatgtggttaagtcaacataaggcagagaaaaatattctgataagatatagaatgtcttcaggcattttatactgaagccaaataaaaatgtattttacaatctcttatttatagcagacaaaaaatccaataacattgtgtcattttaataaagagagaaaaatcaaattttgggtttgcatcagtattatatttgatactattgttaaaaatcttataagaaatcttttaaaaattagccagcattgatgatgaaaaaatgtttttcatgaatcttttataatttttacattttattcattttttacacatttttaggatgattagtcattttctattaagatagcactatagttttttaaaaaaacgtcttgtatatcttgtttacaaagttgccttatgtcatgatttttcctaagaaaatcatttataattttttgttataataattttcactttatagctataattatgaggtggataattgtaaggtttgtcagcattttgtagtaaataagcagatattatgaatataaattttatacatttttaatattcatatacttctttatagtatatcattttaatgtggcaagaatgaacatgtttattaacagagcaaagtatatacagcttctctaaactataaaaataagagataaaaagtatataaattacaaagcatgcttttgtgttttatctttttaaaaatgttgtagatgttagattagatagtgattgaggaatacctattaactaacttaatctaacatacctctaacattttaaattgccaaaagttcttggagatttttttaagttggctttattgaaaaacataattactgttgaaataaagcttgtcatctacatgatttaatttggttaaaaataaatttatgatttctgggtttttttgtttgtttgtttgtttgttttttaaatggagtctcactctgttgcccaagctggactgcagtggtgccatctcagctcactgcaacctccgcctcctgggttcaagcaattatcctgcctcagcttcacaaatagctgggattactggtgtgtgccaccacaccagctaaccttttgtatttttagtgaagacggggtttcaccatgttggccaggccagtctcaaactcctgacctcaggtgatccgcccacctcagcctccccaagtgctgggattacaggtatgagccactgctcctggccaaatttatgttttttataatctcaaacacttagtagatataatgctaacaattgcatcagtatacctatatatatttaggaaaaatatatccaaatagaataataatgtaagctatgttatatttaatgctgataacactagaatcatcactatgttttattaaataatataaaaccagtcattttcgccagtctttttaaaattatgtgaattgaatttttaaaacagagttattcttagtaaccctatgcctaatcattccattttcatatagaaaacgtcacagtaggcctgcataataatgtataaaaacgcttgtttgtgttttttattaaatgttgtttattttatgattttacttaattttaaaattatttgttattgatgcttagtgaatagaactatatattcttgaatagtaattaaaatcagaaaattaaccaaatcacctgtttcttctaacagcaatctctatttttattagttattagttacaaagtattttgtgcttatttatatttagtgtcaaaatagtgatattatgtgcaaacatgcaagagagagccaaatcacacgtttttctggttgtacaaagaatgtttaaatgctaatatctattgtttaatgtgtacaatattacctttgacttagatctttgtcttttgatgaatctttatctccaattacatttaaattattaacgtaatgttcattaaaatggtcatttttactatctagaaataccatagagcttgttttctataatattagaatacgtgtgaatagaatatatagtttcttaaaaactaattctcaatatttacatctgtttggtctaactttaaagactagcatacaagtggaaagttaatgaatgacttcaagaggtgcatctgagctggtgctgagctgcttggcacataggaggagaaagcagaaaggatgctaacatgtgtcttctttgtcaatactttatctccttaaataatcttaaaaattcagcactccgtttccctgcaaagtcttagatacgtgatttttccaaccccaaatatagggcaataaaggccataggtacaatccagtaaagttggctggaaatagtggccacgacaagggccaatgctttgccaaacattgttgagcatgattacaaatattaagttgaaccttatgaaattaccaattttggaactacaaaacaatagtttttagaggtcaacctgacataagtcatctaagaattgactacttgttatatttaagttagtctttagactttaacctattttctgtccctgagtatcacataccttttatttgtgtttaatttcccagttgtgttataataggtaagaatacaaattaagccatgatatttttttctctttttcctaatctcatgatccaggatcataatctcattcttagtatttatatcctaactgcatggcagctagtgatccttacgctgagtgcagaagggtagcatactctctaacttcatttgtttcctaatcataagccagactgctaaaaactgtgagtacagattactcttagggactaaccattgcctgctgacttctctgtgacttccagaaagtgttgtagaatttttgattaatataattcttcatagtaaaggcacatccttcatatttgtcttttacttgtcctagaacactcttcccccaggtatctgtatggctcactccctcacttcatccagctcgttgcccaaacattcctcactaggtgccttcccttccaccccatctaaaatagcaacagcaccccagagcattcacctcctctttatgttgcttcattattctttctagtaaatattgctacctgatatatgaatgtttaccagcttattttctctctgttccaaataaaatataagcactctaaggtcaatagttttccactgtagaacctgcaggcactagaaaaggccttggcatatggtagggactcaataacaatttgttgaacgaacaaaccaaaaagtctaatcacaaattgttacctggacaatgtcctaacttcagaagagtgataaattagcctgtagctgcttgcttatatttgctacataacatagtttccaaaagggcaagattctgatgatagcagaattggattaaaagggtaaaagcttaatgaaatttaaatggaaagatattttgctttttcaaaaaagtcaatgaaccttgaaagtggaatatagttctacaaagaaagggggattttctagcttcacataccatcaaatcaacattgctatatattttgcattagttaacatttaaaatataatgaaatatatagtctttttagtagctattttagtaattatacttaactcttaaacacattatgatagtaatctgagattttaatcaaccaaattgtattatagcatttgcataaagaattccacagtcattactcaagaattgtattttacttgaatcttggacagtgtaaatatttcatagctaaatgatttgagttgacaaaatggtcaaaaatgtcatagctttaaaaaatggagtttatacagtctgtcattattttttaacaatcgacacctaatttttattttataaaatcaggcttcttgaatatattttgtttggatttactttagagctatcactgaaaaacaaaggaatgatcatagaaaagtaactaagatggtaaaaatcttaaaatatgttttacgataagaagttgaaggaaatgcaactatttagcctctcatcctattatcattagcatgaaaatgcttggtgatgttttattcaataagaatatgttgtgcttactattatcaagataccttgattttattttattatttaaatctccaaaaattgcatagcagaaatactatacccaggcttttaaaaatatggctgcaatcaagaatacataattcttgaaagtgacattgtactaattttccctttaacaatttggagagcatcaggacattagcatcatatgcaaaatccccagattagcagagtctgactaagattaagataatgtcttatatctgctttcctacaagccaaatgttctcctcagtcggagaaaatgatagaattatgtaaaccttcagggtaaatgaatacattctaatttcttaccaagatactgctcactttatgtcatgctgtcttcacattaagagaaagactgaatgtggaatcagatggtttaaaacaatgccacattttaatgcaattaggagtcttctaggtatagcaggagacttcatcttttggaaacaaaatatttgagaagattagataaattttcttatttcaagtaataaaatgagagatccatatcattgcttattttggttctaattattgagacatctggcattttattctcttttattctgtggactcttaactccttataataaaatttaattatatgcttaagtattactaaggtattgtcttaagatttgtatattttaattttgctgaaattatacgattcatatatagctaaattaacgtaatcacatgtagtttaaaagtattgctataaaataaaagtactaagtgattgatgtactgcagtaaaattattttgttacattatcgtgtcctgagaaattactgcattggatctgctaggaaccaaacttttggttatcctttattctttctttaggaactgtattattccaaacaatggcaattgctatcagcattggctattttttaacatttctcactgggtgaatgaaatgttgtcaactttattacattctgttttcaataatgtaaatatttaatttcaaaataaagccatgtagggtgttaagcaattttagccagtcatctgaactatcggaacctattcaaaatgaaacaacacctccccccaaaaaaaaacaatgaagaggttaagaaatctgcagaaaaataaaacaaaacagaaaattttatgttaccacatatatttagtcaattatagtcaattataaacattattcctgttaaactttactccaatgccagttgagtaatacataaaatccttgaatgtttgcaaaataggtgtcttaaaagcatcaagaagtgatagttaaaaccaatagaaaaagtatacataaaaacaagtaaaataacttaaaaaaattatttggggttgtttaatgagaaaacatcaaggactgcagtccttgaaccatatgctagccaatacaaaagccattaattttatgatgattcctttgagacattaatgagtgttaagtgattttcaacatatcacagcaaggaagaatccatataacattgtatattttccattttctttatttttatattttgtattttgattgtgcaagtaatgcatgcttattttttaaaaataacacgtggaggtatattaagagaatatcttttcaccaactccattcattcccttttttcatgaggtagaaaatgttagcagcctgagttatatggttttccaatactgctttctttttttttagacagactctcgttctgttgcccatgctggagtgcagtggcatgatctcagctcactgcaaccaccacctcccaggttcaagcaattctcctgcctcaccctcccaagtagctgggattacaggcatgtgccaccatgcctggctaaattttgtattttcagtagagacagggttttgccatgttggccagactggtcttgaaatccttacctcaagtgatgcactcacctcggcctcccaaagttctgggactacaggagtgagccaccatgccccaccaaatctacttcattttcatacaaagatatgtacttacagaaacagacctatttttagcaaatataagctcatactatgcacagtatgtgccagcttgcttattattactgtttattttaaccttttaacacttcattgtgttgcaaatattttctcactacatcctttctattttgactttagaatatctcttagttcatgttctttaagaaagtctttctcacaaaaatactgatttgtatattctcctaatgtatatattttttgcacttaaatctttaaacctatttacaatttattaatgtgagctcagattctggcaataaattatgtacccttattgaattaaaaataatatatttacagttaatttatgtttattcttatgcttgcattttctttttaaatgctacctattttttcatatttctttctgttattgatttctactgtaattctggttagttttagtatcagactttgaatgactttagttctttaaatttgttgaggtctgttttatggcccagaatatgtcccatctgcacataaaaggaacatgtattctgttattatttgttggactattctgtcaatataaattatgccaagtttgttgacaatgattttcagatctatacccttactctttttctatctacttactttagtgagtacttttagaacagcgttgatgttttcagatgtaattgtctatttctctgttcagttctattagattttttctcaggtattctgaagactcttttaagatacattatacatttagggttactgtatcttcttgttgaactctttatcattatgtgatgtatgttggttaatgggtacaaaaacaagtaaaaagtaataagatctcatgtttgatagtacagtggaggaactatagtaaactctaatttattgtgtgtttcatatgtttcaaaataactagagaagaggacttggaatgttcccaaaacaaacaagtgataaatgtttgagatgacagatactccaattaccctgatttggtcattatttgttgtatatttgtatccaaatatcacatatcccataaatgtgtaaagatattatatatccagaaaacttaaaaaatattcatttttcttttttaaaatatattttcactgggtaaagtatactgggttgagagctttgtgttttgttttgttttgtttcagcatgttacccctgtcatgccgctgtttctggcttgtgggtttcagctgacaaatctgctattttctttactactctgatgaaatatgtaactattttagagatgtttctcctcatcactctttaaacagtttgacgatggtgcatctagattttgtttgtatatctgtttgtttgattggttggtgtttattctgtttagtgttctctaagattcttatctctgtggtttgatgtctttcattaattttggagaattctaaattaatcattgaaatattcttcgaccccatttttctctttcttcttcttctgacattttaattacttctctcttagattgtttgataataaccacagctctattaagttctgttttcctcctactccttttcaccttcttcttcttcctcctttgtcttctctcttcctcctcctcctcctctgttttattttcttctctttctccttatcatcctctgcctcctcctcccaaacaattgtatttgtttctttcctatagtttccatctctagttttaatgcaagtgttcgccatttatactacagcctttaacttattaatcattgtaattttaaagtatttctctgattatgtctaaatctgttatttctaatctggttctatcaagtgctttgtctcttggccgtgtttattgttggtttattttcttcttccttttatacatgtctctatctttttggttaaaactggatatattgtgtagaacagtagagatggatgtaaataacatttgtgcctggaattagtgatgcctcttcttttgcatggcttttagtacggcagttgagccagtctattctgataattaaaaattttggctttggtttttttcttgttatcctcagtgcatctcaggcttaaagtaactatagggttgccttgtgcttagcgtgagactggcttgccacagcctttttctccacttgtttcttgatttttcctttgcaactgagcctcagagagggtcccccttcttgattgtacccctccaccattgatagaaggttggcacttcttaagcaacatttgctgctctggtagtgagagcattccttcatatttttgttaagctacagctttaggaaggtactatgtatctgaatctcaaaggtaggactttctcagaaatcctattgcccccttagtggaagaggttctttaatggtctatactcaggatattctcctgatcctttcccaggtacagctgtgtttttaactcttttcctttggtgcaagggatcctcacctatatctagagagtgacaggatattgggcttacccctaggaatttaaggttttcttccataaggtatgtagggaagatggatgtggatgggagttcatacctttcccacagcagcttctgcttctcaggtggtttcttgggtcccttatcttgccctaagtcttctttgagagcacacactgagatcctggagtcatgtctgtcaatgtttatgaattcttcttttttttatggtttccagagtttatttactgtcattttagcctacactcagcctttagcaattcactgaaaatataaattgaatttttcttattagcttacatggtatttggtatctgtctcaagtaagccagtgttcacattccatcctttcttggaggcacatgtctttttttagattctgggttactgtattgctctaggacataaactcacttatggattcaagaaaattgtggtttgctaattactcagacttttcttattgtttatttgtgaacaatactctttttaacttctcacattctaggtgaaaccagtgagtccttgcctttaatcctaagtaatattttcatgaatggagattattgggttgaaagttttcaattatttttttcttcacttaatgatgttattcaactcatttttggtctctaaaatttctgacgagatgccagacaaattgaattattgtttacctctatgtgtcatattcttcctgctgctttcaaaattggccttaatctttaggtcttgaaagtttgactatgattaggaatgacctttgtgtcattctgcttggaaagtcctgcatatctttaatttgtaaatgtaagcatttaagcaaattttctgccattatttcttcaaatattttcttacacaattatctctcttctctcttctggaacttcaaatgtatatgtcatagcacttgatattacctaacagttccctgaggttctatttagttttttctcaatctttttcttttttttcaaattagataattttgattgatctatattcatgtttacttaccttttcctttgtgaatttagttttaatttaaaaggttttttttgttactgtcattcttacattccatttagttcattcttataatttatatttctctactgttagtttctattgttgcaattattacaagcatgttttcttttaccttattgaatttaacaatcttagttgctttaaaatgatatccgctaatcccaacaactggatcacctcaaatttattcttaattgattatctttactttttttttgagaatgagttccatatttctgatttttaacatgtctcaaaattcaggatggtgttccagaccttatgaatatggaattgtgtgatgctgcattgcattatttttccccagagagtgttgcttgattgatttaacagatgattaactttgttggtctcaaaatggaaactcactttcttgggtgccagcttcaatctcaattcagtgttctagtcttagcagaggtgattgaagcctgtggaatacatatgtggctgatagatcatccgagttttgggtaggtggtttttggtgataatttatctcattttcttctcggatttcttcggctttcctcagtggctatacacaactttctgattctccaggctaaaaagtctgcatttttttctaccagtgttattgctaccttgcaccatgaaaactctgcctacccccaacttaaaaaacagcaaaaattggaaattcactacacataacctccttcctcaacacgcagactacaagaatctgcctactctattaactcttcatacccttcctgctttagaaaaaaaaaaagtctagaattcaattatttatctgcagcagtgctggttctataagaccatattcaacaattactgaaagtggaacctaaaataatttttaaaatgacagtttgaagagaggaattttgtcttacctgtccttgaataatcaaggcctagtagtgtgtattgaatcctgtgtggaccagaatggtgcttttcttctcaatacctgctgtttaccccttcccctcgccaaatctgacagtattacagtactttaaaaatattaaactgtcattagtgaggacaattcagtcattcagaataggttttgaaatgcacatttacccagattttgctttcatttgaatgattttacttcgatttatgttcctcgcagctatgctattgatttacttgaggactaagcaagtaaaattgataatacaggcctactagttcataagattgggaaatgtactgcttatgtgtctacattgtagaagtaaataacctcatttactacaataacataaataatcaggaaatgttgaattttttattgtaaatatttatgtttgatagcttctgcttttcagaattttttgaaatatctttgaagagaagagacattgcttgacaattcttacaaaatatgacatgtcttgtaggcctctggtgctttccaagggattacaaagattggtgagtgtgggaggttgaggaagcaggacaagcaaaagcattttcagtattaataagcacactgtggtctggacctggaatttgtaatctattaatagtactgataccatagggttcagcaattaagcataagtatttgccttatttcatgtaatccttacaatgcaaaatagtcattatttacttcactttctagttgaaatggttgagagggaaaacccaaagtcacacagtaaatggtagagctaggatttaaccccaggttttttggtctaagaaatgtaacttttaggtatttatataccttttttgagacaaggcctcactttgtgacctgggctagggtgcagtggtgcaatcatagctcattgcaggcccaaactcctgggctcaagtgatcctcctgcctcaaccttctcagtagtagctgtgactgtaggtgcataccaccacaactggcttagtttcttgtttttcatagagacatggggtgatcctgccaccttgcctcacaaagcgctgggattaatggcctgagccaccacactgggcttgaaacctatactctttcactaatcatgtaatctcccagtcaatctctcagaatctaagtaatagcaaaccaatatcaagtacgtgactcagctaggttgcaataactgcctctggtatacatgtacatgctggcacattacatgctcgcacaaagaatgttttcctattgcattttacctaacttgggaatgtttacaaaatattaataacaattattttgcttttattatactgtttctcaatgtttttgtttcttttcatgtaaataaaaaataacttagattgagatagatcaatatatgcatttaaaacaatttgaattatattaaaaacctctatcaactctctagagaaagatttttgttcatttaattcttcctgtgttttgtttgcttacatttattattggcctgtgtgctaactattcaaaatttacaaaatgtatctgagttttagaatcctggcatttaataattacaaacatgtttgtaatattcacatttttcacagttaaaaatgttttctcaatgtccttcagtctttgcatttctgcctaaaggaattattttaaatcattacttttaatgcaattatttacttattgtttatttccttgataattttctatgcccttaagtgaagatttctttatgttaatgtattccataagtcatggcatctgcatccagcagatgtttaggtggttatatttctttctttttacaattaaagaatgctctcttctctaacattattttcatcaggacacgtaggatattggtctttttccttaacttagtccttgagtgagtgttgttaagtattttccttcctagatccctttgttaagctgtacctgccagctaataatgataaatttgtactgtttgggttgtattctctacctgtaatctcacttagtttttagcatccaaagttgtcaatgttatctaagaagatgaggagttaattgaatattttcttccaattcatattttaaaatgtcctttgaaacccagcagaaaatgtttttgttgttttttgtttgtttgtttgttgtttttttgttttcttttgttttgagatggagtctcactctgtcaccagactggagtgcagtggtgcaatctcggctcactgcaacatccacttcccgggttgaagcgattctcctgcctcagcctcctgagtagctgggactacaggcacccaccaccacacttagctaatttttgtatttttagcagagagggagtttcatcatgttggccaggatagtctcgatctcctgacctcctggtccacctgccttagcctcccaaagtgctgggattacagtcatgagccaccgtgcccagcccagaaaaatgttttttatctgcttcctcctctccttctgtccctctgtcaaatttctctccatcacaaagtactattactggtttaactcttcttagattttcaaattttacctcatgtgttgtatcctttattgagcatttggggcactttgcactattttcttttttctctgttctagagcacctgctgtaccacttgtcactttgggtttgttgttgtttgaatgcacatttatatctgttccatatttagtattcttcatgcgtgtgccccactctttacagtgtttggcatatacttagcacttaattcatttaatcagtctttacaaaatattcttaaattcatactatttgccaagcattgccacagccattcaggattccaacagtgaatagacctttttcacttcatgggccaccctctaagtctaccttcctgatttcttctcacctgtttgatatctaaatgttggtagtcccaaagacttgatactttttcttctagctgtaatcattacctttaagattttgttcagtatcccatttagaaaatcagccatatacagatgatcttcaaatttatacttctagctttgatgcccagaatcttacatttaactttgtgttccaatcttctcttgaaagttcaacaggcatttcaaacttaacatacccaaagccagataccccacacaaacccactcttctgctgtctttctcaactcagtaaatgtcaagtccattatttcagcggatcagatcaaacacctggaagccatccttgagaaaaaagaagcagagatgaaaatgggtgatctctaggtaaaaggcaagtttttactgtgacatatgtgagtgagcagaccactcatgctctgaccccgtcacctgccactttctcctcatccactctactccagtcacgttggttcattttttttctgcagtgacattaatcatgctctgaccatagatccgttactcttcctcttccttctacctggaatgcccttccctcactcccccagatagtcataatttcacttcctttatatttctgctcaaataatctctctttagagacattgtggtaggaagaattctaaagatgtccctcccaaggtttctgactccttgttattcagccacacagtagtctaggtactgctatgatatgaaggtatttgcaaatgtaagcaagttgcacttaaactgttaacatatccaaaaggaaaatctaaaagagtaaagacagcaaaggtggcaacagaatttgtgaagaaggtttctttggaaagagctatgctatgattccaccattcctataaggagggatgagggtgcttacacttcaaattgtgagagggatttcaacagaaccactcagacagctttatatgtgttcccagacaagcagactgtggcctgaatttcaccagaaaaatctaaaagtcgtcagaggcagctgtgatctgcttacttatttgttgtcaaaggaaagttgctgctgctttgaaattaaaggtctgggcaagaaatacaagaatatttactgtggatcagatttgaatgccacaggtgagaacaaatgtacattctgcccgagatggctgttgggaatacagagtaaactccagtggaaacatggatcacagatatccagggacaaagaggtggtagccagagaaaaatatcacatatgacaagacatatgcttgtatgtttactccacagacccctgaaagacccaaaaaggtatctaggggtatgaaaatagatgaagcctttaaaacctgataggcccatacagcacaaagtcttcctaagacagttatcaatttggtaagaaactccctgtccactcttacgtatcgttcattcatccacgtaaaaactggaggtggtcataaaaaagatggaggaggagagttagaagtaaaaatagagaaggattaaggaaacatcattttctccttacctgactttgcaccagcaaaatatccagctacagaaagaaagaatcagatttggaattgtgattattatataacattagacattttgcaatgccaattatcttatatttgtaccttacaaggacaatacaactttttgttactgaaagctgagatgaacaaattatgggacctcctgagttttcttccagagataggagaaaacctttaccaaaaatcacacatttacagagtataagagaaaaaaagagtggttttagattatatcctataagccccatttgttcaatatatgcatatatgtgcatggtgtgatcaatatactagttaatataaaatgtgtatgtgtgcctatgcttatatacatgtaatgtgaagttcaaatgaggtaggtggattagagataaagattgtgagctaatggaatgttagctaaaacagtataattgaatcagcacccataaagagctgatgtagactagaaaaaaatcagctgagaagtgaacactgagaataccaatatttaagagctaagtagtaaaagaacataagaagaagactgaaaaaatgaatacataagataatagaatgttgtaaaatgtcttaagagttaagtattatcttcttatacaatctctggtataaatttttcaacacaatgcgatctagctttaaactctagaatcctattattgattgtcaaacatctaagttaaaagaaacagttacttttattacactgcaaaataaagcatcagttttttcacaccttcattacagtctcataacaattaaaattttagcttaaatattgaacatctttatgataattacttgacttttgcaacatagataacttacaaaggttttgcttaaaaagattttcctttattttccggtatgatatttcttataagatttagacctggtcagttccatttagaaaaattattacaaaagtttgtgaaaataatcataatgaatagaggagacccttatagaaacaatgatctgagaagtaactttaatgaagtcaaggaatgccagaaaccttaagatgaagctaggcatgctggctcatgactgtagtcccagcactttggcaggacaaagcaggcaaattgcttgaggccagtagttcgagaccagcatgggcaacacagtgactctgtctctacaaaacacaaaaataaaaaattagccaggcatggtggcttgtgcctattgtcttatccttaggaagctgaggtgggaagatcacttgagctcaggaggttgaggctgcaatgagccatgattacaccactgcatccagcctgggtgacagagtaagaccctgtctcaaaagcaaacaaacaaaaaggaaagaaacctcaagatgactacacttagagtcatatctaggaatctgaattcaatctaaaagtagtttttgcacagctctgcagtttactgtttctgaattatttaaaagttcatttcaagtaatattcagactcctaaaaactgcttgtgaatattctgttgtatcaatttcccaataatatcatatttcaattttataaatttaaattttcccttacttttttcctctctttcttctaatttgatagaatagcagatttgattgtattagatggctattagataatatttcatatgcaatttcttcaccattattataattatgtgaattgtatgctcctggaaattggacacagagtcttttagggaaagaaaagttttcattgatatacttaggaggtcacattgcaattcagacacaatatagatacattcagaataacataatagaaaaaatgaatatggaatgtggcatttttggaaatacagcagatagcattgcatactttaaacatatattttatgtactttttgttcatttgacatactactgcattatttgtagtatttggttcactagttctaaaatcttaaatgtgaaaaaagtaaggatcaataataaatcattactgtttatgtttaactttccttatatagcattatcttcatgtggttttaagactgactataaaataaaatgagattatttataataatccataaatatactgattttccgtgattttcttcaaaatcttcggttttatggaatttatttagaggcagttttgactgaatattcttcattgcaattttaccaagcatgctaagaactataaaaacatggtctataattaggtgaaatataagtcctgaaaatattactggaaataacagtggctatgggaggaagaatttaaaacagctaatataaataattttatgatgtaccatgtaaacaaccttgacagtttaaatacattattaagtactgtttttgtcaatatagtgtgaaacaaaagtatatttaaacttccaataatttttctcactctatttgaggaaagcttattccacaattcatatatcaatataaaagaatgtttctaaacatatgatgtgcaacaggtatttaatgacatttaggcacattagaactaagagtttatcttttatactaaaaataaatgaaattcatacaggtgtgcatgcttgctaaaaaaacaatttgatgaaatgtaataataatggtttggactgaggatgtcaaactacctaacttagattcaggtcattgaactgtgttctaccactaccttgctttgtttgtttttaatatacctaggccttaatgtgcacatctagacaatgtggggattcttcaagataatctatttaccttgaaattcaaagatagagaaagcttatatttttgttatattttaaatatctcaataaacaaaagtgtgttacaagagtcatcaggatgatgaagcaacaaatgctgagaagaatgttagatattaaatgattacagtattgtaaattatatatatacccttcaaatatgattcttttgaggctacaaatataaaatgaaataaatttggtgaaaaattttcttattctgaactttttaaacaatagctactattgggtgactttgagagctcttgaatagtgctatcatttcatcactatataatacaatacaaatataatataatattatatttatataatctatcatacaatcactatgtataatatatatagcattgtatatatagtattatatgataaatatttataaacaagatcgatagacataaaaaggaaactgaagttctaacctgaaatctcattcatgtcaccacaatgaaaattagatttttaactcaatttctggtgtctaatttgtcttacgtaaacatagccactccagcttttatgattaaatgttccattattttactcttaaccagtctgtatctttatatctaaaacgggtctcttagagacagcatagcattgagtttgacatttttgtctggtctgacaatctctacctttttatctaagggttagaccatattaatttaatgattgtcaatacggttgtgtttaaaacttccatcttggtattattttattttattgctgttattttctttttctcttatcttgccttattttcaattagacatatcagttttatattttttcacgattcacatttcagctccacaactggtttagatgggaggcaaataatgacttctcaaagatgttcacattctaatctcaggacctgatatattacatggcaaatggaactaagattgcagatggaattaaagttatgaatcacctgacctttaaataaggagattatcctggattatctggataggccctatctaatcacatacattcttaaaagaggacatcttgggcttggttccaagatggtcgaataggaacagctccagtctgtagctcccagtgtgagcgacacagaagatgggtgatttctgcatttccaactgaggtacccggttcatctcactggggcttatcggacagtgggggcaggacagtgggtgcagcccaccagtgtgagctgaagcagggtgaggcatcacctcaccagggaagctcaaggggtcagggaattccctttcctagaagagggaagggtgatagatggcacctggaaaatcgagtcactctcaccctaatactgtgctttttcaacggtcttagcgaacggcacaccaggagattatatcccgtgcatggctcggagggtaccatgcacatgaagcctcactcgttactagcacagctgtctgacatcgaactgcaagacagcagcaaggctgggggaggggcgcctgccattgctgaggcttgagtaggtaaacaaagctgccaggaagctccatctgggtagagcccactgctgctcaaggaggcctgcctgcctctgtagactccacctctgggggcagggcatagctgaacaaaaggcagcagaaacccctgcagacttaaatgtccctgtctgacagctttgaagagagtagtgcttctcccagcacagagtttgagatctgagaacggacagactgcctcctcaagtgggtccctgacccccgagtagcctaactgggaggcaccccccaagtaggggcagactgacacctcacatggccaggtacccctctgagacgaagcttccagaggaacgatcaggcaggaacatttgctgttcagcaatattcactgttctgcagcctctgctgctgatacccaggcaaacagggtctggagtggacctccagcaaactccaacatacctgcagctgagggttctgactgttagaaagaaaactaacaaacagaaaggacatccacaccaaaaccccatctgtacgtcaccatcatcaaagaccaaaggtagataaaaccacaaagatggggaaaaaacagagcagaaaagctgaaaatactaaaaatcagagcacctctccccctccaaaggaacgcagctcctccccagcaacagaagacagctggacagcgaataactttgacgagttgagagaagaaggcttcagacactcaaacttctccgagctaaaggaggaagtttgaacccaacaaaaagaagctaaaaaccttgaaaaaacattagacaaatggctaactagaataaccactgtagagaagtccttaaatcacctgatagagctgaaaaccatggcaagagaactacatgatgaatgcacaagcttcagtagctgatttgatcaactggaagaaagagtatcagtgatggaagatcaaatgaatgaaatgaagtgagaagagaagcttggagaaaaaagggtaaaaagaaatgaacaaagcttccaacaaatatgggactatgtgaaaacaccaaatttacatctgactggtgtacctgaaagtgatggggagaatggaaccaagttggaaaacactctgcaggatattatgcaggagaatttccccaacctagcaaggcaggccaacattcaaattcatgaaatacagagaacgccacaaagatactcctcaagaagagcaactccaagatacgtaattatcagattcatcaaagtttaaatgaaggaaaaaatgttaagggcagccagagagaaaggtcaggtttcccacaaagggaaacccatcagactaacagcagatctcttgacagaagctctaaaaggcagaagagagtgggggccaatattcaacattcttaaaggaaagaattttcaacccagaatttcatatccagccaaactagcttcataagtgaaggagaaataaaatcctttacagacaagcaaatgctgagggattttctcaccaccaggcctgccctacaagagctcctgaaggaagcactaaacatggaaggaacaatcggtaccagccactgcaaaaacatgacaaattgtaaagaccatcgaggctaggaagaaactgcatcaactaacgagcaaaataaacagctaacatcataatgacaggatcaatttcacacataacaatattaatcttaaaagtaaatgggctaaatgctcgaattaaaagacacagactggcaaattggataaagagtcaagacccatcagtgtgctgtattcaggagacccatctcacatgcagagacacacataggctcaaaataaagggatggaggaagatctaccagacaaatgtaaaacaaaaaaagcagggtttgcaatcctagtctctgataaaacagactttaaaccaacaaagatcaaaagacaaaaagaaggccattacataatggtaaaggcatcaattcaacaaaaagagctaactatcttaaatatgtatgcacccaatatgggagcatccagattcgtaaagcaaatacttagagatctacaaagagacttagactcccacacaataataatggaagactttaacaccctactgtcaacattagacagatcaacgacatagaaagttaacaaggatatccaggaattgaactcaactctgcaccaagccgacctaatagacatctacggaactcttcaccccaaatcaacagaatatacattcttctcagcaccacatggcacttattccaaaattcaccacttagttggaaggaaagcactcctcagcaaatgtaaaagaacagaaattataacaaagtgtctctcagaccacagtgcaatcaaattagaactcaggattaagaaactcactcaaaaccactcaactacatggaaactgaacaacctgctcctgaatgactactgggtacataatgaaatgaaggcagaaataaagatgttctttgaaaccagtgagaacaaagacaaaacataccagaatctctgggacacatttaaagcagtgtggagagggaaatttatagcactaaatgcccacaagagaaagcaggaaagagctaaaattgacaccctaacatcacaattaaaagaactagagaggcaagagcaaacacattcaaaagctagcagaaggcaagaaataactaagatcagagcagaactgaaggaaatagagacacaaaaaacccttcaaaaaatcaatgaatccagaagctggttttttgaaaagatcaacaaaattgatagactgctagccagagtaataaagaagaaaagagagaagaatcaaatagatgcaataaacaatgataaaggggatatcaccaccgatcccacagaaatacaaactaccatcaaagaatactataaacacctctacacaaataaactagaaaatctagaagaaatggataaattcctcgacaaatacactctcccaagactaaacaaggaagaagttgaatccctgaatagaccaataacaggttccgaaattgaggcaataattaagagcgtaccaaccaaaaaaagtccaggaccagatggattcacagccaaattctaccagaggtacaaggaggagatggtaccattccttctgaaactattccaatcaatagaaaaagaggatatcctccctaactcattttatgagttcagcatcattgtgataccaaagcctggcagagacacagcaaaaaaagagaattttagaccaatatcgctgatgaacattgatgcaaaaatcctcaataagatactggcaaaccgaatccagcagcacatcaaaaagcttatccaccacgatcaagttggcttcatccctgggatgcaagactggttcaacgtacgcaaatcattaaatgtaatccagcatataaacagaaccaaagacaaaaaccacatgattatctcaatagaggcagcaaaggcctttgacaaaattcgacagcccttcatgctaaaaactctcaataaattaggtattgatgggatgtatctcaaaatattaagatctatttatgacaaaccaacagccaatatcatactgaatggacataaactggaagcattccctttgaaaactggcacaagacagggatgctctctctcaccactcctattcaacatagtgttggaatttcaggccagggcaatcaggcaggaggaagaaataaagggtattcaattaggaaaataggaagtcaaattgtccctgtttgcagatgacatgattgtatatttagaaaaccctatcatctcagcccaaaatccccttaagctgataagcaacttcagcaaagtctcaggatacaaaatcaatgtgcaaaaaccacaagtattcttatacaccaataacaggcaaacagagagccaaatcatgagtgaactcccattcataattgcttcaaagagaataaaatacctaggaatccaacttaaaagggatgtgaaggacctcttcaaggagaacagcaaaccactgctcaacaaaataaaagaggatacaaacaaatggaagaacattccatgctcatggataggaagaatcaatatcataaaaatgggcatactgcccaaggtaatttatagattcaataccatccccatcaagctaccaatgactttcttcacagaattggaaaaaactactttaaagttcatacggaaccaaaaaagagcccacattgccaaaacaatcctaagccaaaagaacaaagctggaggcatcacgctacctgacttcatactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctttttaataaatggtgctgggaaaactggctagccatatgtacaaagctgaaactggatcccttccttatgtcttatacaaaaattaattcaagatggattaaagacttaaatgttagacctaaaacgataaaaaccctagaagaaaacctaggcaataccattcaggacataggcatgggcaaggacttcatgtctaaaacaccaaaagcaatggcaacaaaagccagaatagacaaatgggatctaattaaactaaagagcttcacagcaaaagaaactaccttcagagtgaacaggcaacctacagaatgggagaaaatttctgcaatctactcatctgacaaagggctaatatccagaatctacaaagaactcaaacaaatttacaagaaaaaaacaaagaacccatcgaaaagtgggtaaaggatatgaacagacacttctcaaaagaagacatttatgcagccaacagacacatgaaaaaatgctcatcatcactggtcatcagagaaatgcaaatcaaaaccacaatgagataccatctcacaccagttagaatggtgatcattaaaaagtcaggaaacaacaggtgctggagaggatgtggagaaataggaacacatttacactgttgctgggactgtaaactagttcaaccattgtggaagacagtgtggtgattcctcaaagacatagaactagaaataccatttgacccagccatcccattaaggggtatatacccaaaggattataaatcatgctgctataaaggcacatgcacatgtatgtttattgcagcactattcacaatagcaaagacttggaaccaacccaaatgtccatcaatatagactggattaagaaaatgtggcacatatacaccgtggaatactaggcagccataaaaaaggatgagttcatgtcctttatagggacatggatgaaggtggaaaccatcattctcagcaaactatcgcaagaacaaaaaaccaaacaccgcatgttctcactcataggtgggaattgaacgatgagaacacttggacacaggaaggggagcatcacacaccagggcctgttgtggggtggggagaggggggagggaaagcattaggagatatacccaatgtaaatgacgagttaatgggtgccgcacaccaacatggtacatgtatacatatgtaacaaacctgcacgttgtgcacatgtaccctagaacttaaagtataaaaaaaaagtggatatcttttctcccctgtattgaaaaagaaatgagatggaaaaggaagtggaagaaatggctttgaagatgaggaaagtgaccacaagcctagaagtatggatggtggctaggtggaaattgtcctccactggtagccatcaagggccccaaaccatcaaaggccccaatactataacttcaaataactaaatcttgccagcaaccccgctgaaaaaagaaacagattctttgctatggccccaagaaaggaactgcagataccttgattttagtgttttgagatctctgttggactttcagcttacagaattatgaaataatgaattgatgttacttaagatattaaatttcgtggtcatctattacagcagcaataccaaactaacatagttaattaactatattttactttttggtgtttgctctagggtttatagtatatatcattaacttatcacaatgtaccttcaaataatattgttaacactttacatatgctgtaagaaacttaccagagtacactaccctccctaccccagcacacacattttgtgctattagtttcatacatttaattctacctatgttgtacactccacagtactttgttatggtttttgctctaaacaattcattagcttttaaagtgcttaaaatgaaaggaaaaaagttttctatgtttacctacatatgtagcatttctggccctcttcatttctatatgtagatccagatttccatctggtattattacattctctgtcatggtattattacattctctgtcattattacattattatatttcaagagttgtaactcttgaaatctttcagctttacattgtttttagaaggtctttcttttagcttaatttttgaaagataatcttgctaggtatggctttttctttgtttgagtactttagaaattttccattgtcttctgggcttcatagcctctgaggagaagcttgctgccattctcatctctgttcctctgtgcagaatttctcctgtttcagtatttgtctggctacttttaaagtttttttttttctttttgatgctggctttcaccaatttgtttatggtatgctttagtttggttttctttctttctgctacttgatgttaattgtactttgtgtatctgcatttgtaattgttatcaaattcaaaaagatgtaagtaattatttcttcatataattttctgaaccccacacttcgagtattcttctgagacctcaattgctgatatgttaaggcaagtgacatagtcccacagttcaataaggctcatggttggtttttctttttcatattctttctcctatgtgctttattttggataaggtctttcatatgtcttcagtttcaaggattttttttcttctgaagtgtccaatgtgcttttaataccatccagcatatatttcatttcatttattgtatgtttcatctctagacattctagttagaatgttgcatatagtctccagacagaaaaccctaattggtgaattcctagctcctggtattctgctcagtttctctgggcagttccttcaacttacagaaccctgtagtacatatctcatctacttctgcatcctccaaactgagtctgagctttcagaattggttgaatcccagagaagtttttgtctttcatctgttgggctgtacccaactctctttccccagtgttcttttcctgccagccataaggtagataacagatattcattttggaatgatatggccgtttctctatgcagacccttttatactttggatcaagggcacaccagaaatctcacaccaacattgctttattcatgtaatccctgggcatttggcaacttctggtaattagaatagtttaaatcagtatctcaaaatatactattttaaaaatttgcttcaaggtaatagggacctaatctacatttttaaccttacatttccagaaccaaggtgagcacttgcacagaaaataggaaataaggaattcatgtttactgtttgtttgagtgagataactctgttttgattctataaacaattttacaagagaatttaaacaacaacaaaaacactgaaattctttaatacttttatgaaaatgccagaaatacctcttttacctttgtattaccattttctaatatggtgattcacagatatgagcattaaatatcttctgaaaattaacaaattcccaaaagtttgtgaaattgtaaatttttcaagcccccaaatctctttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttgggtccaagtctttgctattgtgaatagtgccgcaataaacatacgtgtgcatgtgtctttatagcagcatgatttatactcatttgggtatatacccagtaatgggatgtctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgatgtaggttgcctgttcactctgatggtagtttcttttgctgtgcagaagctctttagtttaattagatcccatttgtcaattttgtcttttgttgcattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttcttgttggtttcaaagaacatctttatttctgcgttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcattcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgtctgcccgttctcagatctccatctgcgtgctgggagaactactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacctgattttccaggtgcgaccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctgtcccaaatctcttatttaatttttaatcctaagtgtctacatttttatttctattatttttataattcaaagtataacaagaaaaaaaactatcaaaatagattttgtattactagaacataaaattagctacaaaatctgagagaattgcacttagaaatgtttaaactactcttcaaaccctgttgttgaagattacatctttttgatactgttttcataagtccccatgtctccaatacatcctcttttccatgcaaataactgagttattagtttactttcacttgtaatgagtagaaaagagaaaattaaacaacaactagataagcaacatacatatgagagctcactgaatccctcaaaataagaattgttgaaagcaaatttttaaaatagttcaaaacactgacattgcatctgatgctatttaggaaactgaggttcgtgaggtctgcagcttaccaggggtaacccatgtggagtagtgtgtagcttgaatacaaacccagttccgtcatctctctatacctgctctatccagtgcaccatctggcctctcataataacacatttgcatttgtaaaatttccttgaggtaagcaggagaccaagtggctgtgtaaattacatgatgattattctttctctggtcaacaggtttatgtgaaatagcacagtcaccataatcctaccaagatatagggaattattaaagttattacttattttgtgtaaagtctgcttttaagatcatattttcagtgctgtgaataaatataaattttattttttgttcataggatgttttaaaatagtatttacatatatctaatgagacatttatcatgatatactatttattcaaagaagcttgatcagtaaagtaatataaataatatataattataatagtaactgccattgaatgaatgactaattagtaccaaatgctttctggttaattaattctcacaactatcctgaaatgtagatactactatatccacttcaatttgaaacaaactactcatgatgaatttaatgctctacttctctaactattcattagatgtcctacactagctacctgctatgttgacttattttgctttctgctaatggtgtctttcatatttaactaatcattttcttttttttgcctttaggattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaaggtaaaagatgagacccttacagacgcaaatagttgacctgcatgtcaaattttacttattttttaagaaaataaaacagtacactatgctcattcattttgtgtatgtttttgtaattcaagtgttgaataaaagagcaaataagaagcatgttgaacaaataactctgccagagatacaacacatgctaaataagatgaaaaatagtaattaatattttgtattaatgccactacattatagtttccattatgagccaccaagaagcacacagaaatattaagaacttagatactgaaagtaatcattaaaattaatttgctatctgctttgcccacaatgtaaaataaatggattttttatcactatacggtggagttttaatgttctattttgtgatcttattaaatgagttgaatgaaccagagcattcaccataaagttatttttactcatgtgattttaaaatgatttagtctttcaaacttttcaaaatagcttaccttttataaaattcactagcagaaaaagtgtcttaatactaaggaggaggtgaggtaagtgaaaagttggaatggcaccagttcttcatgcatctttctgtattaggaaatgtaaacataatgtaaaattggaatcaggcttatggaatcaattgaatgataatttatattaaatatgaataggggaaaaaacaagaaactcacattatgataaagttttgagaaactaaagaaacaatggtaagtgtaatgttgatgttaatttaggaaaataccctgggaattaatgtggtaaagcctgctgttgtcaatgcttttttaaattcttgagaactaagagaaagaacaagatactttacaatatcaatgattaccagtcttcgataaggaaaaccagcacattatatggggtagtttattatctcaataacttttccacatttagtaatagttcagtaattagggatgaaatgaatatgcataaattgattagtggtgagtcaacagaagctttagttgagtacagtaacttaactattaataaaccactctaaacaaagtttaaaaaatacatttactgtattaaaatatttattacacacacaaacacacattgttggctacattacatatgtgctttcaagttaaatactcctaaaaacttacatcctagtattaatgacaagtgtgcatttaaataatttaaataataaaaagtagtaaatccagctaaactgccagaaaaatacacgtagtcatgtactcttttcttatgatgacaaacgttattttaattttttatttttattttttggtgttatggtagcatattttttggtgtctatacacaaacatttaaaatattctgaataactcagaatgctttgtctacagaaatcgataaattctttatcttagaatattcttaggttttgtagcaatatttgcaggattgattaaaggtccccatagaaaaattttatgttatctatgtttcatttaaattgtagcattctcccaaagtgttaatttttatatagccatatgaagatttactctctgaggtcatttaatgcatagcagaaatagtttaataaatggtacctaagctagtaaaagagcttatacaatttctctaatgcttagaagggtttggctaaactcttagccaacatttcattactttaattgctagaagttacaaaagttctcagggtaactgagaaggcatgctagtgatacgatacaactttgtttttatgtattcttttagttcaataagtaattttattaaaaaatcaccattaatttatatgctgattttttcaaatattccagcttataaaagaatattttcctgaaattcttgtttactgtagctataaatatatgtgtgtgtgtgtgtgtgtgtgtgtgtgtgtgtgtgtgtgtatatatatatatatatatatacacacatatagctactctatatatagctgctatatatagagctctcgctctcaaaaataggatggaatgagaggttatttaatctaggcttacttaaaactgccatgaagactacagttgcatagtgtggaaaaacaactggaaaataatgatgtttttctaaaaagtaactttcacattataaaattaaagttaattttgaaagtttaataaatgagtttgtaaatttcagctgggcacagttgctcatgcctgtaatcctggcactttgggaggccaaggagggtggattgcttaagctcaggagtccgagcagtgtgggcaatgtggtgagatcctgtctctacaaaaaacacaaaaattagccaggattggtggtacatgcctgtagtcctagctacttggggatctgaggcaggagaaggaggttggaggttgcagtgagctgagatggcacctctacactccagcctgggcaacagagtaccagagtgagaccctacctcaacaacaacaacaacaaaaggaatgtacaatttcaagcaagtgaaatatttgtagttttccaagggaaaaaaatgttataattttaattgagaaacaaatttgtttctatggctaattttctaaaatcatgacaattaagcaatacaaaatgaacatggttgtaatttgtagaattctttattctaagtaatcctgaaaaagtgagtaggaggaatatcaatttgggattttagctaccttacgtgttaagaatgtgctttcataaaagtatgtctacttttacttactctaaaaagttaatcatttattagttgctattctattgaaaacgctgttgtgtaagataaaggaatgataaagaaaactaacatttattcagctccacctagtcttttgtgtacataaaattattactgaaatagccctgtgaaagtataaatattcccattttatggctaaggactgaagtttattcatattcaataacttcacattatgaaatgagtacatgaataaactggtatttgaaatgaaactccttgatttctgtcttcaaatatttgtaattctactttcagaaataacaaagtaattatatataaaatgccatagaatcatcagtgcaacttattggatagtcttattcagtacgaataacatcaacaagtccttttccaataactagtttatgcagggttttttctcaggaatgaaatgaaaattaatgacattattggaggttatgtatacatttaataaacaggaagagatgtcaaagtgtagtgcatgggggattaattcattctttttaaaagatatgattttcctattaaatcaaataaatatggaggatttggaattgtgaatatttgtaatttctatgaatgaaatgaatctaataaagttttaaaagtataaccattctatgagaggctacgtgaccaataacgtatggagaagaaaagtgattaagggcagtggcttacttaaaaaactgctagagggctgccttgttgtaaaacttcagggcaccattgatagtgcaattcaggtagatggtaccctgttggagttgtgcagtacacagcctgtgcagccatatgctgccaacttagagattcattcacaaacctccataatgcccactttcttttcagttttgactctatattatccatatatatttgacagctaaaaacaagtatttcttagaaatgacttctttcaagtatagaaaacatactttgtattgtagtaactgttggaaacatatacgtattttaaatttatttatcccaattacattttctttagttcaaaatttcatgggtaaataaaagtgcattgttactgttgtattgaaaattaccaattcctaatataatgactccaatgtaggggtttgggtttttaaattcagaatgcagaacaatcaacaattttatattcaaaacaaacaacatctggaaatttaacttctatttttttttcattcttccctactggtttagaacagttaataaaaaattctgattaaattttatattttattaatttgtgattctcatacagtttttaagcacataagataagaatttagcataaacttaaaacactcgttggtagcaaacacattgggggaattcatcttatgagatgaatccatgtctctaccctaagctgacctattagtccttaccctgtgtagacctaatagtctgattctgtccaaactttaatgcaattagttaggttactattcttttatctagatcagttatttgcaagtgagtttaaatgatagatgaagtctcagttaagtgctctaagaatacctaaaggctagacttacagagctggctaataaataataagaaaatagtttaaaatcaaatattatatatacttgaacaatccaatcagtcatgattttcttgaaattctaaaatgttcttttacacagagcttgtaacgctggtaggcagacatattctctgaggttactaatcaaaattccgatcaaatgtacgtgcattttcaggtatagactcaaatgcacgagggtgttcaagtagacattagaaatcctatttctgctttacaataactagccaattgcaactagaagaactgttttcaatataatattgaaacttcagctggactctttcctcttagttcttaaatgtcatatttggagagctataaaattttaaatgtctgtataaaaaactatacaatatgattcctaattctttaatataagagactcagaagattatcaggaataacaaagggatcaattggatcaatttcaaaatgaaatagaacaatatactaattatacaagattttaaaacaggttttctttacattttattattttatttttatttttttttattttttatcatactttaagttctagggtacatgtgcacaacgtgcaggtttgttacatatgtatacatgtgccatgttggtgtgctgcacccataaactcgtcatttacaataggtatttctcctaatgctatccctccccgctccccccaccgcaccataggcccttgtgtgtgaagttcccaaccctgtgtccaagtgttctcattgttcaattcccacctatgagtgagaacatgtggtgtttggttttctgtccttgtgatagtttgctcagaatgatagtttccagcttcatccatgtccctacaaaggacatgaactcatctttttttatggctgcatagtattccaagatgtatatgtgccacattttcttaaaccattctatcattgatggacatttgggttggttccaagtctttgctattgtgagcagtgctgcaataaacatacgtgcacatgtgtctttatagtagcatgatttataatcctttgggtatatacccagtaatgggatggctgggtcaaatggtatttctagttctatgtctttgaggaatcaccacactgccttccacaatggttgaactagtctacagtcccaccaacagtgtaaaagtattcccatttctccacatcctctccagcacctgttgtttcctgactttttaatgatcaccattctaactggtgtgagatggtatctcattgtggttttgatatgcatttccctgatggccagtgatgatgagcattttttctgtgtctgttggtggcataaatgacttcgtttgaaaaatgtctgttcatatcctttacccactttttgatggggttgtttgatttttttcttataaatttgttcaagttctttgtggattctggatgttagccctttgtcagatgaatagattgcaaaaattttctcccattctgtaggttgcctgttcactctgaaggaagtttcttttgctgtgaagaagatcttaagtttaattagatcccatttgtctattttggcttttgttgccattgcttttggtgttttagacatgaagtctttgcccatgcctatgtcctgaatggtattgcctaggttttcttctagggtttttatggctttaggtctaacatttaagtctttaatccatcttgagttaacttttgtatatgatgtaaggaaggcatccagtttcagctttgtacatatggctagccagttttcccagcaccatttattaaaaagggaatcctttccccatttcttgtttttgtcaggtttgtcaaagatcagatggttgtagatgtgtggtattatttctgagggctctgttctgttccactggtctatatctctgttttggtaccagtaccatgctgttttggttaccatagccttgtagtatagtttgaagtcaggtagcatgatgcctccagctttgttcttttggcttaggattgtcttggcaatgcaggctcttttttgattccatatgaactttaaagtagttttttccaattctatgaagaaagtcattggtagcttgaaggggatggcattgaatctataaattaccttgggcagtaaggccattttcatggtattgattcttcctatccatgagcatggaatgtacttccagttgtttgtatctttttttatttcattgagcagtggtttgtagttctccttgaagaggtccttcacatttcctataagttggattcctaggtattttattctctttgaagcaattatgaatgggagttcactcatgatttggctctctgtttttctgttattggtgtataagaatgcttgtgatttttgcacattgattttgtatcctgagactttgctgaagttgcttatcagcttaaggggattttgggctgagacagtggggttttctaaatatacaatcatgtcatctgcaaacagggacaatttgacttcctcttttcctaattgaatatcctttatttccttctcctgcctgattgccctggccagcacttccaacaatatattgaataggagtagtgagagaaggcatccctgtcttgtgccagttttcaaagggaatgcttccagtttttggccattcagtatgatattggctgtgggtttgtcataaatagctcttattattttgagatatgtcccatcaatagctagtttattgagagtttttagcatgaagggctgttgaattttgtcaaaggccttttctgcaactattgagataatcatatggtttttgtcattggttctctttttgtgatggattacgtttattgatttgcataggttgaaccagacttgcatcccagggatgaagccaacttgatcatggtggataagctctttgatgtgctgctggattcggtttgccagtattttactgaggatttttgcatcaatgttcatcagcgatgttggcctgaaattctctttgtttgctgtgtctctgccaggctttggtatcaggatgatgttgacctcataaaatgagttagggaggattcactttttttctattgattggaatagtttcagaaggaatggtaccagctcctccttgtacatctggtagaatttggctgtgaatccatctggtcctggactttttttggttggtaggctcttaattattgcctcaatttcagagtctgttattggtctattcagggattcaacttcttcctggtttagtcttgggagggtgtatgtgtccaggaatttatgcatttcttctagattttctagtttatttgtgtaaaggtgtttacagtattctctgatggtagtttgtatttctgtgggatcggtggtgatatctcctttatcattttttattgcatctatttgattcttctctcttttcttctttattaatcttgctatcagtctatcaattttgttgatcctttcaaaaaaccagctcctggattcattgattttttgaagggattttgtgtctttatctccttcagttcttctctgatcttagttatttcttgccttctgctagcttttgaatgtgtttgctcttgcctctctagttcttttaattgtgatgttagggtgtcaattttagatctttcctgctttctcttgtgggcatttagtgctataaatttccctctccacactgctttaaatgtgtcccagagattctggtatgttctgtctttgttctcattggtttcaaagaacatctttatttctgccttcatttcgttatgtacccagtaaggagcaggttgttcagtttccatgtagttgagtggttttgagtgagtttcttaatcctgagttctaatttgattgcactgtggtctgagagacagtttgttatgatctctgttcttttacatttgctggctgaggagtgctttacttccaactaagtggtgaattttggaataagtgtgatgtgcttctgagaagaatgtatattctgttgatttggggtgaagagttctgtagatgtctattaagtctgcttggtgcagagctgagttcaaggcctggatatctttgttaactttctgtgtcattgatctgtctaatgttgacagtagggtgttaaagtctcccattattattgtgtgggagtctaagtctctttgtaggtctctaaggacttgctttatgaatctgggtgctcctgtattgagttcatatatatttaggatagttagctcttcttgttgaattcatgcctttaccattatgtaatggccttctttttgtcttttgatctttgttggtttaaagtctgttttatcagagactaggattgcaaccctgctttttttgttttacatttgtttagtagatcttcctccatccctttattttgagcctatgtgtgtctctgcacatgagatgggtctcctgaatacagcacactgatgggtcttgactctttatccaacttgccagtctgtgtcttttaactggggcatttagcccatttacatttaaggttaatattgttatgtgtgaatttgatcctatcgttatgatgttagctgcttattttgcctattagtttatgcagtttcttcctagtgtcaatggtctttacaatttggcatgtttttgcagtggctgttactggttgttcctttccatgtttagtgctttcttcaggagctcttataaggcaggcctggtggtgagaaaatccctcagcatttgcttgtctgtaaaggattttatttctccttcacttatgaaatttagtttggctggatatgaaatactgggttgaaaatacttttctttaagaatgttgaatattggcccccactctcttctggctcatagagtttctgctgagagatccgctgttagtctgatgggcttccctttgtgggtaacccgacctttctctctggctgcccttaacattttttccttcatttccaccttggtgcatatgaaaattatgtgtcttggggttgctcttcttgaggaatgtctttgtggtgttctctgtatatcctgaatttgaatgttggcctaccttgctaggttggggaagttctcctggttaatatcgtgcagagtgttttccaacttggttccattctccccatcactttcacgtacaccaatcaaatgtagatttggtctcttcacatagtcccatatttcttggaggctttgttcgtttatttttactttttttttctctaaacttgtcttctcgcttcatttcattcatttgatcttcaatcactgataccctttcttccacttgatcgaatcggctactaaagcttatgcacgcatcacgtagttctcatgccatggttttcagctccatcaggtcacttaaggtcttccctatgctgtttattcctgttagccatttgtctaatcttttttcaaagtttttagctgccttgcaatgggttcgaacatcctcccttatcttggaaaagtttcttattattgatcttctgaagcctacttctgtcaactcgtcaaagtcattctccatccagctttgttctgttgctggtgaggagctgcgttcctttggaggagaataggcgctctggtttttagaattttcagcttttctgctctggtttcttcccatctttctggttttatctacctttggtctttgatgatggtgacctacagatgcggtcttggtgtggatgtcctttttgtcgatgttactgctattcctttctgattgttgcttttccttccaacagtcaggaccctcagaggcaggtttgttggagttttctggaggtccactccagaccctgtttgcctgggtatcaccagtggagactgcagaacagtaaatattgcagaacagcaaatgttgctgcctgatccttcctctggaagcttcatctcagaggggcactcggctgtatgaggtgtcagtcagcccctattgggaggtatctcccagttaggctactcgggggtcagggacccacttgaggaggcagtctgtttgttctcagatctcaaactccggggtgggagaaccactgctctcttcaaagctgtcagacagggacgtttaagtctgcagaagtttctgttgccttttgttcagctatgccctgccctcagaggtggagtctacagaggcagggaggcctccttgagctgctgtgggctccacccagatcgagcttcctggctgctttgtttacctagtcaagccttagcaaaggtggacccccctcccccagtctcgctgatgcctcacagttggatctccgactgctgtgctagcagtgagcaaagctccatgggcgtgggacccaccaaaccaggcgcaggatatagtctcctggtgtgccatctgctaagaccgttgtaaaagtgcaatatcagggcaggagtgtcccaattttccaggtaccgtctatcacggcttcccttggctgggaaagggaattccccaacccattgcacttcccaggtgaggcgatgtcccgccctgcttcggctcatactctgtgggctgcacccattttctgaccagtcccaatgagatgaacccagtacctcagttggaaatgcagaaatcacccgtcttctgcgtcgctcacactaggagctatagactggagctgttcctgtttggccatcttggaatgattctctttctttacattttagattctataagatgaatttttttttagattctgcaagattaagttcacatattaaactacaatgtatatgttaagcacctatctcattctttattccactttgttacgtaaaatttcataattgaatattttgaattcaatgtattataaaattttaaaaacatttaaattaatatactttgcctttttcctaaaaagttgtaccatgggacaataagatatagtatattattttgcagttttactattttctaatgccacttttatatagcaagcattaacagcaagcttttagaatatgaatataaaatgcactaaactgctttcagataagactgtatatattacatattatatgtgtatataattatatacagttatctcttagtatccgagggggatcgatctcaggaccacttgtgaacaccaaaatcaagtcactcaaatgccttctataaaatggcaaaatattgacatataacgtacgcacatcctcttatatactttaaatcatctctagatttttattttttgaaaattttcaattagcggttggttgaatctataaatgcagaactcacagatatgaagggcaacagtaaatataagagtaataatataaggcaaactatattgtgactatttagaattttacatttctctacgaacgtcctccttcaagtggttgagtttgaaaataggcaaagactatttccagatcggtttaaatgttttcagcttatttttaaaataacagcttatcagaaataattttatattatatcctgttcctaaattgcatatatggctgaaactaaaaagactaatatctcttaacattatacaatattaaaatttataataaggtctttaacataactggaaagaagcattaactttttcctagattacttttgtaacacaaagttacttgtctatatcacagaaacttttaaatgaggggaaaacataatcagttaattgcttcagcagcagtcaattagttgaatttacatttctgacttgattgaccttttaaaagtaaatgataagaagtatttttcatcatataagtatcttttatacttttaaaaaatccaatccaggaattctgaggaaaaccaaggtgatatattgacaattaggaaagtagtatgagtgctctctctgtctctatagatagatattagatagatagatagatagatagatagatagatagatagatagatgatagatagacacatgtatgtacctatatgaatgtatctttataagtaaaccaattaatatgtaatacatgtcttccaaaggcacaaaaagactaagtgaagtttgataacatagaaattacactttctttgtttaactagaatccttgaagtaacatttttaatgtcattgcagacccaccttgccagactgagctcagcaatattcagaagcggcaaggggtaaagaagctcctaggtgagtaatagatcattcttctgaaggctttattgcttacataaataaccccagggaaacagcaacataaaatcaatattaatccaacaaagatagactgcactaaatttcagcaacaaaatttatgaactttttgaaagccattaaacttacttttattaccttacctattgaaagatattatgtctgttttattaccctaatataatgttcattttgaaagttattaagtaaaaagaaagatttaagcaatgctaaagttaaaacatcagcagaaaattcagttcaaattatatggtgaagatttaagaattgatggcaaatatatatatatgtatatgtgctatttaaagcatgtagttttataaattgggtgaaaagtgctctgagtacctcagggaaatttgaatagacttgttggtatttttcattagtgttttttactacccttcttttaataagtaaatgtataagtagatagatatttcagattttattcaaagccttgaaatatttgaatgtttggatataaacagattattaaactgttacatatgagtggtttattcttataaacttacaatttttaaataaactatttttggaatagttttaaatttataaaaacagtgacaaaggtacatagtttccaaacattcttcacccagcttccactaaatataacgtcttgcatgtgccaaataacgatgaaacatttgtaaatatctaagaaattagcattgctataatcctattaagtaagcttcagactttatttggttgtcaccagttttgccactgttctttttctattttagaattcaaagcatgacagcacacatgcaatatttcttttcacggatattaacacactcgtgtatttaatggcacataactctaatgtctctggatctgattaatctgttttatattttgacttactatctttgtaattacaatatattacatttaaataagaggatttttcacattacttgcaaatctttgtttcagtgcccattgtacaaaattaaaagtttaatgttttgtaataaaacatttttaggtgtgaaaattactgatgataaatgctacaatgtgtcatgtttcttttgaccctgttacaagatgcaggagataccacagctcacaaatgaaaataatacattctggctgggtacagtggctcacgcctgtaatcccaacactttaggaggccaaggtaggcagatcacctgaggtcaggagttcgagaccaccctggccaatatggcaaaaccccacctctactgaaaatacaaaaattagcctggcgtggtggtgtgtgcctgtaatcacagctactctggcgcctgaagcaggagaattgcttgaaccggggaggaagatgttgcagtgagccgagatggcaccaccgtacaccagcctgggtaacagagcgagactccatctcagaaataataatgataataataataataataataataataataataataagttcttatatagatttgtcttggcaaatcaaagtttagccatgtaccataaagaaagccattgaaattcaacttaaaaatattttctacttaaattctattagtagcaaaaatctattagaatacaggtttttattatttgaaggtataaaaaaatacttagttcccatttgggaagagttaccttcattattctttcataatataaatgaaaattattatagagaacactaaagtctttaagcatttcttctaatttgggtggggtattagtacgcgtctgaaattgatcacttgttatataggagtatgatgccccatgtcctgatttggagattcagtctttgaaaggaaaagagaatattcttaagaattatgctaaaacttcagacatcaaccaactttactggcataaagtatcaattatggtcacactaactatacatcataacatgtttatgtcaaattcaaatggtagttgtaaaagctgtagatgtgacaacagtgaattttttccttattttttctggcctttaatccatagaaagcgttctgaagttaatgatattctgtctatctaattgaaagattagcagttcagctattttgaataaattatagttttttaaactaagttaatctacgtataacaattttcaaactttttgagatagtgaagttatgatgttatatggttacaagactaagttttgtcttttatccatttatttatttattttttaaatttcaccaaataactattatgcttctggtcacagaaaaaaaaaaagtcagaaaataaaagaaaatattcttatctcctggaacttatattctggtgttggagtacttattaaaaaacacgacttcacttttaaattactaattaagggtttatcatgagcattgtgccatagagtatgttagattttatagatataaaaagaagtctctagtcggggatgacggctcatgcctgtaatcccagcattctgggaggttgaggtggatggatgacttgaagtcaggagtttgagatcagtcttgacaacatggtgaaaccccatctgtactaaaaacacaaaaattaccttggtgtggtggtgcatgcctgtaatctcagccactcaggaggctgaggtaggagaatcacttgaacctgggaggcagaggttgtagtgagccgagatcgccccactgcactccagcctgagtgatggagtgagactctgtctcaaaaaataaataaataaataaataaatgctcaccatcactggccatcagagaaatgcaaaccaaaaccacaatgagataccatctcacaccggttagaatgggaatcattaaaaagtcaggaaacaacaggtgctggagaggatgtggagaaataggaacacatttacactgttgctgggactgtaaactagttcaaccattgtggaagtcagtgtggcaattcctcagggatctagaactagaaataccatttgacccagccatcccattactgggtatatacccaaaggactataaatcatgctgctatgaagacacatgcacacgtatatttattgtggcactatttacaatagcaaagacttggaaccaacccaaatgtccaacaatgatagactggattaagaaaatgtggcacatatacaccatggaatactatgcagccataaaaaatgatgagttcatgtcctttatagcgacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaagtgacgagttaatgggtgcagcacagcagcatggcacatgtatacatatgtaactaacctgcacattgtgcacgtgtaccctaaaacttcaagtataataataataaaaaaagaaaaaaaaaccatagagtaaaattaaataaataaataaataaataaataaaaaatatttatctatctgttctactattcccaatagactgtgttccctctcgaccatgggcttgagatgttgttcacacaacaataaaaatgaagagaacctaaatatttctaaccatagatgatatcacaatgtagtggtgaaagtatgcaaggacagtcaacacacacacacacacaaacacacacacacagagaatggaagaagtaatcaggaatctttcattttgaggaagactttaaattgtgggtcacatttatgtcaaatcttaaagtggaagagagaggagagagactctagtcgacataatgtgtaaagagacaaaacagcattgaatttgggaaaaacacatagcttgatttggaaagaacttggaatataggaatgaacatttggggaaatgaaagtagaaagttggcagcgatgaaggcagatggtggcaggtcttctgccatgctaagtggtctgggtgatttaatataagcatggcactaatcagattttaattctgtattgtgcctctgaaacactaccctttgcacagtgagaactagtaagatagtactttgctttacaaaggaaatgaatccatgaactataagcagttcattgtggcaatggccagctccatgacacaaaagacttccctgatttcttctaaggcatcactggtatctatcctggaatacagtggacactccatatgtgtaagtctttaatgcattaatgcataatgggtgcttctcagaaaggagcacagcttattcataaactacatgtgtgtgtttgtatgcctgtgtgttgtttcaacaggacagtatatccccctgtgtgatgaagatggttactacaagccaacacaatgtcatggcagtgttggacagtgctggtgtgttgacagatatggaaatgaagtcatgggatccagaataaatggtgttgcagattgtggtaaggagaagggttacttatttcataattttctaagcacagaattaagtgctttagagcctcattcatttgttcaagcatttaatgaggacttactctatgcaaagactgtagaatatctagggtggagggagtgacaaaaaaaacttactcctagcatgttaaaaacttggatagataataagtggtcattgcataatttagattttctagagagattaattaaaagctgagttcctttcctacttcaaattcagaaagttgttgaggtacttcttttcctctcagctaaagcagacctttctcattcatcctactgcaagtcaataaactctatttatcgtgtcttcagatgacacccttttgtctgtatacctctggagatggtaacttagggaatatgtgggttcaccagccaaagaaatacaaacctttttaaagtaaaagtccataaattacagctatatgagcatgtttccttgtgcttgagtgaggaaaatgtagtttgactgtttaaagggaattatagctaatattctaattcttttttaggaacatgcattttttatgtatatatttaaaatagaatgtaacgcttagttgagcataacatacatgcattttaaagtttccattgtggtaccatttgtacttcataaaacatttttctagaatgcaagtgtcaattttcttggtattatagacagttttcatgacaaaagccacctcattgtagacacacacacgcgcacacacacacacacaccaggaattaattctttgtgtttcaattaatataaatgatcaaaaatgagaataaaatactttttaatcttgcattttagaaaatatttagatgtattcttcaagcaaattttagactaataaactaagactattaaaaaaagataaacaataaaagtaatctcatttaaactttaaattcctgctctgaatccatttgttcataacatttttaacagcttagtttcggtttgctgacctggccaatgcagttagatttaagtaggaagaaagaggattcaatagctgccttacataaattttacatatagggaacacatctttgtaatgtgtgctgtaaagtagttgcattataaattaattctgttgtcattgatgacaatgatggatacataacttttttatgttgtaaataaaagttatatggagatgagttccttaagtgaacaagaacattgcttttggaacgtggacatctgagttttctttacattttataactaacacagtagatgaagttggagaactaaatattttcttcagttaagatgggaattttagtgtgttgtcttgtgagatcaaccaatttataaaccttgaattacatcaataggatttgttataattagataccaaataattataagaataaaatattagaaagagtataaaataaatccacgctagcatttgaggagttgaaaagtcaatacacagtgagtgctaagatgtatgtgcattattgcctccataagtgttaatagttatttttaaaatattttgtaaaatattagttttctgttgctttagtaacaaattcccactcagtggcttaaacaacacacatttatcctacatttctgtgcctcagaagatcaacacaggtctcactaagctcaacatccagatgtcagcaggatggtgctcctctctggaagctttagaggaaaatctgtttccttgcccttttcacctcttagaggtagctctcatcccttggttcatggactctttcctctaaacttaagccgacaacactgcatctctgatcattcttctgtagtcatagctccttcccactctatctggaaaacatttttttttttattttaagaacctaagtgacaatttggatccacctgggtaattcaggataatctctccaattcaaattcctttacttaaccatatttgcaaagtcactttttcatgttaaggtaacattatagattctggagattaggaaatgaatatctttggtagggcaatttttctgccacacttgtagaagaaattttgaattctttgcaaaatgcacagtctgacatgaatttctataacaactgggatgagatcaatattactggactggaaatcttgcataacatacctcaataatgattctgcttttagcacatacattttaacaaatgatagatttttaacatgtgataattttccagaaaatggatctttcattatctttgataaataagatagaaaacaaattactttctaaaaaatattcttaatttttataaggattttatcttgcagaaattgacagtattcagtcaaataaaggttatgtttactttcacttgttttaagctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaacc

SEQ ID NO: 36862 - DNA, 501168 bp, Homo sapiens; identical to SEQ ID NO: 36861

SEQ ID NO: 36863 - DNA, 11168 bp, Homo sapiens
gatggcggcagccgaggccgcgaactgcatcatggaggtgagcgcttggagcgccgccgtgggcgggaggcggctttgggtcggtgtttcacgcctctgtggtggggaaagggctctaagttggcgatatggggttggaggtcccccgccgcacacgggggcgccgcacgttccacatccggggatatcgtttgaggtgacggctccctagcttccaagggccttcggcatccggcctagcggagggtcttatcccccctcccacgtggaggagggctgggggcgcttccggccaggcccccacgtggccgctgcgcggtgggtggggagggggtgtgccgagtccagtggcccggcgggctccacgtgcgggacaaaggccccgcccccggccggggaggggcgcccaggggggcggggagggggtccgaccctcctgacgcccccagccctcctccccggggacctgggcacacgccgtggggtgtgatcgacctggggccctccacgatgtggggagtctcttgggaggagcagtgcttctcagccctttaccaacctccttccgagctccgggggcatctgttgggatatcggacccggttttgtgcgttctgggttagggactggaggaaaaccaagaatggggtcccccgccgaccccgtttcccctcccagaattctccccctcgcccagggctttaggagttgggggatggggcatgcccctgtgacctccctctgggtggtggtggggcatctagatagagattttcccattaataggcgccgtgcacccccttgtggccatttctgggtgtgtgggagggacatctttttcatggggcgtgtcctgaagcccacctcccctcggatttcttcctggcgggcggagggaggagggtatgtccgctgggaaggagttgtgggaaatatgtaggctgagagctttaccctactggagccgtttatctcccccgggtctttgtgagggtgcgagatgacctccttcttcctgaagccctgtgcagggtcctgagccctggggtcctgagagtgggtgcctgaaatggtttcgagtgaggtttggttctcgtgcagccatgtgggggaggtttcagtcttgcgtttcaagccctctggggctggggttgtctggcggtagttttcagtggtattgagaaataggcccgagtgggaaaccccctcagcacctttcttcttataggcatccccgctagcttgggagagctggagggagggtgcttggagcctagtaggtcatggcctgtgacgtggcccttcttggagacttggatagtggtcacatctggaagagatgtaatctgatggggcctctgtccttccaccccttacctatggcattggctggaggggcaggtcagctctcagctgtcaggatgcagctcccaggggtcactgtaatgacttcccaccctcttggctgtctcctgcacctggggctctatggatggaggaaataactttcccagaggtggcctcaggcttggccgcacctggaagtcttcagggcctgggatgggtgtctgaatgggggcgatggcctgactccccaagccactttttttttttttttttttgagacggagtcttactctgtcacccaggctggagtgcaatggcttgatctcggctcattgcaacctccgcctcccgggttcaagcgattctcctgcttcagcctcctgagtagctgggattacaggcacccgccaccaggcccagctaatttttgtatttttagtagagatagggtttcaccatgttggtcaggctggtctcaaactcctgacctcaggtgacccacctgcctcggcctcccaaagtgccgggattgcaggtgtgagccaccgtgcccccaagccactttctggagtcctctcattcttagagggtccaggagctgcccatcttccctgggaccctaccttcgtgggcagagggtcataagggagggggttggttccagctggttttgtttggggctcctgagtccaaggcaggagctggggtctggggtactagctctggggaagtacccgtgtgccacacctctattctggaatcctctcagacatgagactggtttgcagaggtggcagatgccctgtgggcatatcctgccagccccgctcccttctgctattcatggcaccctaggataggggtgtgtgtgtcaggaagtgtcacctaatctggaggagattaggtgatgagagggagcgacagctggcggtggtgggtgccaattcccctggcctggatgggggaggtgtgtggtcagctgcctggccagagaggggcagcgtgggggtgggccaccatctctccagccacagctgggataggagacccccctttcttctcccctcacttttcccaccctttcttaaacaccccacctcattacttgcccccttcgccaccactccccaccaagaaggagaattgctggaaacccaccccccggccagagcccaggttccgccacccagccctcccacagccactcccagtagctaatcctttttccctgttactctctcctagaattttgtagccaccttggctaatgggatgagcctccagccgcctcttgaagaagtaaatatccttttgtgagacccctccccaccctgacctccacatcaatatatcttgccacacatctggccctttcttgaggtctaaccatacccctcttgcttcaaaccagtttaccccaggcccccagacacttagtagcaacccctccaggttcacagcccccgctggcctcccccagtatcgccgctacttccttaactccacctccaacccccctttgcccttccctgtgtctgcccccattttccttcccctcccctccccagctgtgggctgagctagagacggggtcagagagactggagagatggtaggcgtggctgaggtatcggggtgctcccctggatggtgctctgggggggtcctggaagtggaaaatggggttgttaggttttggggttcctgggggggcaagatggcaggcgggggctgtagggttgtcatggtatgattttgggggttctatactactcttcagggaaaagtagggcgctggaggtttaagaggctgtggggagcccccagatctgacccatgatcccatcggccccctcccaggtgtcctgtggccaggcggaaagcagtgagaagcccaacgctgaggacatgacatccaaagattactactttgactcctacgcacactttggcatccacgaggtcagtggggacagtccccaaggccccaatcttaggggggcttaaatgttggggaaggggtggaacctgttttcccacgcatgcgcactgcttcccctggccgcaggccgcccccctgcccctctgctgcgcacttcctagggtcgcctcgccaagccgttgccttggagaccgaggttagcctgaatctctgcaggggcctcgcgccgaaggctggggtgggagagcgcatgcgtgcctggggccttagccagaggtcgggcagggcccactggtctctgccgccctctagtgaccggcggtgggactgcgccccggctgctcccgccctaacagcttctgcacacttcagatctgactgaagacactgaaatcccagaacgaagctggggtggcattctaaggaattttcttttccccctgaggcctttttcataaaattgtggcaaaatatgcataaaattgccattttttatttttagagacggtctcgctctgtcgcccaggctagagtgcattggtgcaatcatggctcactgcagcctcgacctccccggctcaggtgatccccccacttccactttcggagtagctgggaccacaggcgcgcgccaccacgcccagctgatgttcttatttttctgtagagataatcttgccttgttgcccaggctggtctcaaactcttgggatcaagtgatcctccggctttggcctcctgaggtgctgggattacaggcgtgagccaccgctcccagcctgaggacttttaaaagccagggttcactggttcttaggtagcagtggtgaagtccggccaagattggagtttagaccatctaatctgattttttaaaaagggaaactggctgggcgcagtggttcacgcctgtaatcccagcactttagggggctgaggtgggtggatcacctgaggtcaggagttgaagaccaacctgggcaatatggtgaaaccccatctgtatgaaaaatacaaaaattagccgggcatggtggtgtgcacctataatctcagctacttgggaggctgaggcaggagaatcacttgaacccaggaggcggaggttgcagtgagctgagattgcaccattgcactccagcctgggcaacagagtgagattccatctcaaaaaataaaataaaataaaaataaataaatgaataaatataaaagggaaactgaggtgcatggaagaaagcgagagggccgagctctggccctccgagctctcaggacacgctgttctccagctggggatatggggcccctcacggcgtctctgtgccattcttgccctaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcggggtgagtctccagggtggccaggcggggccgggcctgagggatggaggggagcccatcagggctcagggattggatggaggtgatgggggcaggggatgggtctcaccctcccttcttcctgggccctcagatcgagtgttccagtatctctgattatgcggtgaagatcgtcaaagccaacaagttagaccacggtgagcccagaaagaggatgggtttgtgggagtggagggggtgatgccctgcttccccagggccctctgaagagcagtggggtctacagatgaccacagattcagcagctcccaacccatggtcttttgggctgccggccgcctgagaatctgagtgtcaaaatcacaggcttagcaccgcagtcttaaaattagggcaagaagcactctctagtttcttgaatgagtaatagagtcacgtggttggccacggaaggcccacagtgagaagccttccctgtttcccagctgccctcctctgagtttaaccaacactaacttccagagaagtctggacctacaaacacatacatacgtaaatgcatttacattctcgtgcataattttcacgccagtagcatttcataccagcctcttgcccttggcttcttacacctgcttgtcatgtcgtttaacactttccaggatgttgcggcatccgctcttttgcatgaccaccatcataggtacatccccagcatttttttttttttttttttttttttgagatggagtctcactcttttgccaggctggagggcagtggcacgatctcagctcactgcaagctccgcctcctgggttcaagtgattctcctgcctcagcctcccaattagctgggattacaggcgccagccaccacgcccggctaatttttttgtttttttagtagagacggggtttcaccgtgttagccaggatggtctcgatctcctgacctcgtgatctgcctgcttgccttggcctcccaaagtgctgggattacaggtgtgaactttttttttttttgtatttttttagttgagacatggtttcaccatgttggccaggctggtcttgaactcctgacctcaggtgatccatccactttggcctcccaaagtgctgagattacaggcgtgagccaccgtgccatcctgaagtgatttttaaaaagagattattataatgaacgcacgagtccatttgaagcaaattcccactgtgatgtaattttcccggtaaatgcgtctgcttgtgtcttatctaatagataaaggctgttttgagaatgtgatcatgctgttacttattatatcaaaaccacccagttaaaaacaaaatcgcggccgggcacagtggctcacgcctgtaatcccaacattttgggaggccgaggcgggcggatcgtgaggtcaggagatcaagaccatcctggccaacacggtgacaccctgtctctactaaaaatacaaaaaattagccggacttggtggctggcacctgtagtcccagctactcgggaggctgaagcaggagaatggcgtgaacccgggaggcggaggttgcagtgagctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcagttctctgaactgaagtggggtccccaggctctagcccccgggggaggtgaggtgaggggcaggcctcccgggggctgacgtggccacccttgtccgcccgcagtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggtgaggccccagcgggacgggtgcagctcgcgtgggctggggtccaggtagaagacgaaaaccacgctcaatttttcccacagacgggacttactgtgggggcttagctgcaaggtgttagaaagccacagcccaagccaggtgtgacagaccctggagggagatggtgcgatgtgggggaggtcgtaggaacaggaaatccgtagcggcgcaatagcccaggtccttaggccccagcaggcctccccgggagaggtgaggtgacggagaggtggatgaagcatacggaggggcagccagggcaggtgtgcccttgctgcgtgtggaacagcagggaggcccgtgtggaaggagggtctagaacggcagcaggaggaggagtggaggtgaggggtgacagggcgtgtgcagattttgtggaggcttatgggaccccgtgcttttcctctcagagcagctagggagggtctgaggatccccagaacctccaagggccgggagctgactggggtgcccctgggtgccctctggcggccgtgtgggaaatagaccagggggcgaggggtgagtgccgctgcgacatgagggtggcccagaccagggcaggaggccacatcttggaggcaagactcagggtagtgttgccaggccccacccttcatgcctcgccctgcccctctgtaggcgcccgatggcctcatcttcccagaccgggccacgctgtatgtgacggccatcgaggaccggcagtacaaagactacaagatccactgtgagcgcggcccgggagctggcgggcggggcctcgggtgggctgctgcgggctcaccccctccctgcctgcctccccagggtgggagaacgtgtatggcttcgacatgtcttgcatcaaagatgtggccattaaggagcccctagtggatgtcgtggaccccaaacagctggtcaccaacgcctgcctcataaaggtgagggggtgggcatggccaggtgccccctgggttgaaaccaaagagaggccatcacctggccctggcatgggactttggggcccagaatgttggcctgaggtctcagagcctgatctgccagccagaggtggtgctagaggcccaggaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccagggcgatgagcggatgcacatgcacgcgggccactgcagaagagcacggggccaggctgggctccgagatgtgcctgaggtcccagctactcgggaggatcacttgggcctgggagttcaaggctgcagtgagctgtgatcacatcactgcactccagctttggtgacaatgttttgttttgttttttccttttgtttttttttacttctgagaccctgtttaaaaaaaaaaaatacggcgatgagtatttgttgagctgggatgtgtgagccgggtgaagctgggtggctgaccgggggatcctgtcggggaggagtaagttgttgagtgggggaggagaggagactacaggggcagggaccccactcgggccaccctcctgagagccaggggaactggcgcagggtttaggttggcatttgtgttgccgtttgaagccatcatgttgttggacttgtcaaggggttggggagacagtggagtggggcgcctgcattctaggaggtctggacagagttagggtggcactgccaggtttgggtgttggagaggagggagcaaggaatctgggctcgaacccacatggtttattgggagccggataggcaggatgcagagtgaaggaggagccgaggctgggtgccagtgagggagggctagcaggaaggggacagcgaggtcacaggccctctgggagcttaagggagggaggaggggatgaagcgaggtggggacgcatcccggagctcgccctctcatgtcctgcaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagtgaggcggggcccacagggctgggggccgttcccgagccagggcggaggcgcacccacgtagtggagggggtgacagaaacgggcagaaggaaccatggggacacgcgtgttccagtgtgagctctgccatgtagcagtcacgtggccttgggcaagtgacctgagtgtgcagtgcctcagtttcctcatccacaaaaggctgacacggtccctgtctccaaagctcaatgacagggaggtgactcgcggatagcagtcccatcagctgtcatgggggtgggcattccgacagagggaacgcaagggtggggttggggggggcagcaggccgaggccggctgacccgcccgcgcccccaggccccgagtccccgtacacgcactggaagcagacggtgttctacatggaggactacctgaccgtgaagacgggcgaggagatcttcggcaccatcggcatgcggcccaacgccaagaacaacgtgaggctccgggcagctgggtgggagggtggcagctagggcggggagtgtagattggggggggagtggtgggggaggaatggtggcagcgggggtaggggatgggggcagccggggtgggggatgggggcagctggcgggggcgagcacctctgcctattcccgggtccccaagcccctcagccccatgcctgtctacacagcaggattgcttgagcattcaccggaagttatgggcctggggacccaggctgaaaccctgccctcctggtgcttccactctagacaagggggtcagtgacatggtgatgccagttggaggtgacctctgtcaggctgggagcagggcagacaggtgttggtgtaggtgggctccagggcaagaggcagcccccagtagagtgcacggggttttctagcccagctgggaggcatgagaggagaaaggcagctttttgttttctgctcccctttctttttcctcctgagcacttggcaggagctgccatcacctgagatcagggggcttccgggggagctgggggggcttctcggagacagggtctgggcagagatccagtgtggtgggtctgagcaggcaggaggatggaaggcttggagcctggagtcgccgggagtggtctgggttggaaaagtgggtcccggccgatgggtgcgagggtgggtggcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggagaaggggtggtcctggcatctggtaggtaggggccagggggctggtaaatgtcctgcagccacaggaccaccccctacaaagactcatgcagcccccgggaccacggcactagctgggaaacggatactggagagggaggaggagtcctcgggcgttggtgactttgtctcatcttcatgtgctggagggtatggggggaggagaggaagtggagacagcaggctggaccattgtgtttcactggaacgtttgcctgaggaggaagtgggcttgggagaggttttcttttttatgaaagaagcaatcactgcattgctgatgggaatcatcctgatggagaaatccaagggcaagggacagcagctgggctctactcctgagtgagtctagtgggcttgggggtgtccatgtggtgctgtcccttggcagggtcagggcagctgctagggtgggaccagcagttggggtctgcagcgtggagatgggcaggaagctggagcccggctcatcgtcgcatagcctgcctgcacccgccccccgccaccacctcctggtgggttccgccctcatgccccacctctccctgcagcgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 36864 - DNA, 9013 bp, Homo sapiens
cggccccccgcattccccgcccccacctccccgccttgttgtccaacttctcccggagcagccggagagcaggcgtcgggacgcagcaaagagaggagaggtaccaggactctgggcacgagggagtcggaactcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccgggttcgtctccccactaccggttcccaccactgagtctgggggcgaaggaaggagccagagtgcaattgcagatccaggtcgtggatggggcggtgctgagggcagccgagggatccctctcagggctgagggatccccgcactccccacaccgccccaatgcggggagggggtggtggaatgttttggtgagccgagcagagcctggaagcgtccagccgcccgcccctcgccccccggccccagcacaaccctttcctgagcggcagtctgggcggggtgaaagggggggcgtgtttactgggggtctggggcgggtctgcggggagcctagcgcccgtgggcgggctggggcgggccgggggcgggtctgcgggaagcccgagccggggcgggcccgagtcaaaggcaagtgaaggtggaagcggccgcggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggtccggggcgcttggcaccggccacgcaagggtgtcagtctccacgcggacgggctgcgtagggactcgtagggacgggttccgggtgctgggcccggccggtctcctctgtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtgtttgtttttaaattgtggagggaaacagccatgctctgctaccctcctcttactggagagctgtcaaaaattttggggatcccctattcccccgcgtttagtccccctgcagatagaaaattgaggccaaatgtagtaactaactggggcaaggtcacactgggagtggcagagccgggattcgaatccggaggttctgacagggccaccctcttacctccacatcagcacttccttctctcctccgcgcagcctgaactgatgcccttgtagcctatattgattccggctcgagcctagagaggacgtgttctctggacttaggggtagacagacactggggagggttagtgacccgaggaggttgatgaccctgggagtctgggtcttggctgaggctttccgtccctgaaagaccccaggtctgtctcccatgtcattcacctcgttgctgtgttttctcagaccccagagtcagaaggagtgagaaccctgacccctaatcccactgcatccagccaataggagcccagtaagtgaccccaccccgcaggctgcaggctccttcctgtgcaggtctgtccaggtgctctgctcctcacccactaatgttgaacttgcggagtttattcagagttgggaggaagggtcttgggaggaagggaggcattgggttggttggacagatgtcccttttatgttgttttccccacctcccccattggtcatgttgctttggtcatttttagccccctttgagctgccgactttggggctttaattgaaggtcatggtcaattgtgaactctcacagtcccgtcttttggtaccctgtcctttagaatactcagtcactgagctacaagtttcactccctacctgagagtgtggggtggcccctaaatatagcccgagaaatctgagctacacttctgccccaccctggtattttggtccagggcagaggagggaggggtctggaggtgtggtgttgagggtggcagtggggatggtgagtatcaagagaagggctgtcctgattcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaaggttattagagaccgtttgactcccatgcccaaattccagacctctaagcatcccccttgccttctaacttcccaagcgtactgatcttattctaactcacaccactgcttcaccactaccctagtctctctccccatacactataattgggagtcaggcccttgtctcgtcactacactaaccttcatcctttccgtgtctctctttgtcaatctctttctgtctttggtcatttgttggtctgtctttacttgcctctctttgtctgtttgtctctccatctgggacgccacatggtcatgtgtttctgtgtgaatccgtgtgtgtctctccaggaggctgagttagctgcccgaatcctcctggaccagggacaggtaacagtgtgggggcagtcccaaggtgggaggaggggctgtcctcttccccagtagaaggatggcctctgcttggccctctcttctctctttgctttctttccttctattctagtcctttcccttccctatctctcccctctccttccttcccctcctcttctctctctaatcttcattattctttcttatcctcaaactcatcttccggtatcatgttttcctcaattcttgctgatcctgtttttaattctttgttcccttttccctcttgcccacccactcccagctccctgaccttggtgttgctccttttctggcctcgtctcctctgagcctagctcttggtgccctgttttcctgcagactcactctgtggagacaccatacggctctgtcactttcactgtctatggcacccccaaacccaaacgcccagcgatccttacctaccacgatgtgggactcaactgtaaggaccttcattcatctcccactcctgtctgggaagaggctgtgggggaagggtagaaatgaaacccagagggaggggaggggtcagtgtgggaaggagaagttctctcctggtctgactgtggcatgaaaggaagggtgagttctgactgggggacacgagtccctgtctgattctattgttgaggtgatgtgggttctctttagataaatcttgcttccagccactgtttcagttcgaggacatgcaggaaatcattcagaactttgtgcgggttcatgtggatgcccctggaatggaagagggagcccctgtgttccctttggggtaagagttaggtcgttactgcttcaccagactgtgaggaacaggacaggtgcgggaaaggttcgactggggaggaggaaagggagggcagtggttattctgggagagaatgagtaggacatcctgaggtggggggtgtgagggcaggttggtatcttccttaacatgcctctcttttccagatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctgaactcaatatatcttcttccttcatgctcccgccttgattattgagaaaaggtggtgggtttggaaaattggccagagtcaacagaatagccctaatgggtggagggaaggaaaagggtctatgcttggccctgcctcaggctaaggagggccttctctgatcagaaagtcagggaggaatgaaagggggtgacataatccctgaggaaccagatagacctgtctctttctctcccactcccctctccttcatgcccacacctggtggatggggagctctgcgggtgagagagagttggggaaggaagagaacaccagaccaagtgtctttggtattcagagggaggtgctggcccctgggtgctgttcttagctaagcttctcctaggcaccagggctcagcagctctggttcaccactttgccactcttttcctcattctctccattgttcactaaaattgtgtctgttttcacatttgctttaagttccattcttcccgttcctctagaggaaccaggaactaaagcagaacaagttgaactggctcttgaaaattgagaatggacaaagagctatctatatgggaaaacagtgtgttggttggctggtggatgggtgtttgtttttaagacactagctctccagcagaaagctggggatagacttcaggtatctaccctgactacccgtgccaacctttggcttcttgggcccttctttttcgcgtcctccaaagaaaggtccgtgtctgcctttctttgtgcccgtggactcaggagggagggtgaagagtttgaagagatgggctgtggcaggttttggacagcagatcccatgaggcgtatatttctttccctttcacagtttctctacaataattggagttggtgttggagctggagcctacatcctggcgagatatgctgtaagaaataaaaagcccagaggagggaaaggagggtccagactgattaggagaatactgtttattagtgctgtttgggggaggaagtgggcactaggtggggagtcaggccctgtgggagtccaggagtgggtcgagcttagcggggaggggataaggccatgccctgtttctcatttccttccttctgctgtccctcagcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttctttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggtaagtgggtgtaggagatgtagaagagtcgacgggagcagcagggaacttgaatgcttgggctaacttccttagctgggacaggatttggggaaggaagaaggcttacctcttttcctccagtaattgttgttttctctttccatccctaatttttctccttgttctctccttcaggaagagctctctggaaattctgagttgatacaaaagtacagaaatatcattacacatgcacccaacctggataacattgaattgtactggaacagctacaacaagtgggtgggctgtgtgtgtatgcatgtgagagaaatgcagaagcagtaattgggcgtcatgggggaggcacagaggaggagagggaagtctgggtagtgtgcaatgtgcaaggaatgcagcatttagtgtgcaatgggggcagcttcaggacagagtcagtgggaaggattgcaaggggctgtcccccttctcttgtttacctcctttggattattggactcccagaagtaagatgatcttgtgtcctgtgtccttcctccccttttgttgccctctgaccagggatctagggcacaagtgactataggggctgtgcttggggcctgcctgcccctttctcctttggtttccacctttaataaccaagatttgaccgtaatttttagacaaagatagttccatcatgggagagatagcttatatctggttagatagcattgcccacctaaaattcctactcttttaacccctttctagccgccgagacctgaactttgagcgtggaggtgatatcaccctcaggtaagactttaagagataatgcattgcctgtctccctggatcttccctaggagcttgtgtcccttagaagaaggagaatcttttgccagggaacttccttgtcatgtcccaccccatcctatttggtaaatcacttccctctaggtcttccccctttgaatcctcttggtggcatcagcagggagacacagaagtgtctttcctctttggagccagatatttttccagctgcactcctaggcagaggccagtgagggagtgccaggggctcactgccttctccccaacactgtgtctttaggtgtcctgtgatgctggtggtaggagaccaagcacctcatgaagatgcagtggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccaggtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggctagagtgaagaagctagggaagagagaccctttccacctctctgcatggctcatttatgtgtgtttcactttttctgggtggtgctctcctgaacagatggctgactccggaggtcagccccagctgactcaggtgagtgccgctgccgtccatgggatggggaagggacataggataccggtggcactgggctctgccctttgccacacacccggccccacagtgccgcagcctcaggctccagctcttcctctaacctcatctcaccgtctccctcgcctcttcttacttccgcagccaggcaagctgaccgaggccttcaagtacttcctgcaaggcatgggctacagtgagtatcgggacaagagcttgctgcactagaggagagataggcactgacggggtggaaccgttttaggtgaatgcctggactcaccgctatctgcccaatcgagctcgttgatcccctggcttagttataactagtccataatccaaggaccacaccctgagtcgccagccccccttccccacttcctctctgactgcttgtgcatcgtgctgtctccacagtggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtt

SEQ ID NO: 36865 - DNA, 53866 bp, Homo sapiens
aaaccctgaagagcccaagcaatgtggttgtaaaatttgcaaaataagattaaatcttaactgcaatctgttaacactgctgtctcctttcactctttctcctatatcacactttcccacatgttggatggccttggagtggtagccataagcatttttggaattcaactaaaagtaagttgaatgaagcactactttatttaatacttgtacctaattttctccttttcttctcgatacataatactttacatatttatggggtatatatgatcatatacgtagtatgtataatggtcaagcttgttatacacgtagtatgtataatggtcaagtcaggatatttggggtatccatcaccttgagtatttatcatttctatgtgttggtatcatttcaagtcctctcttctagttactttgaaacatacaaagtattgttgccaagtatagtcaccctattctgctatcaaacattagaacttatttcttctatctaactgtatgtttgtaaccattaatcaacttctcttcattcccctcccaccaaccacccttcccagactctggtatctatcattctattctctatggccatgaggtcaagttttttagctcccacatatgagtaagaacatgcagcatttgtctttctgtgcctggctaatttcatttaacatagtgacttccagcaccatccttatggctgcaaatgagttgatttcattcttttttatgaccaataatattccattttgtatctataccaagttttctctattcattcatccgttgatggacacttaggtttatatctttgctgtcatgagtcgtgctgtaatacacatctgaacgcaggcatccctttgatatactatttattttcctttagctagatacccagtaataggattcctggattatggtagttctatttttaggttttaataaatctccatattgttttccatagtggttgtactaatttacattcccaccatcagtgtataagagttccctgttctctgcgccctcatcagcctctgttatttttttcttctttataatagccattctaactggggtaagacgatatctcattttggttttgttttgcacttccctaatgattcatgacattgagcattttttcatgtatccattggccatttgtcagtcttcatttgagaaatgtctattcatgccagtttcccattttaatgggattattattattattattatttattgtttagttgtttgagttccttgtatattctggaattagtcacctgttgcatgagtagttagcaaatattttctcccattcaagaggttgtctctttactctgttgattgtttcttctgctacatagaagtttttccatttaatacagtcctatttgtctatttttcgttttgttgcctgtgcttttgaggtcttggccataaaatctttgcctagaccaatgccctgaagagtttttcttatgttttcttctagtagttttatagttttccatcttacattaaaattcttaatccatcttcagttgtcttctgtatatagtgaaagataggaatccagttgcattcttgtgcatatggttattcagttttcccagcaccatttattgaagagggtgttctttccccattgtatgtccttggtgatttgttgaagatgagttagctgtaaatatgtggatttatttctgagttttcaattctgttccattggtctatgtgtctgcttttataccaataccatcctgatttggttactaaagccatgtaatccattttgaagtgagtcaagaagtgactctgaagacacatctgaagatagtgtgatatatccactttattgtttttgctcaggattacattggctattctggctcttttttggttccatacaaattttagtattttttttctattctgcggaaaatgacattggtattttgatggggattgcgttgaatctgtagattgctgcaagcagtatggtcattttaataatactaattatactagtccatgagcatggaatgcctttccatttgtttgtgtcatcttgaattttgttcatcagttttatgtagtataccttgtagagatctttcacctacttagttaagtttattcctaggttttttgttgtttgtttgtttgttttttagctattgtaaatcagatttctttcctttttttttttgagacggagctctgtcacccaggctagagtgcagtgtgcgatctcagctcactacaacctccgtctcccaggttcaagctattctcctgcctcagcttcccgagtagctgggattacaggcacatgccaccatgcctggctaatttttgtatttttagtagagatggggtttcaccgtgttagccaggctggtctcaaactcccaacctcaggtgatctacctatcttggcctcccaaagtgctgggattacaggtgtgagtcgccgtacccggcctatttatatcttcttgtactatgtcttcaaaaattgttgtgattattatttctgagtagctcatcttttagtcattctactcaagatatgagtagtttacacaccacaattacagtgttatgatattctgtgtttttctgtgtacttcctattaccagtgagttttgtaccttcggataatttttgattgctcaatgaccttttctttcagattgaagaactctttttagcatttcttgtaggacaggtctggtgttgatgaaattcctcagcttttgtttttctgggaaagtctttatttctccttcatgtttgaaggataatttcaccagatataattttctagggtaaaagttttttccttcagcactttaaatatatcatgccactctcagcggggtgcgatggctcacccttgtaattccagcactttgggaggctgaggcgggtggatcacctgaggacgggagtttgagaccagcctggccaatatggtgaaagcccatttttgctgaaaatataaaaattagccaggtgtgatggtgcacacctgtagtcccagctacttggcaggctgaggtgtgagatcacttgagcccaggaggcagacgttgcagtgagtcaagatcacgccactgcactccagcctgggtggcagagtgagactcgtctctaaataaataaataaataataaatcatgctgctatggtgtacaaatgggggaaaggcgtccgctctctatgcatgagcctaagcactgaggctgctccaccagtgggggtagggtcactgcccaggccccagacagtcagctctcaggctcacccacttgggctcctggtggcagcaactgctgcatttgtgtgggtgtgggggaggaaggggaggcggtgggatgggtggaaggaattccactttccgattatgagccccagaatagagtctgtgccactgctgggggcaaggtcgctctcacagggtctggaaagtgtctgctctggcttactgtgactgtgtcccaggggcttcctccttggtgtgtggcaccatccttttcctgaggagtagtagttcatgtgggccagggtactggggaccctgtgcacatttgggtccagccagtgctgtgccactgtaaccctctgagtggacactaagggacatcagtgggggattctgaaatgtggacataggagggtgtggttcccagggcaggatgcagtccagtggtggctgtgctttcacaatggtgctgtgctgcagccacgtacgtcttggggaagcatgtgaccctgcatgagtcccctgtctggtgagatgccctgacagggcctccagaccaccacccacactagtctcagagtttgtatgggtagaggagctctctcatggttaggactgcagcagtctgcagcagggatgtgtatagcagagggattctcaccgccaaccttggctgagttgaccactcacttcctgctccatctgtgcctcaggtatttcccataacttctctgttgaactccagtgttctctcctagatgttctattggaggtatgattatctattcacaattattgattccttctttaaagagtgagtgtctaatgtctctagtcagccattttgaacccctatctcagttttttgagagatttctgtggtttgccgtcacttccatgagtttatgctagccacgccaataggaatagcttctaggaatactcccatcaatccatgtgctgcctgacctgacataatgacatgaagcagcagtgccaaaggttgtattctaggaatataccctgtagtatctggcactaaaagtaaagtgggaagcaaaggagaaacaagtttggaatatgtggagccagaacacatctatagaaaattcatctagttctcagctgtgtaaaattataagtgggcaattaatttcttattaaatcctagccaaaacaaaatttatctcttgccaaggaaactggtcagtgatgcagtgtacataattataaatgcagcatacatatgaagatgtaatcaaggagtatgaagtcaaaagatagatatatggttttttattttcaagaattctacttctgacttcaaaatagagtaacaggaactggatttattctcacacctaaaaaaaaactaagcattaagccaaatatattaaagacattgacgatcagacaacaaaggacacagatgggaaacaaagtgagtcttataattgccccccaacaggaaggagaattccaggcatggcctcatgatctccttaagttcaggaggtaaagctgggagtcttgggagggaagagtattggatgtaagacagcttcagtgagagagatcaccagaggatgtgagaggcctcccctggagtcttcaactaagtgctaatcagcaaatgtatgaggaaactacccaagaccaatgagagaaccacccaaaaggattagaagaaactactcagagatctcatgggactgggagtagtttctgttctcattagcgaaaaatgaaaaatctcataatttgcagcacattcaaagagtcttcagagttttgtctctatagtgggccaaaataagccctagaataaatgatgctctgttcccaccaacccccaaccaatgaaaaaaaaaaaaaaagactcaaaaggataaaactgtttctaaataactatgtctcagaataaagctcaagaatatgtataggaaaacaaaaatgtccagcagtcaaaaggtaaaaatcacaatgtctggcatccaataaaaaattacaaagaagtagaaaaatatggcaaataattagaagaaaactcaatccttgaaaattacttcagggtgggcaacatggagaaaccttgtctctacaaaaaatacaaaatttagctgggtgtggtggtgtgtgccaggagtcccagctactcaggaggctgaggtgggaggatcacttgagcttgggagattgatgctgccgtgagttgtgatcatgccactgcactctagcctgggcaacaaagcaatactaaaaaaaaaaaggagagaaagagaaagagagagggagggaggggagggaaggggagagagagagagggaaggagggagaaagggagagggagaggaaagaaaaaggaaaggaagaaaaagaaagaaagaaacacggaaggaggaaggaaggaagggaaaaaagaaagaaaaaagagaaagaaagaagaaggaaggaaggaaaagaaagagaggaagggagggcgggagggacaggagagagggagggaaggagggagggagaggaaaggaaggaaggaaggaaggaaaagagggagggagggagagagggaaggcaggctggtcaaaataacacaatgacagaaatagcagacaattacattaaaatagctattataactgtactgtatattcaaggagatagggaaaagattgagtttggtaactagagacatgaaagatgcagaaaaactaaaatcaaacttctagagatgaaaatcccagtatctgagattaaaaaaaaatggatgagattagcaacagattacacattgtggaagaaatgattattaaatatgaagaaatattaataaaagcaatccataataaaacacagagcataagaaattttttttaatgaacaaagcatcagtgagctttgggtcacattcaggtgacctaatgtaagtttaatcggcatccccaaagaaaaatatttgaacaaacaatagccaagattttccaaatttgatgaaaataataaattcacagatacaaaaaaagccaataaatataagcataagaaacatgaaggaaactgcaacaagaaacatcataatcggctgggcatagtggctcatgcctgtaatcccagcactttgggaggccgaggcgggtggatcatgaggtcaggagatcgagattatcctggctaacacagtgaaaccccatctctactaaaaatacaaaaaaaaaaaaaaattagccgggcgtggtggcaggcagttgtagtcccagctactcgggaagctgaggcaggagaatggcatgaacccaggaggcagagcttgcagtgagccaagatagggccactgcactccggcctgggtgacagagagagactctgtctcaaaaaaaaaaaaaaaaaagaaagaaaaagaaaaagaaacatcataatcaaaaagcctaaaacctatgataaagagaatgcttttttatttttattttttgagatggattttcactctgtcgcccaggctggagtgtggtggcacaatctcgactcactgcaacctccgcctcccgggttcaagcgattctcctgcctcagcctcccaagtagctgggactacaggtgtgagccaccacatctgactgatttttttttgtatttttagtggagacggggtttcaccgcgttagccaggatggtctcaatctcctgacctcgtgatctgcctgcctccgcctcccaaagggctgggattacaggcgtaagccaccatgcctggccaagagaacacttttaaaacaaccagaggaaaaaaagctattacatacagatgaacaaacataaaagaacatgagatttctcattagtaatgacacaatcctgaagacagtggagcagttagtggtagactactgaggaaaaaaactgtcaacctagaattctaaacccagtgaaaatacctttcaaaaacaatggcgatagtcactttttaaaatgtgaaacaccgttcagaaaaatgaggatcgtgttatggtttcaatctgtatccccacccaaatctcatgtcgaattgtgatctccaatgttggaggtggagtctggtgggaggtgattggatcatgagcatggatccttcatgaatagtttagcacccttggtgctgttctcatgataatgagtaagttcttgagagatctggttgtttaaaagtgtgtagcaatcccccacacacacacccagctctctctcttgctcctgctttggccatgtgatgtgcctgctaccccttcactttccaccataattgttaagtttcctgaggcctccccagaaagggagcagatgctagcatcatgcttcctgtacagccaacagaaccatgagacagttaaacctcttttcattataaattacccagtctcaggtacttctgtacagcaatacaagaatgaactaatacagattgctttccttgatgtgtgagagtcatcatctctcctcttggttcattattgggtgtgctataaataaaatcattagcaattaaagtgagatttgcccacacacacaaaaagcaaaataaagatatttctcaaacatgcacatgatgaaagaattcctcatcagcagaactgcagtacaagaaatactaaaggaagtagttcaggcaaaataaaactaataacaaatctgcatctatacaaaggaatgatgagcatcaaaaaatggtaggcatatgggtaaatatgaaagacttacccattttaaagagatttaaagaacaataacttttctttaaatatttaaatctctctaaagagttatcacagtgtattgtgggctttttcacatatgtagaaataaaatgtatgacaatgatagcacaaacgctgagggaagagaaatggaaatatactgtagtaagattcttattctgtaaattcatcggcataatatcacatgaagctagaccacaataagttaaagatgtacacaatgagccataaagcaaccatgaaaaaaagcaaaacaaaactaataaggcaacaaagaagataaaaatagaatcataaaaataatctataagaaggaaagaagaacaaagaacctatggtagaaaaataacattattgatttaagctaactatatgaataatcgcttacaatttaaatagcctaaacaactcaattaaaggcagagattgtccaattgtattttaaagacaaacactcaaaaatatgctgcccacaagaaatccaatataaatataaagacatgtatagggtaaattattattgactaccccacccaaatgcaacagaatacatattattttttaatgcacacatagaacatttacaatgatagacaatatttttggctactgaaaagtctcaatacattttaaaagatctaaatcatgcaaattatgttctctggccacaatggaattcaattagagtaaataaaatgcgggtttctgggatatccctaaatatttggaaaataacacactaccaaataacccatgggtcaaaggaaattaaaggagaaattagaaaataatttgaactgaatgaaaaggaagatgtaacatatcaatatttatgggacacagattgagtacttaaagagaaatttataacactaaatgcctatattaaaaaagaagaaagatataaaatcagttaagcaaatagaagttcaaatgacatcaccaagatggtggatgagaaggtaatgcccatcccccactgagaaaaacaacgaataaacaactacataccaaccaaaatagctctgggagagctgcagagtacaatgaaaaacttgcagcaacccaaaggaccacacaaaccaagatagccatattaaaaaatacagaaagtatcctacctactccaccccatcccccagtccaagcacagctttgcaccaagaggcatctcctggacacaacccacaacctccacctgtgggagaaaagtagagcaggaggaccccagcatcctttgccaccaatgcaaacattgaccacttttaccactgaggacccctgcagtttccaccagtgatgatctcaactgacagagctttccagggtccatgctgctgtgtccccctggagaagaagctgctgtgtccccagtggccaagattaccaactcaccgtctcacaattgcatgtatgctctagaccccagagccaaggctgctacatgtatgatggacacttctgacactggcaccaccactgccatgggcacacctgtaccccagatcatagagccatggctgttctgtgtgcaaccaagcatcaaataccagcaccactaccaacatgagcacacctgcactgtggatctggcacaaaaagggatcccatcagctgtgaagttcccccaagcaggaataagagaacaggaaaatgccagcagcctttgctgttgcatttgggtggggtagtcaataataatttaccctatacatgtctttatatttagagtacccaagcaactttttctgctgctgtgtacacccacagccttggctgctgagggcctccagagccattggccatgctgatctcagctgatggagctttatagagagtatgctgctgtacccaccatggagttggagctgatgctgtggcttcccagagctagaaccaccacacccaactcagacagcatcttcatgcccacttataaatggtctttccctattgaaatgagtccatacagtctggaagaggtggctattacttcaaacatgcagacatcactacaaggctaaagaaacataaaaaaatcaaggaaatattacaccgccaaaggaacacaataatttttcagtaattaaccccaaagaaatagagatctatgaactacctaaagaataattcaaaataattgtttaaggaagcttggtggctacaagaagacactgggaattcagtgaaaccagaaaagcaatacaagaacagattaaaagttcaagaaagagatagaaatcattttaaaataaccaaacaaattatggagttgaagaatacaatgaatgaaattgaaaatacaatagagaatttcaacagcagacttgatcaagcaaaataattttaaaaaaaaatctgtgaacctgaagacacatcatttgaaattatctagtcagcagacaaaagagaaaaaagaatggaaaacagtaaagaaagcctatgggatttatggaataccatcactgaaatcaatatatgtatttgggagttccaaaaccagaagagtggctgagcactgtagctcatgcctgtaaccctagcacattgggaggccaaggcaggaggatcacttgagcccaggagttcaagaccagcctgggcaacatagtgagacctggtctgtacaaaaaatgtaaaaattagctgggtgtgatggtgcatgcctgtggtctccacaactcaggaggctgagttaggaggatcacttgcacccaggaggtcaaggctgcaatgagctgtgattgcaccactgcactccagcctgggcaacaaagcaagatgctgtctcaaagagagagagagaaaataaaaaagaaaaagtaggagagagggcagaaagcttattaaaaaaaaataataaaggctaaaaacttcccaaatcttgagagagatatagacatccagattcatgataccaaatagcccccaaatagaatcaacccaaagaagactacatcaaggcatattataatcaaattaccaaaagttaaggacaaagagaattttgaaagcagtaagagaaaagtaactgatcacatataagggagactcgatgggactattggaagatttctcagaagaaaacttgctgaccaggagaaaatagggtgatataacccaagtactgaaagaaaaaaaaatgccatttaagaatactattcctagaaaaattttcctttaaaaatgaaggagaggctgggcatggtggctcacacctgtaaccccagcattttggaaggctgaggtggaaggatcacttaaacctaggagtttgagaccagcctgggcaacatggcaaaacctcatctccacaaaaaaaatttaaaaattagccaggtgtggtgacacactcctgtagtcccagataccagggaggctgaggcaggaggcttgcttgagcagaggtgtttgaagttgcagtgaggcatgatcacaccacagcactctagcttgggcaacagagcaagattctgtctataaaaataaaactaaagggctgggcgcagtggctgatacctgtatcccagtacgttgggaggccaaggtgggcggatcccctcaggtcaggagtttgagaccagccagaccaacatggtgaaaccttgtctctactaaaaatacaaaaattagctgggcgtagtggtacatgcctgtaatcccagctactcaggaggctgaggcaggagaatcgcttgaaccaaggaggtagaggttgcagtgagctgaaattgcaccattgcactccagcctgggtgacaagagtgaaactctgtctcaaaataaataaataaataaaaataaaactacaaataagattaaacaaaacataagacaaaaatttgcaggggctgggcgtgggggctcatgcctataatctcagcattttgagaggccgagacgggctgatcacctgaggtcaggagtttgagaccagcctggccaacatggtgaaaccccgtctctactaaaaatacaaaaattagccggttgtggtggcaggcacctgtaatcccagctacttgggaggctgaggcaggagaatcgctggaacctgggagacagaagttgcagtgagccaagatcacaccactgcactccagcctgggagacagagtgagactccattttaaaaaaaattttttttctaatggatatacagtataaaaacaagccagcagccaacaagatcacaaagtgtgcaggggtgcagggatggagagtaaaagtctagtgtttttgtaagcaattgaagttaagtttttttgttgttgttgttttatttttgagacggggtctcgctctgtctcccaggctggagcgcagtgtcgcatctctgctcactgcaagctctgcctcctgggttcacaccattctcctgcctcagcctcccaagtagctgggactacaggcacctgctaccatgcccgactaattttctgtatttttttagtagagacggggtttcacggtgttagccaggatggtctcaatctcctgacctcgtgatctgcctgcctcagcctcccaaagtgctgggattacagacgtgagccactgcacccagctgaagttaagttgttatcaactaaaaataagttacaactccaagctaaccataaagaaaagacctatggttgggcacagtggctcatgcctgtaatcccagcactttgggaggccaagatgggcagatcacttgaggtctgaggtcaggagttcaagaccagccttgccaacatggtgaaatcctatctctactaaaaatacaaaaattagccaggcgtggtggcaggcacttataatgccagttacttgggaggctgaggcaggagaatcacgtgaacttgggaggtggaagttgcagccagtcaatatcacaccactgcactcagcctgggtgacagagtaagactccgtctcaaaaaaaaaaaaaaaaaagagaagacagtacaaccgataccacagaaacaaaaagatgtataaaggactattatgaacaattacatgccaacaaacaggaacaaacaggatcacctagaagaaatggataaatttctagaaacatacaacctaccaaaactgaagcaaaaaatagaaagcctgaacagaccaataaaaaataaggcaactgaatcagtactcaaaaaatctcccaaaaaagaaagcccagaaccagatggcttcataggtgaattctaccaagcattttaaaaagaatgaacacctaatctttcttaaactcttgtgaaaaatagaagaaaagggaacacttcagaagttattctgcaaggccaaaattaccctgataccaaaaccagacaaagatactccgagaaaagaaaacctcaggccaatatacctgattaacttagatgtaaaaaccctcaatgaaatactagcaaaactaattcaacagcacattataaaaattatacaccataggccgggcatggtggctcacacctgtaatcccagcactttgggaggccgaggtggatggatcacctgaggtcgggagatcaagatcagcctgaccaacatggagaaaccccgtctctactaaaaatacaaaaattagctgggcatgttggcaggtgcctgtaatccgagctactcaggaggctgaggcaggagaattgcttgaacctgggaggcaaaggttgcagtgagccgagatcgcgccactgcactccagcctgggcaacaagagcaaaatttcgtctcaaaaaaaaaaaaaaattatacaccctgagcaagtgcaatttgcttatttatttgttcatttgttttattatccctggaatgcaagtatggttcaacgtatgaaaatcaatcaatgtgatacaacatattagctaaagaaaaaatgtgattatctcaatagatgcagaaaaaacgtttggcaaagtacaatatctattcatgactctcaacaaaagaggtacagaagaaacttaccctaaaataataaaggccattatgaaaagtccacagctaatatcataaccaatggggaaaaactacaagctttccttctaagatctggtacaaggcaaggatgcccactttcaccttcttttcaacatagtactagaagtcctagccagagcaatgagacaagaaaaagccatccaaacaaaaaagaagtaaacttatccttctttgcagatggtgtgatcatgtacatagaaaacacagaagactcaatgaaaaaactgttagaactaataaatgaattcagtaaatttgcagggtacaaaaatcaacataaaaaaattaatcaggccaggcgtggtggctcatgcccataagcctagcactttgggaggccaggtcaagagaattgcttgagtccaggattcaagaccagcctgggcaacataaggagacccccatatctacaaaaatttttttaaattagtcgggcatggtggctcacgtctgtaatcccagcaccttgggaggcagaggcgggcagatcacttgaggtcaggagtttgagaccagcctggccaacatggtgaaaccccatctctactaaatacaaaagattaacctggtacagtggtgcatgcctgtaatcccagctacttgggagtctgaggcaggagaattgcttgaacctgggaggcagaggttgcagtgagttgagattgtgcattgcactccagcctgggcaacaagagtgaaaactccatctcaaaaaaaaaaaaaaattagccaggctaatttaaacggtggtgcatgcctgtggttccaactatttgggaggctgatgtgggagaatagtttgaacccgagaggtcaaggctgcagtgagtcgtgattgtgctactacactccaacctggatgacagaacaagaccctgtgtcaaaaaataataataataatcacataaaaaaattttgagacagagccttgctctgtcacccaggctgcagtgcagtgatgttatcatagctcactgtagtcttaaacttctggactcaagcaatcgtcctgcctcagcctactgataatctgggactacaggcacatgccaccagccccactaattttatctttttgtaaagacagggtcttgctatgttgcccaggctagtctcaaactcctggcctcaagcaatcctcctgcctcagcctccgaaagcactggaattacaggcatgagccaccatgcccagccctagtcacatttctagacacaaacagcaaagtagtcagaaagaaaattaaggaaacaatcccattcccattagcaacaaaaagaataaaatattgaggaataaacttagccaaaaagacttgtacactaaaattataaaacattgaaggaaattaaataacattatagataaatgaaaaagatatcgcatgtccatagattgaaaaaatattggtaaaatgttcatactacccaaagtgatctacagatttaacgccatccctatcaaaatcccaatggtattctttacagaaatagacaatagaatcctaaaattcacatgggatgacaaaagacctagaatgtccaaagcaatcttgagcaagaacaaagctggattaatcacacttcccaattttgaaatgtattatagccagatacagggtagtcccagctacctgggagtggagtctgaggcaggaggatgcttcagcctaggagtttgaggctgcagtgtgctatgattgcacctgtgaatagccactgcactctagcctgggcaacatagatacacacacacacacacacacacacacacacacacacacacatatacacacacacacacattatagtaatgaaaacagtatggtacttgcataaaaacaatatatagagcaaagggacagaatagagctcccagaaacaaatccatgcatctatagtcaactgatcttcaacaaggatgccaataacacacaattggaaaaggatcatctccttgatagtgttggaaaaactggatatacaaatgcagaaggatgaaattggatccatgtctcacactatatacaaaaatcaactcaaaaaggattacagatctaagcttaaaagctaaaaccataaaactcctagaagaaaacataggggaacattttcttgatattggcctgggaaatgattttttttttgatgtgacacaaaaagcacaagcaacagaagcaaaaatagacaaatgagactgcatcaaactaaaaagcttctgcacagcaaaggaaacaacagagaaaaaaggcagtctaaggaatgggagaaaatattttcaaactatgtatctgataagaggttaacatttaaaatatataaggaactcatacaactgaataacaaaaaaaaaaaaagaaagagagaataaatttaaaaaataaataaataaccctactttaaaatgagcaaaggacctgaatagacatttcccaaaagaaggcatacagatggccaataagtatatgaaatcatcggagaaatgcaaatcaaatgaaatgtcacctcacacctgttagaattagtattatcaaaaagacaaaagccaggtatggtggcttgcgcttataatttcagctattcaggagactgaggtgggaggatcacttgagccctggagttcaagacgaacctgagcaacatagtgagactttgtctccaaaaattatatatatataattttatataataattttaacaattttatataataatttatataataaattatatatatcatttttatatataattttgtctccaaaaattttatatatatatacacatatatatatacacatatatatacacatatatatacacatatatatatacacatatatatatatatatatacacacacatatatatagagagagagagagagaagagggtctcacttgtcacccaggctggagttggtggtgcagtctcagctcactgcaacctctacttcccaggctcaaatgatcctcctgcctcagcctcctgagtggctaattttttttttgtttttgtttttgtagagacaaggtttcactacattgcctagactggtctcaaactcctggactcaagtgattcatctacctgggcctcccaaagtgctgggattacaggtgtgagccactgtgcctggcccccaaaattttttaaatttaaatttaaattttttaaatcaccaaactccatgcctggcatgtgcctgtagtcctagctactcagaaggctgaggtgggaggattgcttgagaccaggagttcaggctgcaactccagcctgggtgacagagcaagactccctcttgaaaaaaaaaaaaaggtttatttctttatattagcaatggaagtagaaattaataaataatactatttataatagcatcaaaaatactaaatgtaaagatatctgacaggagatgtgcaagacttatacacaaaaactacaagtcattgctaagacaaattgaagttctaaataaatggagagatatactgtgtttataaatcagaagacaatatggctatgaattcagtgctctccaaataattcatatatagatttaatgcaatcccagtgaaaattccaacaggcttttttgtagaaattgacaagttaactctaaaatttgtatggaaatgcaaaggacctaacataaccaaaacaactttgaataataaaaacaaattagaaaatgtcactatctaacttcaaagctttttataaagttatagtcgtcaggcctgggggcatgatggctcatgcctgtaatcccagcactttgggaggccaatgctggcagatcacctgaggtcaggagtttgagaccagcctgcccaacatgtcaaaaccccgtgtctactaaaaatacaaaaattaaccaggcatggtgacaggtgcctgtaatcccaggtacacaggaggctgaggcacgaggattgcttgaacccaggaggcagaggttgcagtgagccaagattgtgccactgcactccagcctgggcgacaaagtgagactctgtctcaaaaaaaaaaaaaaaaggttatggtcatgaagactacgttttattggaatagaaataaagaactatatcaccatatcaatcaaacagaatgaagagtccagaaacagtctctcaaatatgtgcttagtttattttttgacaaaggtgcaaatgcaattcaatggagaaagcgtaatcttttcaataaatggtactgaaacaactggatatctatatgcaaaaactaagctttgatccatacatcacaccatatacaaaaattaactgaagatatattttcgacctaaatgtaaaacctaaaaaaactgtaaaacttctagaagaaaatgtaacagaaaatctttgtaaccttgggttaggtaaagatttctcttaatataccaaaagcagccaggcccagtggcatgtgcctctaatcccagctactttttctgaattcattgacatgatcatatgggattttttgacttgttaatatggtgaaatacattgattgattttcaaatattaaaccatttatgcattccttccataaacccaattggtcatttatgtattatctttttatatattgttgggtttgatttgataaaacaccagctactggaaggctgggaggattgcttgagcccaggagttcaagaccagcctgggcaagataatgagtttttaacacacacacacacacacacacacaccaggctgggtgctgtggctcatgcctgtaatcctagcactttgggaggccaaggcaggtggatcccttgagctcagcagtttgaggccagcctgggcaacatagcgagaccccatctctacaaaaaaatttttaattagttgggcatggtgttaagtgcctgtagtcccagttattcaggagtctgatgtgggaggttggcttgagcttcagaggcaatggttgcaatgagccaaggtcacaccactgcactccatcctgggcaacagagccagaccctgtctcaaaaacaaaacaaaacaaaagaacataccaaaagcactacccataaagaaccaattgataaattggactttatcaaaatttaaaacttctgctgttcaaaaacattattaaaagaatgaaaagacaagccattaactaggagaatatactttcaaatcacacatttaataaaagacttatatccagaacatatgaagaactttctaaagttaataagaaaaaaaaaacccaataaaaataggggaaatattttactagaaacttcaaaaaagacatacagtaggcaaatgaaaagatcattagtcattagggaaatgcaaattaaaaccacaatgagatagcaatacatacctactagaaagcctaaaattaaaagaactttttatattatgtgttgacgagaatgtagagcaactagaactgcaaatgggagtataaatgatacaacaactttggaacatatttcgatagtttctttagaaaacatacattaacctgccacatgattcagttatcccatgcctaggtatttactcaaaagaaatgagggtatattctatgcaaaggttgtaaaataatgttcataacagttttacatgtcaaagccaaaaacttgtaattacccaaatagccatcaacaagtgaatagataagtaaactgtgatatatccatacaatggaatactattcaacaataaaaagaatgcagctacatgaatgaatctcaattatgctagtgaaagaagacatttaaaatcaatacacactatatgattctgtttatttaaaattctataaatgcaagataagatacagtaaataaaagattcgtggttgcctggggattgggggagggagcaaagagaatagaaatgtgattacaaaggtgtgatataataagaaatatatacagatgcttctcaatttatgatagcagggttacctcctaataaacctatcataaatttaaaataccatgtcaaaaatgtatttaagacacctaatctgctgaacatctcattgcttagtgtagcctaccttaaatgtgctcagaacacattagcctacagttggacaaaatcatctaacacaatccctattttataataaagtgttgaatatctcatgtaatttattgaatactaaagtgaaaaacagtataagtattgaagtagtttgtggaaataagtaattcaaaatctaagctgggctgggtgtggtagctcacgcctgtaatcccaacactttgggaggctgaagcgggtggattgcttgaggtcaggagttcaagaccagcctggccaacatggtgaaaccctgtctctactaaaattacaaaaattagccaggcatggtggcacatgcctgtaaacccagctatgtcaggaggttgaggcacaagaattgcttgaaccaaggagacagaggttgcaatgagccgagattgcgccactgcactccagcctgggtgacacagagaggctctgactcaaaaaaaaaaaaaaaaaaaaaaaaaatctaagctgttggtagacgactcatataaaaaattttttaaaaacaaaatctggccaggcacagtagttcacgcccataatcccaccactttgagaggccaaggcgggcaaatcactggagctcagaagtttgaagagatcagcctggccaacatggtggaactccgtctctaccaaaaataaaaaaattagctgggcagggtggtgcacgcctagtaatcccagctatttgggaggctgaggctggagaattatttgaactagggaggtagagtttgcagttagccgagatcgctccactgcattgcagcctgggtgacagagcaagactctgtctcaaacaaacaaacaacaacaacaaaacacacacacacacacacacaaactctaaaatattttgcgccttaagggaacacgattatggcacctgagtcacatgacaggcagtcaaaacctttgtttatctgattagattggccttcttccttacctgccttacctgccttgttttgtaaatgctgtaaataactaaagagtgtttagtgatgttgcactatggaagggaagactccttccttctttatttacttactgttttttttttttttttgagatagagtctcgctctgtcgcccatgctggagtgcagtgtcacgatcctggctcactgcaagctccaccacccgggttcacaccattctcctgcctcagcctcccgagtagctgggactacaggcgctcgccaccatgcccggctaatttttttttgtatttttaataaagacaggttttcaccatgttaaccaggatggtctcgatctcctgacctcgtgatctgcctgcctcggcctcccaaggtgctgggattacaagcatgagccactgtgcctggccctttatttaccgtttttttagagacaggattttcctatgtcacccaggctggtctccaacttctgggcttaagcaatcctcccacctaggcctcccaaatgggaattctcattcactgttgtgagagtgtaaattgcagtgaaattaagcatctgtgcatcctaaaaccaagcaatcccagataaatttgcactcttaaaggtcaggtatgaagatgtttgcggaggcattttttgatatttttgatagcatgggttcaaggtacttagatgttcactgggagaacaggtagcaaattgtggtggctatcactacagaatacagtgcaacactttgagggaatgaactatgcacatctatatagtaacaaggacagatttttttttaacatgagagtgtaaaaaaaagaaaaagaaaaaaaaaggccaggcacagtggctcacacctttaatcccagcactttgggaggccgaggcgggcagattacaaaaggtcaggagttcaagaccagcatggccaacatggtgaaagcccatctctactaaaaatacaaaaaaaaaattagccgggcatggcagcaggcacctataatcccagctactcgggaggctgaggcaggagaatcacttgaacccaggaggtggaggctgcagtgagccgagatcacgccattgcactccagcctgggtgacagagggagactctgtctcaaaaacaaacaaacaaaaaacccaaagaggtctaaagtccattgcattattcccagcaattcactcccttctaccagttgtcataaaacttgcaatgccaatactcgcaatggatatatttcctcatcccattgttgagtttagttatcatgtgtgggagcagatgtgacacatgccaattcaagctgaagttttaagaaacatcacaaattctgcctattttttttttactattccttttgcaagaaaatatagcatgtccctcgccagtatgttccttcagcccagatcctaaagtgagaagatggaggaagagaacttcagtctccacccacaattactggtttttaggattttaaattttaggatttttttcttactgctgcaagtctaatacaagcttcatgtcagaatatcatttataaaaattaaaaattagaaatacacatgcaaacaacataaaagaatacatatatatccaagtgcatatttcagttacattagagtggatgcctattaccaggggaaggaataagagtgggaaatgggatacaggaaataaagaaacaaacaagagagacacctcgcacaggtcgatgatgatcagtgttaagaactaagcagtagcattaactcgactctctgcatgtgctgtacaaagacaacaaaaacctctggagtgacaagtaactgttggagaaaggtcctgggggacttggaagaggagggaattcacaatccaggtagagaaaatcggccttgggatcacctcctcgttctgagagagaagctgagagaaaggcttcttagggattctgttttcaatgtaacctgtaccaaaggtgttcttccaagtgtgagtgagaaaggggctcaaagagagagagataagagaacaataaattacttttctcaaagaactcatattctttttttttttttttgagacggagtctcgctctgtctcccaggttggagtgcagaggcaggatctcagctcactgcaagctccgcctcccgggttcacgccattctcctgcctcagcctccctagtagctgggactaccggcgcccatcaccacacccggctaattttttgtatttttagtagagacaggctttcaccgtgttagccaggatggtctcgatctcctgacctcgtgatctgcccacctcagcctcccaaagtgctgggattacaggcgtgagcccccgcgcccggccaaagaactcatattcttaatgaaaagactaaaatgcccatttttgtatttcaaatcctactcatctatcaaggtctaggccaaaatttacctcttccggaaagatcccccctggattcccaatagctctaccctaaataaatctacaaatcactcctcttcctgctgaaaatccatagcatttattatgttaaattgcgcctgtgttttcttttccgaccagactgaaggatccttgaggacggcagtacctggcatacctacacagtcagcgttcaacaagtgtttgcaaaggtacatgataattaaaatgtcagataaccaattataaaaaataaattggcctgcacggtggctcgtgcctgtaatcccagcactttcagaggctgaggcgggtggatcacaagggcaagagttcgagaccagcctggccaacatggtgaaactccgtctctaccaaaaatacaaaaattagctgggcgtggtggtgggcgcctgtaatcccagctactgggagactgaggcaggagaattgcttgaacccaggaggcagaggttgcagtgagctgagattgcaccactgcactccagcctgggcaacagagcaagactccgtctcaataaataaataaataagtcaacagatcagatagcatttcagaagaggctaagaacatgttgaactgttcaggaaagactacatggaatagggccttgaaagaagggcaggaatcagctaattagaagacaggaagagcatttcaggccaagggaaaatggtaaataaacacaaagagttagaaggattggagggagggccaggtgcggtggctcatacctgtaatcccagcactttgggaggccaaggcgggcagattacttgagctcaggggttcaagaccaacctattcaacatagaccacatctctacagaaaatttttaaaataaaaaaattagctaggtatggaggcccacacctgtggtcctaactactcaggaggctaaagtgggaggatcacttgagcctgggaatttgaggctgcagtgagccatgattgtgccaccgtactcctgcctgggtgacagagcaagatcttgtctcaaaaaattttttccaataaaataattttatttatgttcataaatgtattagggaaaatttaggatatgagtttcatcatcatgggagtgagaacaacttcctaagtaagatagtaacctggaagccataaacatatatgtatgacaagtcacgtaaataaaattaagagagaaagaaaagaataggaaaagacattttcaaaatatatacaaaggacttattttccacaatatgtaaagaaactattataaatcaatataaaaaagacactcaagatttagcaatttcccatctggcatgtaaaaagcttgcaagtcatcgccccagcctaacaataagtaaaaacctgaacaaactgaaaaatcaacacccttcttacatccaccagagtcatgaggccacagggcaaaccactgcttcctaaattgcagagacaggcaggcaaatgcagggaatcacagcttaccagagcagaaacccatgagcaggaaccagtaccagggtaccaaaacctgagctgtaattgatgaattgctggagactcagtatggacaactctgagaattaaaaactccaggggaagccagtcatgggaggacctcacatattgtgagttttacctcctagagctcaccaggttctcacagtaaatatcagaaaaatatcccctgtgcttctggctgggggaaggaaaagtaaccatttctaaatacacctaagcattctgttcttcttaacaagtcctgttctctcaagagaaactattttgccagaacctaagcttttattattactttttttgcagagtctatccaaactaggggaaggaaaatatccagtttcagcccgctgtagcctttacattggggaagggaatattaaattccatcccactctaaccatcctatactacctaaggagtggaaggattgagaagcttttgcgaggtgcgcagtccagaggcacaggctcactaaatgacagagacctaagcatagaactatagaatgcttcctcacttcttaacaccttaacacattactaaatgcctatttacagcatttctttttgtctaatacatcatgcctggctatcaagaaaaaactacaaggcacaccaaaatgcaaagaagacagtttgaaaagtcaaaacaggcaccagaaccagactcagatatggcagggatattggaattatcatactgggaatttttaaaaaactgtgatcaatatgttaagagctctctctaatgggtaaagtagacagcatgcaaaaacaggcaatgttaacaaagagaaaggagaagcaagaaatgctagagatcctgctccatcaatagcactacgacgaaagaatgcctttgatgagtttgttagtggactgggtccagctgaggaaagaggctctgcacataaggctacctcaaaagaaactttcaaaactgaaaagcagctagacatgatggctcacacctgtaatcccagcacttcaggaggctgggaggattgcttgagcccaggagttcgagaccagcctgggcaacatagtgagaccctgcctttacaaaaaaatgtattttgaatcagccaggcatggtggtgcacgcttgtggtcccagctactcaagaggctgagatgagaggatcacttgagcctgggagactgaggctgcaatgagctgtgatcacacccttacactccagtctgggcaacggagcaagaccctatctcaaaaataaaacgaaaccaaaactgaaaagcaaagagaaaaaagactagaaagaagaaaaagaataaccaagaacggcgggacaactataaaaggtataacatgtataatgagaataccataaagagaaaaaatagagaaaggaacagaaatatttgaagcaatgactgtgaatttcccccaaattaatgttggccaccaaaccacaggtccaagaagttcagtgaacaccaagcagattaaatgacaaaaacgaaaccaacaacgacaaaaacactacacctaggcatatcatatttaaaactgcaaaaaatctaagacaaaaaaaaaaaaacgatattgaaagaagccagcgatgagaaaaaaacccttacttatagagaagcaaagataaaaagtacatctaccggccaggcgcggtggctcatgcctgtaatcccagcactttgggaggctgaggcgggtggattgcctgagatcaggagttcaagaccagcctgaccaatatggtgaaaccccatctctactaaaaatacaaaaattagccatgcttggtggcgtgcgcctgtagtcccagctactcgggaggctgaggcgggagaatcgtttgaacccgagaagcggaggttgcagtgaacagagatcgtgccactgcactctagcctgggcaacagagagacgatccgtttcaaaaaaaaaaattatatctaccttctcctcaggaactatgcaagcaagaagaaagcggagaaaaatatatatattttaagacacggtcttgctctatcacccaggctagagtacagtggcacaatcatggctcactgcaaccatgacctcctgggctccagcaatcatcctgcctcagcttctgagtagctagagccacaggcacacaccaccacacctggctaattattttatcttatttttgtagagacaaagtctctcttttgtagagaagggcccaggctggagtaaaatatttaaagtattgagatataaaaaccactaccttagaaatctgaaccatgtgaaattatcctttaaaaatgaaggtgaagtaaacactgtctcagacaaacaaaaaataggagaatttgttgccattggactggccttgccagaaatgttaaaagaaattctttagagagaagcaaaataataggtcagaaacgtggatctacttaaaggaagaaagaacatcagagaaggaacaagtgaaggtaaaacaaaaacttttcatattcttaattgttctaacagataacagtttgttcaaaataaaaatagcaatagtatatttgattatgtatgcttatatatattcacatgcttatgtacaagtgaaataaatgacagaaataatacaagggattagagggaggaactagtattattttgttattacaaggtactcaccctactgatgaagcagtatagtattatttgaaagtggatttgggttagttataaatgtctattctgaccactaagcaatgtaaaaaaataagtataactaatatgctaagaaaggagggaaaattgaatcatatgaaatgtttatttaaaaccacaaaaggcagataaaagagcagaagacaaaaataggtacaaagtataaaagcaacaacagaaaacagtaacaaatatggtagatataaatccagctataggccaggcgtggtggctcacgtctgtaatcccagcactttgggaggctgaggtgggcagatcacgaggtcaggagatcgagaccatcctggctaacatggtgaaacccccgtctctactaaaaatacaaaaaaaacaaaaaaaaattagctgggcatggtggcgagtgcctatagtcccagctactagggaggctgaggcaggagaatggcgtgaacccagaaggcggagcttgcagccagccaagaacgcgccactgcgctccagcctgggtgacagagcgagactctgtctcaaaaaaaaaaaaaaaaatccagctatatcaataatcactttaaaccacaatggtctgaatacaccaatttgatgacagagattgtcagactgatcaaacaataagacccaacaatatctgttgtctataagaaatcaaatataaacaaaaacactattttcatctgttttgctgccgtaataaaatagcacagattgggcagtttataaaggacagaaatttatgtctcacagttctgcaggctgggaagtccaagatcgaggtgctggcaggttccttgtctggtgagggccaggtgtcttgaatgctgaatcctccagagtggaggactgctggatcttcacatggcagaagggcaaaaaggataaactccctctgtgaagcccttatataagggcatctaatcccattcaggagggctccaccctcataacttaattacttcccgaagaccccacctttcaatagtgtcacattaatagtgccattaagtttcaacatgaattccatgggggatggatgggtgtttgtttttgtttcttagagacagggtccccctctgtcatccaggttagagtacagcgatgtaatcatagctcactgcaagcctcgacctcctgggctcaaggaatcatcctgctttagcctcccgagtagctaggactacaggcatttgccagcactcctggctaagtttcaacatgaattttagaaggtacacattcaaattttagaagggatgcattctgcctctggcccccacaaagtcatgtccttcccatgtgcaaaatactcattccatcccaacagcccccaaagtcttaactcattccagcatcaactcaaaagtctaaggtccacagtctcatctaaatcacatatgagtgagactcagtgcatgattcatcctgaggcaaatttccctccagctatgagcccacgaaaccaaacaacttacatgcttccaaaatgtaatagtgggacaggtgtaggacagacgtttctttttcttttttgtttttttttttcgagacggagtttcactcttgttgcccaggctggagcgcaatggtatgatcttggctcaccacaacctcctcctcccgggttcaagtgattctcctgcctcagcctcctgagtagctgggattacaggcatgtaccactacgcccggctacttttgtatttttagtagagacagggtttctccatgttggtcaggctggtctcgaactcacgacctccggtgatctgcccgcctcagcctcccaaagtgctggattacaggcgtgagccactgtgcccagcccaggacttacatttctagtccaaactggagcaatcagaaagaaggagtaacaggtcccaagtaagtctaaaacccaaggcaaacaacgttaaatcctatgactggagaataatcttctttgactccatgtcctgccttccagacacacttcccacaagcgttgggcccccaagcccctgagcagccccactcccacagttttgctggaaccagcctacacagcagctcttatgggttggaatagggtacctgtggctttcccaaggctggcattgcaagtccatgcctcaacgggtctgaggtctcaggggtggtcctgcccccacaactccactaggtattgccttcgtgtggggatctctgtggcagccctgttcctgcagcaagtctttgcccgggccctgaggttgtctgaggcatcctttcaaatctagatggaggtagccatgcctccacagctcttgcactgtgcgtccctgcagagttagcactacatggacgctgccaaggtttatggcttgtgccttctggggcagcagccccagctgcacctagacccacatagcaaagattttaaatggccctgggcaggaaatcctgaggtctcacaggtgccctaggcactcccccaataacattctgcttctgaggccctaccactcaaagcctgtgatgggcacaacagccacaaagacctccaaaatgtctttgggtcattctcccattgtcttgatgaataccacctgacttccttctatccttattaatctccttaccaaacagtcacttggccacacctttggttttctctctaaacatgcttttttattctttacatgacgaggctgagaattttccaaatctctacattttgcttctcttttttattaagaaattccatcttaaaatcgtttctctgcttgcattttactataagcagttaagagaagccatgtagtaccccgagcactttgctgcttagctattccttccaccaaatatcctagttcatcactcttttttttttttaagttccgggatacatgtgcagaatgtgcaggtttgttatataggtatacatgtaccatggtggtttgctgcacctgtcaacccgtcgtcatctagattttaagccccgcatgcattagatatttgtcctaacgatctctgtcccctttcccccccaacccccgataggccccggtgtgtgttgttcccctccttgtgtccaactcccacttatgagtgagaacatgcagtgtttgtttttctgttcctgtgttagtttgctgagaatggtggcttctagctgcatccatgtccctgtaaaggacatgatctcattcctttttttttttagtttgttttgttttgaggcggagtctcactctgttgcccaggctggaatgcagtggtgccatcttggctcactgcaacctctacctcctgggttcaagtgactctcctgcctcagcctcccaagtagctgggattacaggctaatttttgtatttttagtagagacagggtttcaccatgttggccaggctggtctcaaacacctgacctcaggtgatccacccacctcggcctcccaaagtgctgggattacagacttgagccaccacacccagccaatctctctctttttttttttaatggctgcactagttcaccactcttaaattttgccttccactaaattctaggacatggacataacacggtcaagttctttgccactttgtaacaaagatggcctttcctccagtttggaaattgtttcccatttccatctgaggcctcatcagaatagtcttcactgtccatatttttaccagcattctggtcatgatcacttaggtaatcattaagagagaagctttccctatatagctcttcttttctgatcctttagtgtagtagaatcacccttaatactccattcacaccaatgtaagtttttccatcattcacttcaaaaccgttccagcctctatccattacccaatttcaaagctgcttccagctgggcgcggtggctcacgcctgtaattccagcactttgggaggccgaggcaggtggatcacgaggtgaagagtttgagactagcctgaccaacatggtgaaaccccatctctactaaaaatacaaaaattagccggtcgtggtggcgtgcgcctgtaatcccagttactaaggaggctgaggcaggagaatggcttgaacccaggaggtggaggttgcagtgagccaagatcacgccactgcactccagcctgggcgacagagcaagactgtctcaaaaaaaaaaaaaaaaaagccacttccactaagaccaaaacaatgcaattctccacaatctcttccagaagacagaagcagaggacatacttcctaacttattctataagtccagcattactctaataccaaaaccagacaaagacattatatgaaaactcagactaatatctctcatgaacacagatgcaaaaatccacaaaatattagcaaatcaagtccaataatgtataaaaagaattaggcaccatctgggatttatcccagatatgcaaggctgattcaacatttgaaaatcaattaatataacctgtcacattaacagtctaaaaaggaaaaatcacatgatcatatcaataaatgcagaaaaagcatacaacaaaaccccacacccattcattaaactctcatcaactaggaatagaggtaaacttcctcaatttgattaaaaaacaggtacaaaaaccctatagctaacatatttaatgtcaaacttactaaatcagagtgttatcattgcatggtggaaactcaggttgctatgcaggggtgaaggtatttcatcagaaagaaaaataactcagactccagaattgtttctaatcatccaacaatcatatattgttcactattctaggagttgtaacacttctcagtatgttcaggagaaatgacaggagtaactgtctcattgctaaataattgtgcacagtggggagtacagtgtcttgatcattaattccacaaagctgctatgagcagaggcacgatggtcatgttgacatgaaccagggagtcttaaaagggtagatggttgggaaaaaagcgagggtatgacgacaggcataatcagagaactcaaaagtgatgtcaaagttaggaactttgaactgaggatctcaaatcacagtaacggataagattgctaaggtagtgactctccaagaggttcatagtaatactaagctgttatttgttcatgtttccctcgttctgtcatgaatgtacaatggagctttccagaggctacattatcacaccagactgaatgtagaagcacataagagaattctgctattaagccggacattaaagatagagtatttgcaaaaatgttaaataatgccactcttttcatgctttttgttttggaaattataggtattttcccataaaaatatggtattaatattaacaagtattggggttattatcgctaataataaaaaaattaaaataaatatttttaaatgtttccattttgatctgataaaatacattttaggccaggtgcagtagctcatgcctataatcccagaactttgggaggttgaggcaggaggattgctttagcccaggagttcaagaccagcctgggcaacatagtgagaccccgtcactaaaaaaaattttttttaattatttaggcatggtggtgcatacctgtagtcccagctaatcgggagactgaggagggaagatggcttgagcccaggagttcagggcaagccatgatcgtgccactacactccagcttgggcaagagagcaaggccctgtctcaaaaaataaaaataaattaaaatcttatattttagagcagtttttagatttacagaaaaattgcaaagatagtacaaagtgcccatatatcccagttttcccgattacaaacatctttcttacactacaaatgtatggtacagttgtcacaacagtggaccaatactaatatattattattaattaaagtccatactttgttcagaacgcctcagtttttccccagtgtcctcttccttttccaggatcctatccaagttataatattacatttacttgtcgtgtctccttaggcgcctcttggctgtgacagttgctcagactttccttgtttttcatgaccttgacagttttaaggagtactagtcaggtattttgtagaatgtccccctggtggaatttaccaggtgtttttttcttgattagaccggggtaatggggaggaggaccacagagggaaagtgttgttttatcgcatcatatcaagagtacatactatcaacctgacactggtatgttgaccttgatcacccagtgaggttgtatttgtcagctttctccactgtgaagttgcttttcccctccacactccctgtctgtacaatactcttggaaaaaggtcacgatgcatagcccacacttaagtagtagggagttgtatgtcacctccttcagggcagaatacccacatacattatttgggattctgtataggaaatttgtctcttctcctccatttatttattcattcaatcatttatttgtatcagcatggactcatgggtatttaattttatgctttgggttacaatcgaaaactgttttgttttgttgcccaaattgtccagctttggccactgggaacttttcagttggctcctgagtttatgttaatttttaatatggatagctattacccacataaacaaaagctctttggggtccttgataatttgtgagtgtaaagaggtcctgagaccaaaatgtttgagaaccaccgctctagggatcctctggctgacccgaatccccggtgtgtgtgcgcgcttcgtctgcaggtaggagttgtggtctggacagaagcaaagtaggccacactcgcctgcccttgggaacacccacttctccgtgccacgcccgctcctaaggttttcttcgggcagaaacgcggggatccccaagaagacgaagctcaggctgccatgcctttcccgcgaacgccacggcgcggcgcccggttcacagggcgagtcgcccacccgcgagtcggaaagcgcccggaatcttggctaaagctcagcgttctcctccggggctggggccctggccaggcctggcctgagcggtctcccctcactctgcggctcgctctcccgggctactccggcgcgcaggtgctgcgcccgcgggagagagcgatcctgcggccgtggcggacgccgggaggagccaccgggctctcctctcaggagcgcgtccccgtgccctccagctgcccgtccctgctgaaagcatccggacagctccccgggccgcggccctggggcccgccagagccctgccctgcaccccgctctcccctctctggcccggagggctgcgccgggcagatcctttcctctgcaagacagagacaagcagcgataaacagctaaagctggagacccggctaaatgatacaataagttctctaattgcctcgaaaataaggtaatgatttggcagagggaatgctttgatcttatcaggcaagagagacctctccaaaggaaacctcagagaagggctggaggcctcggacttgggggtgtgaagcccaaggacagcctgctttccccgccctcccccgaccctgcgtgtccacggtccccagcctcaccctccggcttttcatggaaagacccttctcctgtgatgactggaggagagtacacacacataacacaggggttaggagaggaggagggggtgggttctgggtttttcaggaacaggaggacggctgaaatgactggtgcagttttagagaggctatagagaaggaaattgggggagaggggattgcggacagggattatggaaaacctgacttggctcaagtctgatgatgtttcttacacagtgagggctgctgatttgagcttttcaggcaggagggagtgacaaagggaggagaactttgagtgtcctgccttctccaagaatctgcacacacactcacacacacaccattgctctgcgctgtgggtgtccctgcctggcagaggccccagcacaaagaggattagagagatgagctaatctggtttgtatcccagacatggccccagaaagggaccttgtccaccctgatatgtaaggatgtgaaggagtgaggagtctttctttgggggcctgctggctaacagtaccagagaccccactccactggagtccctgggatactgcagtcctgacttcagggtcagatttaggaagcagaaagacggtcggtcccacagaaggaactagatctctaccctacttgtttcaccagtggggaaactgaggcctgaagtgggaaagtgatttacagagtcatgccaatagtgcatggctgagttgggggaaaaaaccctcaggttttctgactttttactggtccagtgctccctgcactgtgttgcaggagctgcaagggagaggtatgagacagagagagggcaagagaaagagagagacgaagacagaagcaaacatacacaccaaggaaaatagaggtgcgcacacacccacatgcacagagagacggagaaagccacagagagtcagaaacaacatggagagacagatggagagagtgaagaaagagcaagacaaacggtcatacagattcatacagagagatacacacggagagacagggagtgacacaatctgacagggagacaggcaagagacagggattcagaaagagaaggacagagacattcagacagggagggggaggcaggccaacttagacacatagagagacaaatgaagacagggagataaacacaagagacagatgcaaatagacagagaatgacagaaacaagagccagagagagacccagggagatggagactcagagaagagacatggggagagtatgagaacaagaggcagcgtgaactgaggaaggcagagtgggagggaggcaggccatgccctctgcagatatttgtccattggaaacaactctcacttccagatcattctagggcccagaacaggtggtagggagagaaagagggcttagtgcttagcctgtgtgatacaggcagactgggaaccctcccttggggagaggctggtcagttgaccacccaggatcccagcagcacacccactggcctcacacagaacctgggccacccgcccggaatggccgtcagcccgcccactgcctggctccagtctgattacagccaaagtgccaaaaggctccagacacccccattccctgcccccatcgtctcacctccccacgcctcctctcctccttccccttctcctttacatccctctcttcctttcttcctagtcctcaggggagcagtttgtgcccctgtttagccactagctgggaggaaaggggttctcctccatcaagccccctttcctggtttggagctggatgctccttccctccaaagcccttttggtctggcctctttgagacacgttccacgcctcgcctaagagctcataaataccaaggagaggccggccaggctgtgtacaaagcgtggatccccactcttttccccccttaacagctcctgggttcttcccaagcttcctttacttccccagacacctgcatggggtggcagggcaagaggtgaggcattagttacctgtgtgaacctggccctatttcaaataagacctgcctcggtttgcaaagaaatctcaggaaaggcgtctcagggccccttgtgcaagcagcaggctcaggaattccttgactcccatccaaacctccccccagccccttcttggcctttctctctgctcattaccatccacaccacctcccacccaccgggaaaaagagaaggtcatcgccaaaggggcccagggaaggggagccttctggaggatagagcagggtggggtaagagctgtttacccacaccccagctccccttagctcatctcccctcccatccaagggccagcaaaaattcaaaatcattcagccacgcatagctgagaacagagtgaaaagaaatcttaactctgtcccaccagagagcagagcataaggtgacatcaagggtgacagtggacccttcttctttgggcacccacttttgagaggacaggaggaggctctagtgccactatggggaagagggtggacctgactctgctggctgggtggaagctgtcctgctggaggccccaggtaatctggcagctttcaggggacctgggattcttcctcaggtctctactgatactgttcactatgtctgcagcatgcacccttgaacttcagcagagcctagtgtgccacccacagacggttttattatatttccatgaaaatgccttgggagtaatgccttttgctccttgttatttaggataccctggccagtgttgggcacacagcaggtgctcagtaagtgctgacttgactccatgcagggttctacagaccagaacttaactctgagatcagtgactcctccctctggctcccagaactgagagtgagagtgtggaataaaatgaagatgcaggtcaggagctagcttgagcctctggccttgaccctctgcctggcagccccacaacaagcctttgcgtgaggagctgagctctccagtagtgtctaggaccttgagactggaagtttattttgagatttgaagctccaaagaggcagatcccagaaaacctcttctctggctccatatttgttctctagttaagtggttgagtgcagctcttgcagtcagctggctcctgcagcctgggattcctcccggggaactggggactcagaggagaggggacaaagaagcagaaggagccaagcctcatcctaggttgtccactctgggggcagaggtgacttgtaaaccttagagagaagtctagtcccctcacccacttccttccctctcagagctgctgatgtttctggctgtacccccctcacccctcccttcagctcagaaacatgctttaaaattttttttatttctatttatttattttgagacagggtctcactctgttgcccaggctgggtgcagtggtgcattcatgcctcactgcagccttgacttcctgggcgtaaacaatcctgttgcctcagcctctcaagtagctgggaccacaggtgtgcatgaccacacctggctaatttaaaaaattttttgggtctcaccgtattgaccaggctagtctctaactcctgtgctcaagccatcctcccaactcggcctcccaatgtgctgggattacaggcgtaagccaccaagcctgggcctcaaaaacatgctttaatacttgagcatctgtgttgtgccaagacacagtcccacttgactgtaaagacagctcaggccaaagaaggggcctcagaagtgatttgggggcccatgtgggcgagtccactctaggttagggctgatgtgatcatcttcagccaactttccccctccctgcgctttccaccaaccccaggccctgtgtagaaataaacacagggccagagtcacacccaggtctaaacacacaggggagtctgggagaggctgctggagctccaagactgccctgtgtagggatggggctgggttgggaggaggtaaaagagtggtccaaggaaagaggcccagccaagaaggagcctgggctcattcctctcccacctgcccctctcaggaaaactaagcacagagtctgtgcctttctaaggaaatagccaggccaactggagcccacccgacaaaaagaaagggagagaaggggaagaaaataagttagcctgttggccacaaaggatatggtcccagtttctgtgccaggaagtcggccctgagaagtgtctgtattcagtcctctccaactcccatccaactccagcccagcccccactttccacccaagtggggagcactgcctcccattcatgacttggagcacctcagggactcatctgaattctcttcctccacgcactccgctccagctggatggccttctcgataaccctcgtacaccagcccactcctgcctttgggtccctgtacgggctctgccctcggcttaggatgctcttcaccaggaagctgcctggcttgattccttgcctccttcaaatctctgcttgcatgtcaccttaatgaggcctaccctgatcatcctagttgcaactgtaaccatccccttgactgtgctctctttaccactgcacttactactttttaacatactctgttttacttctgatgtttattgtttatggtctatcctcctgcaatagaaggcaaactccatgagggcatagactgttcaccaatgggtccctagtgcctagcacagtcctggcatgtggtaggaaataagtatttgttgaattaatgaatgcactcatcaccttaccacagaaagtgggggtaaaggagtgtcactgtaggttggggacaggagggaagtgcttgcagccccttcccactctgcccgcccacagaagttggggctgcggagtgaggggcgctaggacccggaggcggtggggagagaggttaaaggttcctctgaaaccttctccactatctctgtctctgagatgtctgcagccagctgcaccccatctgcttacactcgggaggcacctctaacgccaccaccgccccccacccccaaccaaagactgacagtgaatttggagttgggggcatcggcagttactagtaagttgtttaccccaggactttaaaatcatatgaggaggcaggaaagacacctgcgaggtgggagaaactgaggctgaagaagcgactggagccagatcccaggtgaactctgaactctcgaagttaagcccaggattttaaaaagaattttacttctgacggagggccacagtgcccgcagggcccgtacctgctatcctgggaggtttgagggttggggtggtggggagaggagagtctctttcggcagactgcacctccccaccccttccctatttaccacgcccccaggcgctgtgcgggcggagggagggtgaaggagcagtggggaggaggcagggcgagaagacgaaggagggaaaaagctccagggcttccactctctcggcaggacccccaccctggcctctggtgcgggaaaacctcccagctgtttctgattctttcatactctcagccccgcccgagagggtggaggaccgaggcacagagggggagcggggagagactgagctccgctgagcccaggagtaaggggcggggagtccgcaggtgcccccttagcgtcggcagtcgattcccggtccgtaaagaaaagcacccgggccgggcaggccgggcaagcaggagccaggtctaaacgtgatgcattgggggtggggggtgcagtggctcagaagaagcaggggcgatgagctctagctgaaagcatcccctgctagaagccgactgcccacggcgctcctgtaggcagtgttgaaaaggtagttaagacctccaactcccggtggcagggactctacccatttcacagaagcgcaaggatggaggaaatgagtgcatcctccgtgctcagcgccggtgtcactgtaggttggggacaggagggaagtgcccgcatccccttcccgctccgccagcctggccgtcacccatagaagtggggctgctgagtgaagggcgctaggacccggtggcgcggtgtcggcagggactgggcgcttggggcgcaggagggagccgcggcgtcccgtcgcagcgtgcgggagcaggtgggggtgcagcgcggtggcgcgcgggagccccgaggggcggaggcggctgctacacctagggcgtcgcggagcgccccgggcttggcgcgggcggagccgccctaagggccgcgcgtgtccccggcctcggccccgccccgtcccgtccaatgagagcccgcggccgaaggggctgtccgcacactaggcccgcagctcccttcagcgccgcagaccccctgacaccgcacccggtcctcaggcagcgcgccccagaccccgggttcggcacgccgtcgtcggcttccggacatcgcaacttgcgcccctctcggggatcctcctcccgggctctggaccccaggtgatcctaggtccccagccgccggcgaacaccatggccccccaggggggtgaggtaggagcagcctgagtacccccagaaggtgccccgtccacgcccctccgggctgcgcggcgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtaagtgtggctctcaggctgggcgggtgaggcgcttggtaggagaggccggaggcgcctggagggactggctgctcacgggaccaggctgttgcttcgacgggttggagacgattcgggcaggactgtcactgaaatctgaagtcgcggggtggcgggagggtgaggcgccgcgtcttacacgactggtgagaaaggcgctgggcattcggagcaaggatgcccggtggtcgcggctccttaggcctccacgtgctgtaccccctctatttcagctcaagccccttagggcagaagctaccttccgagtttccctcagggtgagttcaaggaacgaataaccttccagggcccgcaatagcttcgccagggccccaatcgcctaaggtcgccctctgagaggtggagaaaggggcagctcgctagtctagcccacccataccacaggaaggctttggtgaggcagcagcacccagccgaggcttagaaatggaatcgaggcaaaatttaccccattaactcccacaattaaaacaaacaaaacgcatgggtttgcattatctaggcatttgtcttcagccaccgttttgaggatgtcacttaggaaactttgcctccctcccttcttcctattctttcccatctcccatttctcccctccaagagccagagggctgcggagtcccaagatactaagagaccccctccccagatttcttgcaggccctagactccagacacttcacaagagggcagatgaggcaaaaaggcattacagatccactggatgtctcgtgtctgttctttttagaatcctccctgccccctactccttggatggcactcatcaccttcccgtaggagaaggagctgctttcccttcttccccaccatggggagagggcaaagcagggagagttgaacctagaaaagactcagtctttcctcttcaccccacaatcaaactggcctcttggactaggctattgcccctctccaccaggcagtgcctcccgtcctttccttactccgttcttcttcccgtgcaagcccccctccccgaaatgtggtctcttctctccttgcaccctgtggcttttctcctcttgacttggaatcttggctgaagggtgaggggtagctggccgaggggcccgccagcttgggctgcagattcctatcatttcaagatgccgtctctccttatcccaacccccaccccctgttttcctgtttcagaaaaatctcttttgaattttttttttttaaatctctgcagtgttggggaaggcaaggagggggggttctggttgggggaacagagaggcctatatcttacatctggcttgaaacattcttttagaaagggaaaggggagaagggggatgaggagaaaaacctttcaaagttctgagtgagatcaaagctaccttttgccttcatgagcttggtctggctggggacttggcatcttcagggtctttgttgagacaacatgaagtaaccgctgcccatctttatctggctcagacagcagtttgctttttgggactcttgattgcttcttaccagtttgggatatagtcttggggaccaattggtgtttgggtgaggaagtgtcactctggtaatttcagcatcctggcagtggttcctaaagacccaaatgggggtcttcctagttcccattttgtactcttgactactccctctcccttttcctttctccctctactaccctcccctgatgtggttcatattaaagattctggaaaaattcctgggtgaaagagctagggagggagggagggagggaggtgacacagagtgacttagcagcccctgtgaaaaggaggaaggctgcaacagggccaggttgggaagtgggtacagaggttgtttcagcctccttgctccacacctgtcatagctacaggcccagatgcctgcctcagtgatcaccacttgtgggataaggtgaaaagctaccttctaagggcaggctaagcccccaagcctttctcttaggaaaaaaccagcaagattgatgttctgtacaacccgtggaagagaaatgcctgttgactctggtgtgtccatgttccactctggagcagaaggccatcattttcaccagttaatatttggatttttctcatagcttgagattcttccccttactctctaaccactgccctccctctatctatcctaaacagaccaagaaatagggagcttccggcatgtgctttcctgtttcattttgcattctgtagggggttggatgtagggaatcacaagaacaggattgtattcataggctcacaaagggagagaaacacaaagtggtatcatattgttagcactacttttaccaacagcagttgcttttaataagcccttactgagcttcaggcactatggccaaacaccttatgagcatgatctttgtcaatctgaaataatccagtgagatgggttctattatcatccttatttcacaaatgaaagtgagggatgctgtggcattaagagcagattcatggaggctaatagtgttatctctgtgttcaaagttctatatgtgctgggctgaatcatgtacactaggggctgtacacgaaaggaggaaagaaaaaaaaaaagcagatccctggcccgtttgtgtctttaacatacaaacataaaacatctgcagataggctggcaactgttgacaagtaaagctgtaatggaaatgggagttaatggctggctagagggagaagggagttggggataaatcagaacagttaggtgtttattcaacaaatagtgattgcatacctactatgtgccaggcactgttctcagtactggggatattgaattgaacaaaaccgacaaaaatccctgcctttgtggagtggtgcatccaaaccatgtgaggatcatggtgaaatgcagattctgttacggtaggccttgggtggggcctgaatgtctgcatttctaacgaatccccacatgatacagatactgctgttctggggaccacactttgagtagcaaggggctagagtagtgtatgcctcactttgtcaaatgaagggatgtgaattggccaaaagcaggtgaagagaagcattctggggcaggaagctgggaaggaagtgaagaacttccagaagggaaaaacaaagctagagtcagggcatctaacactctaccagaccgtgaggtgggagatgccttaaatatctttgtgtccctgacatctgagctcagtgcttggcacatggtagacattttgcaggcatgtgttgaactgagaggaagatgtggttagcctcaggctcagctttattggaggctccctacactaactacaaggggctgactactggagagcaagcaagcgccatgctctgtggagtcttgaagccattacttagtggagtaagggtggtaatagagacatttaattatcttcccatcttagatactgaacagatgttcccacactcagtgaggatgtaataaaaaggacctatgtgggctgcagcagaatggatttaagtcagaccacaagaaggacttgttgcccgagtttggcctgccccactccagactgtctcacgagggctgggttattggtctctcattcccatccaaccctcctcacccaagccccattaaaaaaaaacaaaaaaacacacccattgcctagagcagtacttgggctgaactagggaagctgaacggtggtgagacagggacaagctccaactccaacggtcttgattctccaaacaaagcaccacagcagtgggtgtaactctgggctgtgcgtcaggcagcctttccggcctggccctgtctggggtgtttattttgtttgttcctggaagctgttgccctgatggacagtgctggggatgctgattccatgggatttgttaggggagggccagccctctcaccccttccccgggacagatgggccccatcagccctgctgagttcccgaagaggcaagcatcagccctccttgtgtttgtttgagttggtgtcaccagtggtgatccagtctgtgggtgagggccggctgtgggaatgcaggggggtggtggggggggacacagagcccagggcagtctagcttttcccctccccacaccagctgccctcccttctcctcacccacttctaggcccattttggggccgttcccaaaccacaggctcattcatagctcaaaccaagtcttttctgtctgcagtaacaattgctctccatggccccacctgttcaaaacaggggagggagggcagccctttgatgcgttctggacaggagaataaaaagttcccagcaaatcaaggaaggtgctatggggttaaagggagagaaagagaatgacaagtggagctgggctgttgagctggaggaagtgggtgaatgggtcagatctcatttggtggcctcttggggaagaagggtgatatactcctgttttctctctgaaatattcttcctgaggcttgtggtgggatccagggttaaaactgagtgaagagaaaatattgccttgagaaacaataatgactctggcaacccacctattctttagtagcccatctcaattgaccttcttttaattgttcatattggacagactggagactgcagtgtggggagagtcatcctcttacttatcttggcctttggcttcccactgcagacagcccttgcaggtccatccaggttggggaagatggttttaaaaggttcattagttaagaaaggccctggggcctggaaataaagggtttgaggaggagagtagagggtggggtcttcctccccggacctcacgattgggaatgaggattttttttagctacacgggtctgactagagctgtaaacgttactcagattgctcactatgtctcttcccacgagcccctccctgtcaccacccccctgctgtcaaaccatatcttcgtggaccagccatgcgggacatccctcttaatgggagcataagagtgttgtctcagacccttattttgttagtttatgtttccatgaagctcttaatgtttattaaataaacagacaatgagtttgtgtgacatgcccacagcttctgtgtatgtgacacatgcctagcctgtgttctgggagtgtatgtcactttggcctttggctggggaactggtgatggtgggaggccactcaattactctctctgcaactgtataactattaatacttcttcagaactgtgggaaatggttctactcatcagctttatggaatgtgggttagggagaggggacagaatctcttcaaggtctggatgctaaacgtaccccttccttattccctcccaatgcagaaaaaggtctgggatgttctgacagggccatctctgccttgcaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtaagagcctcttccatcctgtgtcagctccttccctttctgtgctgggggtggtgagtgggaagagtaggcaagatctcccctctcctctcccacacactgtttcatcatcagagaaagaactgtgggcagagcccaggatataattgggaacagactcttagcatcttagatttgtagacaggggctcctctaaatcttagtgctctgggacaagaccaaggtaaagcattccctagaacctccatctttctccctcattttccttgtcctccccaatccccagcttgggaggctaccatgtactgtaaggctgaggtctatgataggccctctgttcttaacaccaccatcactatcgtcaccccaacactcccaacactacagtaatgggaacaaaagataaacagaaaggtgatatgtaaatatttggagagtcagtggcttggcctcagctcagcaaaaaagctaaatagagctagacagtaaactaggagaaagggaacaagatgggaatctggaggtgtcaggcatacaggggcgataattcatcagtctccaagagcagggagggagagcaagcaggcaagggagggtagcatggatctctaaacaggctgacccctgggctggggtctccattgtgggggaactgtccagcagagtgggcctgaaaaggcctggaatgtggactaaggcaggcttagctgagccagtgctggcactcagtgggaggggatgattcaccaggagacttttcaatggatggacacagggaatttggcaggaaacaagagtataggtcagctcaaaaggtcagatatacaaagaagtggatagagagtagtgagggctgaggggaagaggtcagatactctggggaatgctcttggaaatgaaaggcaccttgaataaagggggtgtaggggtgactctgggaaagaaaattagggaagaggtttcagagtcagaggttgtatgggctgaagaaggggacagacatgggcctctttcctgaagcacacctctacaattctctctctaggtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggtcagtactcatgtctgtgtaagtacactcatatttgctgggggtgaccagtgtgtgtgaccatggactaaataaatgtgaagatggaagagctgaaggcttctgggtcacttccaaaagccccaacatcctgggacaggagaactaaatgcaagggagcttaggaatgcctagggtcaatcaggtgcgtgaagagtcttcacataggtggaaagtaggaaaaggtggagaaaagaagtaactttttaagaaggaaaagaactgccttcataaagactgagaggataagaggttgttctagtcagttccctggtatttgaacatcttctatgtgcctagtactatgctggaaaatggcacaccactaaagtagaaggcatggtacctggcactctaaaacgtgaaaagtagaggatgtgcaagcacactgtcatcgtgaacagaatcctgtggctctacagttcagtgggctgtcatgaaaaggaaagcactgttggttcaggcagatttcctggaaaaagagtttcttgaacttgatcaggaagaatgggtgggatctgatgtgggagagaaccgagagctcaatcggccagccagggccaggtccagcctatctcagagcactcatccttttggacctagggatgactaaaatgtgtcctgaccagctacttctcccttaactgccttccccctcccccaggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggtgagtaaggaaggcaggcagggacatgcagtcccagttcttagtgcaggcacccctggttaatcatggtctgttcagtctcaggagttagggaagggggtgctgtgggaggaggcagtttcctctccacatgaacacctggtcatgagattgttgcagtccaccaggcccagtgctgcccaagtagagaggaggtcactcagctccttgaggcctgaggtcatgcatcgctcctttgtatcccagcatctgggatacagtaggcattattcagggtatgtttaacttagttacctgttttcagttttaagcaatgtgtgggctgcacagaaacataagatgcagccctaagcctttggctcttcgcaatctacttaaagaaatgagacataatgggtagacaaatgcaaagagagatggagaaatcaataaagtttatttgaaaatgtagggaaaaaaaagaaactagaatttaagctgctccttgaagtgtagggagtatctggatagcttgagagacgagtgggcaatttcttatcagagagtagtaggtgggaaagcacatgatctgtcccagggacagagaacagaccaatctgctgggtaaaggttctctctaagggagattaaagctagaaagatgtccttgaaaggctttatccagtgtgctgccattgaagattctgaaacagctgaaaaagaaacgaagaagagatccctaccaaaggcaggtaaagcagcaaatggttgtttttcagtctgttcgaggtatttgtggtgggattcttggaggtgctggaagttgatatggtttttccccaagggaatgaaagttaccatcctggctcacatttctggttcagataggttaaactaggaacatgcaatgcagcagaactcttctcctctggttattgctgtggggctcccaggctcttttctacaggctcagcgtcaggacttgggtgaagtggagccaaaaaacctcagctatcttcggtactgtttgttttcacccatcactgtcattcctggaagagtcaagtggcttggagtaaaactgggcacagaaaaagggtggggctctacccaattaatgaagaaagtagtctgtatactttgtagggtgctagaagaaaaaaacttggagcccttctgattttcctagtgatttcctgccactaagtatactttcctcccacttggtctaattcagagggtcactctctggatacctagaaataattccataacatctgaggtgtaaacctatactaccatactgaaaatacacctttagggaaggaactttggagttaggagggaggataagtcaaatgtgtgttcgtttttctcagaggcataaaattaggcctcctaaaacccaaagtgggccctggaattcaaagaatataagtcatcccagaaagaatatggagccaggaattccctccaaagcaatagagtccaattgaactttctgtgatgatagaaatgttttcctatctctgttgtccaatacagtagcaactagccacatgtgattactgagtacttggaatataactagtgtgactgaggagctaaattttttagtttaattttcattaatttagatgtaaaagaccatatgtgactagtggctgctaccctggacagcacagctccacagtgtagaaggggtttttggtgcccaagaggacttaagacccagcccttggagttaggagactaacatatacagtagacctagtcagtccacattccagaccagtggtctcctaacattctggatcctttactcctatcattaaaacaatttgagcatatatctccattatatgtatatttatttatacctgtgttccactatatgaatatgtatattataaaacgtaaatattttaaattgatgagataaaaaacatagaagttctagcattttcctcccgtatcccagtgacatttggagactaattctgtagaaatcagttaatctattctccgttttgaacctaggctagtcagtttcccatctctggattcttattaaccatggaaaagcttggagtagatgctctcatgggcccaactcatccaaaagtctattgattttatgatctgttggcaggatctcttttgctaaaatcagtcagaatgaggttctaagcattccctatgcatggggaaaacatgatccctatcctagagtttccactgtaaggggaagggataatgcttagggataatagcaataataataatgcaagggatattacttaggaattccttaggaatatgcctccagccagtcatggtaatcagttcacctcttcagatgaacagagattatatctaacaatctattattgtgcttattttcatatgagaaactaagttaatgtttcattttgactaaatcacacaactaagagtggtagaactgggatttgaatccagacaagatgatgtcagagcccatgcttcttttttttttttttttttttggagacagagtttcactgtcacccaggctagagtgcagtggtgcaatcttggctcactgcagcctcgacctcccagcctcgtgttactttcacctcagcctcctgagtatctaggactacaggctcatgcccatggcacctggctaattttttaagtttttgtagagacagggcttgctatgtttcccaggctggtcttgaattcctggactcaaggattccttctgccttggccttccaaaatgctgggatgataggcatgagtgagccactgtgcccagcccaaaaaagcgattctttttatcttccttctgagaatgtggttaagggtatccagggcagctgaagagataactttgttctcactccctctcttccccaacccaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccaaacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgt

SEQ ID NO: 36866 - DNA, 53866 bp, Homo sapiens; identical to SEQ ID NO: 36865

SEQ ID NO: 36867 - DNA, 6224 bp, Homo sapiens
gccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcgtgtacagcgagggccagtccgagaccatccttggcggcctggggctccggctgggcggcagcgactgcagaggtaacagtggcccctgatcctccccctgcacggtgcagagctgagcctgtccacagccgtgtaccgccccgctctccctggccccggggcagcacccaaagttttgtcccccccaccgcccccacccctgttcacctcgcagccttgggaacaccaggctccttaggcacgtctagctccggacaacttttctctcgtcttctcttctgttcgtctctcttctcttccgggaggtagccagcaccctcactgacgcctggatgacttggtcttgcctggaatgacttggctagcccctctctggagcacaaaaaacactgggatctggcattgtgcagctcctgtccccacctgtgccctccaggtgcccttgacgggcctgatctgcagaaattctgttcttaccgcctggcactccctggcacagtccaaaatcagagtttggacccagcacactatctgcttcctcctttgcacatgccagcctgctcggggccccggactttgctctgagtaccttgtggtactcacaagggcacctcacaagggtggcagtgcccggaagccttggcagctccctcagggggatgagggattggggtggtacagagtctcactgccctctctgtgggaggctctgtcggaggctattggagagaaatggacactaacccactccaggaagctccagttctagagatggctggggagcccagagtgaccccttcctgggagggaccccgtgaagaaagaatggataggagtttgccaggaagagtacaaggggcaagggcgtcagggcagtgggcatgggtgtggaaaggcaaatgtgttttggcaatgccgcgggtgctggaggaggcaggtgtggccggaggggaggatgtgtgtataggggcaggaggagccgccctcagtctgatgccatttgcagtgcttaggccgatgcctggcaggcacatagtgagggctgggaaatgttagctgtttgtttgttcttagtattagcaccatttgcctccttccactgagtgtctgagtggagtcttatttctcctctgattcaccacatggtagatccagaacgaacctggcctgtgcgtgcatcccagtgccacgctctttctagatcacccggctgccactcagtgagagctctaaccatatttctgattttttttttttttttgagacagggtcttgcttttttgcccaggctggagtggagtggtgcgatagggctcattgcagctttgacctctcagggctcaagccatcctcccacctcagtctcctgagtagctgggactactacagtagcaccacacccggctaattttttgtattattcattgaaactggagtctcactttgttgcccaggctggtcttaaacccctgagctcaagtgatcctcctgctctggcctcccaaagtgctgagattacaggtgtgagccaccacagatctgtaccctctgcctggcccttatttctgatttttttttctttccttttttaatccttctttgtcttctgtctgagtccaaggttggctggcgaaagtcctcagatctgatctgaagttaaattcaattgagaagcagaggggtggtggtggaatggaaaaattccatatgaatagttcctcaaacctgctctttgctaggcctcaagggctccagtgactgccctcctgccagcctaggtgactttctaagtgtgaaaagtgggaagaggactctccactcacctgttagtccagttcactaggaactaagattctttttttttgttgtttgttttgtttgtttgtttgttttttgagaagtctcactctgtgagacattgtgctgtggcacaatctcggctcactgcaacctccgcctcccgggttcaagcaattctcctgcctcagactccggactagctggggactacaggcgggctccactatgcccagctaatttttgtgtttttattagagatggggtttcaccatgttggtccagctggtcttgaactcctgaccttctgatttgcctgcctcagtctcccaaagtgctgggattacaggcatgagccacggcgcctggccctgaatttcatttctctttcctctcagtgaaaattgataccaaggccattccactgtttgggaactccctgaagcctgacagtctccggttccagctggagacgtcactgaagcggctgcagtgtccccgagtggacctcttctacctgcatatgccagaccacagcaccccggtggaagagacactgcgtgcctgccaccagctgcaccaggaggtgaggggacccctgagctctgggaggtggtccactgctgctctccttatcctgatcctaatggtgagagcagaggcaccagggctgttccagggtggagcagggaacagcccaactcccaggggccccaccctggcctccctttcctggtctgggctgcactatgttctgactggagcctcacctgagcagggcaagttcgtggagcttggcctctccaactatgcagcctgggaagtggccgagatctgtaccctctgcaagagcaacggctggatcctgcccactgtgtaccaggtgagagccagggctgcagaggccaaggtctccagaactcctgctcatcctgggctgtctttgcccctctgactgccccctgtgccctctgcatagcagccactcccctgctgaaagcctgcagatggctcccaggtaccctcaggatgccattcaagctcctcaggctggccactgggcatctgcttccttcctgcctatctgtgcaccttggacccttccttccctaccttcccctgcactcagcctggaacaagcccttcccccaccaccgccccttccgtgagagaatggttcaggtctcacatacgtgtctcttcctctggaagcctttctagatgggcccagaagaccctgagacctcaggtccttgtttacctcctcatgattcattgcacaaatatttgcacacctgcttggtgccaggcactggtcacagaactttctagtctattatgattgcctcatgacttgattataactgtttatacttgaccttattataaaaccttgagggaagggaccctgtccttttggcttaagaatctaaatctgacaaccagcccatagttggtgctcatgaaagttggcagaatgaatgaattttccatgggcataagcttctttcaccagcaccagttagaataagtatacgcccagacggttaaagtcctagaattgttaaggtctgaaataagggttctggaagggtaattttgaagtctcttcttttgacacatccaccctctcccccggggcccctctccttacagggcatgtacaatgccatcacccggcaggtggaaacggagctcttcccctgcctcaggcactttggactgaggttctatgccttcaaccctctggctggtacgtggagcattcctggccctgtctcagcctattcccgacccacagatgcccagcccaggacctgggaagcaaggagggtttgacaaactttgacctctgaggtcaaagacgtaaaggctgcatcttcagccctcctgggtccctgcccctcccctagaccagagccctgagggatgtggcagcttctggggcactctaggccccggggctgattgctgctttccctcagggggcctgctgaccggcaagtacaagtatgaggacaagaatgggaaacagcccgtgggccgcttctttgggaatacctgggcagagatgtacaggaatcggtaagctgtgggtgcttggtgtggatggctggggtggggtcagctttatgtggaatgaagtcctgggctgctcctggggtaaggcctttcctcgctgctgcacctactcccctgaatttcttcgggaatttccaaaccctccatcggttttcttgttgtcttgggacctccaggaggaaaggagactccctggacctcggggtcttgaagtcgttgctctttcctgagcaatcacctgctaggaaggaaagaaggagctctggagggaggtccaggaggcctggggctgagtcctgacccatcttagcggcctttgtgtccctaaggaaaataagagcaggctgatgagtcctcaggaataaagatttgttgaggtctctgctgaggggcccagcatcctgagtggttctcttgcccagcaaagtgggagacccatggctagagagaacacctgcccctcagggctgcagggtgtggggtgggacagtggccctggttggctctttggttgtggctcccaatgtggccctgacacctgtgccaccgtccccccttcccagctactggaaggagcaccactttgagggcattgccctggtggagaaggccctgcaggccgcgtatggcgccagcgcccccagcatgacctcggccaccctccggtggatgtaccaccactcacagctgcaggtaaccagtgaccctgtgcgctcagcttcttcccttccaggggaaccagcaatatctttagatgaaggctgaaacatttgtttatcgattcctctgaaatttctctttctttcaactctcacaaacattcttcccactggtctttttctatgttttttttttggggggacagagtctcactctgtcacccaggctggagtgcagtggcatgatctcgggtcactgcaacttctgcctcttgggccgaagcaactctcttgtctcagcctccccagtagctgggattacaggcgtgcgccaccatgcccagctaattgtttgtatttgtagtagagacagggtttcaccatgttgcccaggctggtctcaaattcctgaactcagacaattcgccctcctcagcctctgaaagtgctgggattataggcgtgagcccctgcgctcggccttctcattggtctttgatggtatctgagtgccaggctttgtaatgagagcttcattgcagggatttcattattccttcagctttatgaaatgactatcccagtgttattgacgaggaaactgagtttcacccagctatgaaaggggcagacattttaacacaggtttaactgtaaagcccactagtctcatccttttggtgggagctggagtttccctctctcagtgcctcatgtcttcctcacttatatccaactccagccttagatgttgcaatagtgtctggcatatatacagtaggtgctcaataaatgggagctaagtgctctacataatttttcacacccataaccatgttgaaaatagaaaagaggattgaatctcagagaggtttaataacttagccgcgtttacacagctgctggggggcagaactgggctgtgaatgtaggtctgtctggaagcgtcgtgtggcagtaggggaagggatacaggttttgcgtcacatgggtacagctatccaaggcaccttaagttctttctggacatatgggatacaagagatcccaaatctcagcagggaggtggctgggacggctgtgagtagagtcgctgtgcagcagaagagggttgaagtctggccgtctcccttgcagggtgcccacggggacgcggtcatcctgggcatgtccagcctggagcagctggagcagaacttggcagcggcagaggaagggcccctggagccggctgtcgtggacgcctttaatcaagcctggcatttggttactcacgaatgtcccaactacttccgctaggcccatcgtttctcaggctgcccaaggctcttctgtaacatcttttgttactcacattttctttaatttagaactgcctcagtaaattcttagggatggaagtatttggacaaaaacctaatagaagagtcaccaccaaatgaagaataaaactcccagggtgctgtg

SEQ ID NO: 36868 - DNA, 397162 bp, Homo sapiens
ctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggtaagtacttcaaccttggggatgtgtttgtgtatttttgttaagctatgcatgagcttttcctagggtttctggctgaattctatgggaagtgtcccacttgatactaccacgtacgtggaaatgagcgccaggatgaatccacgagtttggacgctgggtttccaggcacagcaactcttgtagcagaggacagtttctgccggaatcttgagacaacccagcacttgattcacatgccgggtttccagaaatgttgctcttccagaactctggtgttttacaggctctgagtcagtcctgttggtgtttcttgagatataattccaaggaattttgtgattgtttgcatctggctatatatatatatacatatgtgtatatatatatatatatatatatatatacatatgtgtatatatatatatatatatatatatatatatatatatatatattttcttttttacaaatcctagaggaagtctgctttgacctgtatttacttttcagagtcaccaaaatcgaggtaaaaaggggcagaagagtaaacctgcctacttctcagaactagccctggagggacacatgtttgtatatttcagtgttaaaatcagaaaccagttgcttggggcaaggggactctagactttctcctattgctgtcggccgtgcccccctatcactctaccttaggacaggagctggttcagctttcaagtcagctctagtttttgcatatttgagatcttgtgcctgagagagggagactcagcctcctaggcagccagcaactctgggagcagagagaacaggactttcagaactttttaaatgcaaaactccagactcgcctcctgcaatttaaatattttatgtcagttgactttttctctgtgctagctcagctggcaggtcttgctgctggattgtccatctgcctgtaagttggggctttgtgtggaagtgttcggaaaaggagtttgttataggtgcaccaaagtcactttaggaagtggaaattgctaggaatttagtcttctctgcagagtataaataccacaagatttatgccaaagagcttttagggaatagctctggtggaattttagattgaagattgacttttaactctaggaagggactccattaagtttgtgctatgggataaaacacagttggcttgaattgtcaacagagccatagagaattcatgacgtttcgtgtatttaatacagctaacaagatgtgacctgctttctgattggctaactgctggacaaggacttatatgtattttaaaagctgggttgtctttaatgactgctgttttctttatatgttaatacaccatagacgctaaatatgactgctggtactcttgctctttctagaagccagtagcttctatagaagtgcaaactatgttttgcttaggatagtgaactgttggcagtgactgatatttgtgcttgctgttttgtgtatgttgctttgtgtgtgtaacagtttgtatatttccttcagatctttgcaactgtgtgttggaatcttaaatctctgcataaaccattggttgacacaggctgctttcataattaggaggatagaaaatgtcttatagttcaggcacacattaattgcaatacaaatttggaaaaaatagtcttttaaaagtatgattagttataaaaaaagaggccagggaccattatggctcaattcttgaacagcaacaatatttaaaaatgacctgtccaccttacattttagaaagtttttgaggaattgcagagattcttctccatcctcctgcagttaggaacacaggcagctttctctgatatctgcctgccctcctgcccattactgagcacttggccaggtctgagctaggagacttatctgcaagatttccctactcttgccctcattaaaaaaaactgcaggattcaatatggtcccaggtttgtttcccatttgagacaagacatttgaaaagacctcctttcgcagtatgctttgcaaagatggtacattattttttgtgagagctaaactcaggaattcctaacttttggattatggggtattacttttaaagatttagctctgagtagaaaaagactacttcatagctcaagaaccaagagaagaaagcttgctatgacaaatcttaaagatttttttaaacctccctgcctgtaacagtaaagtgctatgaactgttttctggtgtgtcctagagctaaccgtttacatttttccctccttaattagataatttttcaaataattattcaaataattgcctcaatacttctttttttctttgctaagcagtaaatactgtcatgaacgcaatgccatacatttgtttttatttcatatgaaaaggggagagaatcaaataattgctcctaagatatttaaatatttacatcaaatattaaattttgatcatgatgtatgtaccttgaaaaaaacaattttcatgtaaagttacactatacctttaccaataattgttatttatgataaagctgctctgagttctggagagggattggttgggataaaatacaatgatactcagcaagagttattagtttattcacatgcaaaatcaaatatgcctttgagtgactactttgagaatttagccaaagcatacaaccattttgggcaagactgactcacccatccctcttccatctctctcttcctctctctcttctggtcccactcctatagtatatagtattatttcattaagtcctaatatctctctcacacacacacacacacaaacacaccccactgggtaatactctcaagtcttcacccctttttgaacatggacctggctagaaaaacaatatatagcaaatcagtatgtgatgaagaaattgtaatcaagtttctggaaatttcctagaaacctccttttttatatggaaagaaattagtaaagaaccatgatgtttacctactctccttccatggctgatcccagggcattttctcatggggatccatgcatttcttccaattaaattaaatcaaagttcttcagaagccgggaagtttgagtttaaagaggatggcattgggagttaatattatttctaactcttacaaactagttagcatgggtcttggttcctcatttgcaaattaccaacagtgtccctttaattgaaaattcagattttctttttttttttttttttagcatgaaaaagtattatgaagtaaagagtgcagacattatttctttgctcatggtatttagttcaaaatcacaaaatcacaaagagttcttcatgttggcactacgctaattaaaaaaaataccataaacaccagaaaagtgtgagttccgttatgtatttttcctgttttgaggtttttttttcttttatcaatattacacatccaataataaaataattgggtaatggtgaagaaaacttgaaggtccagtttggttttaaagctagcacttaaagcaagtagttcctggaccaagtaggtactcattaaacatttgctgactagccaatcagtgaatcagtagacaaaaggagagaatttgaaaaccaatgcatttaaattagcaccttccctgagaaatacaattctgaagttttttggggcctggtatctcctattgagctgaagcagctttgcgcctctgcttctcactctccctaaagtgttcatctcacatcccccacatttattttatgtgaggtcatttagatccataatctttgtggcagaggaaagcaagtgactaagtactaacaggacctcacctctctgtaaaggaataggcatgcattaaaaagcaaacagcaacaacaacaaaagtatattttaaatgctgctagctgttctgggaaataaatttttttttcaacattagaatctcagtggaatttaataaagaaatgtgtgggtgctcttcccaccctttaaaatgaaattaagaaaaattctgaggttagcatcactgttgttcactgtaattcccaggcagcagaaaggagtttacattttctgttgtgtatgctgtcaaaaattgacccaatgtcttccaaaattcatgtatttgaatggtttggcagtgccaaatgtattttggaagaatacaaccgcacaattatatagttttaacactgtacacacaatacagtcagataggatataaaaatatgttctgaagacttcagaatttgttctgtgaaaagcttcaataaaagcaaaaacaatgtattttttcatttttaggtctcagccctgagatgaaaatataggtaaaatatatgagaaacattacagtggacatcattgtaagtgaagggatttaactaatgttcgattattataaaatttaagaaagtttatcaagtaaagttcacaaatctttgttagaggagataacttttctataccttgttttctcattcaaatgaccaaaaatgtctgcatttaagtgaagatatttttaagtatacatagttcttcatgttggcaccatgctaatttaaaaaaaaaaataccataaacaccagaaaagtgtgagttccgttatgtatttttcctgttttgaggtttttttcttttatcaatattacacatcctcttccaaaagagaaaactgtgattacaatcggaagctgtacgcacaaggattttatagaattacagtttttagtttcacaggatttaatatgaaggttacaaatgttcgaagacctagaaatttaaatctgctggttttcaccccttctcagctcaactctaaaactccctggggagggggtggggaggagggggattcttagtcctcttttctttcagctacatttttatatactttagtcacagggtttcacgttgtaacatcatgtttattcatggaatagcttggtatcattgatgttcagatggaatctagttaaaatgagattagttattttggataggtggagaaaaagaaaaaatgctttgtggtaacttggaggtttctcccccctagaaatttagaaagaaaaatgttgctgctactctgagatatatgaatgattttcagtgttaaaaacagaactttgcaagttgtttgaagagggttggtgaggtgggggagggggctgggtggtggaaaggaaagctattttgaaaatgttaaatgaaaccaaaagtgcagttttaaaaatgagaacttccaaactctcttatttttcaggatctctacatggcctcagaaaaccaattgtaagactcttatactgattttattttcttgaagtcttttttttcccccattttcttactatgggaactgtttttaattaaaaattgctgcaaactaactattcataggaggccaagaagaaaaaagaaaaaaaaaagaactttcaactcacattcaacacagattcttatcagcctaaaatcaatgcacatttaaatttctctctttttggtgtgtaaattatgatgtaggatttaaacgctatgcattttttaaacatttagctttttgtttggggtccagaaagaaattaatttaaagtatatggagaacagggccataaatctctttttattacaattgtccacattaactcatttttcatgaggaacacagagcacccgctttctgaacaagcaaacgaaacgtaaaacaaccccaaacatccaactttataaatgatcaagaacaaaattcataaacttacttatttggatttggttggtgggcctcaaaatataactgacctgggaaaacaatgtctttttgaagtgtcagaacatagcatttaaaaaaatgtccaaaggatgtagatactacaaataccttcgtcattttctgacaaggcgttttccttctttttaaatttttaaaaatcaatatgagcctagattttttttaaaatttaaattctggcagcatgcatttgaacctaggcaactattaatgcttaaaacaaaattcaggcattccttcaagaatttccatacttcaggcaatgacagtctcagggcctggaaatataaacatgattaagatactttctgtcttctagaagcttacaatttgataaagaggggagacatacaaaccacacttacaatagagagccatgataggttaatacacggtgtatcgtgggcatattcctgtagtgaaaggtatatacacctttctgaaaggcagtcatagaatagcatatatggagttttcagtgtctgttgggcaagtatgaatactaggtgctttttgtatgtcggctcaagtaaccctcatgatcacatcgtatgatactaatatctactaacatctgcacttttactaatgaggaaactggaaactgacaggttacataaattgtccaaggtcaaatagacggtagtttagcttcagaggttgtaactactctgccatagcacctctcttgaaataggaaacatgagctaggaatctagttttacctatagaaatttttaatgtgaatatattcatttttgttttctaagacaaattgactttggaggtggcttggaaattgatcccattcactaacttgattctgctagatgtgtctcaactgcctaacttaattttcaaagggaccaagtgaaattccaagggatggatccagggatggaaaatataccctgggtactgaacaaaaaaacccaaattacactccttattaaagaatacttaagttcgggcacggtggctcaagcctgtaatcccagcactttgggaagctggggtgggcagatcatgaggtcagaagttcaagaccagcctgatcaacatggtgaaaccctgcctctactaaaaatacaaaaattaaccaggcatggtggcacacgcctgtagtctcagctacacgggaggctgaggcaggagaattgtttgaacctgggagacggaggctgcagtgagccgagattgtcccactgcactccaccctgggcgacagagtgagactccatctcaaaaaaaaaaaaaaaaaaaaaaaaaagaatacttaagattcccactttatctgaagagtgattgaaactgttatagaatataatgcatagtcatctaaaaggttttttttttttttacttaaaaatatttaaatttccattcagtgcttcttcttagttgtgccctgggaaagatagtgtttttattgttttaaacagtagtgaatgagtataaaagctatctcattttttggtggaaacaataaccaaaataaatgttaggaaattaaattacaattcaaattgggtatagtattggctcccttttcaggtaatcaattaggaatcttagggaaaataaagacataaaggggaaagaacttccaacaggtttggcttctcaggatcttagtttaatctactcctgagaggaagtcagtctccccacatcctgtctgtctgcagaagttctttgtgggaggtgatatttccttcctacccttgcagaccactttagctacctgcaaagccattgtcatgagagtaaatgcctgccagttgttgaagataagatagatctcctcatttgatccacccccaaagcctgagatgcacgcattctggttctcctttaccagacaagcaaccgaggcctcagttcatgcatggccatcctgagatttgagagcccaggggctggatcatctgacttttcactgtatggtctgtcctggagcatattggtaaagggatgttgcctcccagctgcccacttcctcttggatgccctggtagccacacccttctctcacattagtaccacgttggaccagcctaatttgaagttttagtcttccagttcaaaataggaggcttagcgttaaggatttggcagacctctctgaagaagaggaatctgtcctgttctggtgacattgcgagcccccagcctctctttttggaatcaggacggcctcttaacagcactccgtgccccccctttccatcttataatctgatccccacaaacagccaaggtgatatttttaaagcataaatcagatcctgtgactctcctgcttcctctcaaacctagaacaagctctaaactccttgctctggttttaagaatctattgatctcttccttcctgatggtccattcttatctgctaccaagtgttcactggactggagccacggagggcttctttgggatccattagcttgccaagctgattcacactgcaggacctttgccctcggtcagggaacaccgaatatatggctttctttgtaataactcagctaagtattaggagacctcagttgagttgggatttggcatagtgctggctttatttgcaggtaatcaattagaaaaagaaaagaaggacaataaaggaaaagagtcccagcaattaggaggtcctgtactgagcaacttaaatgttctcttcctagagagcccttcctcaaacaattaaaattaacccccaatcactttctatcacatgccttcttcataggaattattggaagcctgtattttcttgcttcttgtttatttcttaagtatttgcttgtccttgatagaatataagccccatgagggcagggacctgattgtcttacacatcattgcatccccagtgccctatatagcacatggctgatgtgcaaaatattacctattgaataaagaaaattaagttgttccagcactggccatcctgacgctaaaattttccccaagtcttaccaacaattgcctacagttccagtaggagaagaatctgtgagcctaatagcccagtgagcattcactgctagaacgcacgtcaagcccaaaggaaaaagaagccctgagagaacaaaatttcttctatgaagggagtgttgacctgactattttgccctctggatagtgcaaatctgttgggaatctcctgacttctgattaaaaatatttatacttatcctagtgtttcttttctcatttgatatttctgctacttctgtctctctatatctacctgggagcccacagccgtgaattacggtatgaatcatgataatatgttacatttcctggagcactttgcattttaggtaagtgctttcggggccattaatcagcttatttgaagtgatttgcacaacagaaaatatgggaagttctatcagtatatgatgctgtggtctgtaataactttgtgtttgctaactggtgtatgtatgtgtgtgtgtgtgtgtgtgtttatgtgtgtgagagagagagagagagagacatttgtcctaatcagattgtgtttgtgtatgtgtgcagcttttggttagggaatatgaacattttttttcaccaatagttttttcttctggaatgaaaacagtgaccagccttgaacataaaggcttcaacctcagtatgacttatagtaagacagatttgggtccaaactctgagtttgtcttctacttgctgtgtaatattaaggaagtttcttaaattttctgagcctcaatttccttagcctgaaagttacattgcaaagtaaagaataaatgcatgtataatgcctggtatatgataggtgccacatcattgggaactatgatgatgatgacgacgatgacgacgatacacttattctggattctatcagcaaattaaataatgtaagtaatgccaaacattgcttcatttcttaaaagtatctttaaaaatactttttacatgcctgcactagcatatttcaatttaataaacaaaacttgcaataacatgatctaggactcttgagtttggttgttctcgtgtgataatgccaaaggggcttttcactgttatatggcagggatgacataataatcatataccttgttatgtgagaggaatggcagagtagtcacaatctcctgcaaattcaaggctagaattatttcttaggcatacctatggttaagtagtaagggttgaccaatgtatgagaccatgtgtactccgttttgttgggaaaaagctgtgattggtgttttctccatttaagaactcagtggagacaacaaaacattaaaaggttccctttcaccagtgtctttgcagggctgtctgaatgggggccccaggagagggctggagagcacacacccactggccttgactggccatttcttctaaggacgcatgcttctcaatatgcagcccagcacagacttctccaagggagctgggtcagcactggtcagaagcctgaagcaccacctgcgtgtctggactgataacagcccttccaattgattcactgtgacaccttgtggcttaatgcacacactggtggaagtagtgaagtgctgaagagtaccatacggtatctttctggccacagggatcaggtggatgggtagtaacgctacctgtctcttttttttttacagatgcaagtgggcactacactatgctgatttgaagaattcctattgaagaattcaataggaattcttcggattacatacattgtcctatacttcatttctctgaccagggcacctatgatttttatagtcttatattaataataatttttatcaacttttataaagtaagatcttgtgtagctcaaacgttaaattatttgtagccctttttttttcttttccttttggtaggagttagggtgtgttaaacttctcttcccaacgtaggtcatttcttaggactcgtgaagatttgatctcaatattgaaaatctgtgtagagaagcaaaagctaaaccaatacataaaactgaccaattggaaatacacacaaaaaaacaaccttttttagaccttacaagtttaacatgattaccatgtagttggctgaaatttattacttgaaattaaacttaaacagtcagtgcatattacctgccctttgaaaggttctaatttgatggaacctactagtcccaaattagatgaatcctagaatttcagggctggaatggttatgagatcatctagcccaagctcctgattatggaagtgcagaagtcaaacccaagcggggctaacttggactaagcagtgctgtcaattcataagccatctcaggtttctttttattctttttcttttttttttttttcaagtcttagcactctcctgtcactatgtaattaccaggaactggctaaatccaaacacacttaccaagcattaatctgcacctcaacactacaaaaacttttgtattccaagcccatatctcctttttcagttttccaattgtcttaaaacagtgttgattttttttttttttttttttttttttttgagacggagtttcgctctgtcgcccaggctggagtgcagtggcgcgatctcagctcactgcaagctctgcctcctgggttcacgccattctcctgcctcagcctcacgagtagctgggactacaggtgcccgccaccacacccggcttatttttttgtatttttagtagagacgggatttcaccgtgttagccaggatggtcttgatctcctgaccttgtgatctgcctgcctcggcctcccaaagtgctgggattacaggtgtgagccaccgtgcccagccaaaacagtgttgatctttagtgtcatgctattgatgttgaaaaacacatcactaaccttcattgcttttgaatttatgatttcctttgccagtttatttagaataaagctgcatgtgctttaaaatacatgtctccttttttggttttaaaaacagtacattattaatgtagagtatttgtgaaatacaaaaatgttcaaggaggtaaagaaaatcgtctttaattttactgtgcaacaaaattgctgtgaacatgttagtatataaatttaatgcacacatacatatacataaatctttacttgcttacaagcatattgagcatccttttgaatccagctcttttaagtaaaattatgagtattttaccgtgtccttaaatcttcttaaaatataattttgagttgcctgaattattcttacatctgtttatgtttcaaaaattaacaacatatagatattttaaaaattatttggctccattgtaccatgatttgagatcagcttttgtttgttggtttgttttgtttttgagacaaggtcttgctctgttgcccaggctggagtgcggtggctccatcagaactcactgcagacttgacctcctgagctcaagtgatccttgagcctcagcctcctgagtatctgggactacaggcacatgacactgcactagactaatttaaaaaaaaaaaattgtagagatagaatttctctttgttacccaggctggtctcaaactcctggctcatggtgatcctcttgcttcggcctcccaaagtgctgggattacaagtttaggccagagttaagtattcttaacaatcaattttatctcccattgcggtagaagattactggtatgaaggagttaactatgatgactattataatgaccgttagcatttagtactagtcagaagtcttgaatccagacctctctctcactccctatccccaacttgagggtggatccttttttatttctgcttttctttctcttgtattatttctgagtcaaaaggcagcgagcacgtaatctttcacaaggtccataaatcaaaatattttagcacaattcatactgggaagaggaagcttgaattaatgttaagggttagtgttgatctagaaccagagagttgggatatagcaagttaatttatgacacctctgaaggacacgtctttaattcaaaaagaaaagggatacctcaaaaagtgggttgtgtcatgacttgtatgtaatgttatcctgttttccttactggatcaaagaggtctttgggattgggcactatcttgctcatatttgtatcagtcataacaactgatattctctgtgaccaatatcaatcttcttctaaaggcacatttcactgaagcagccattttgttatcactttctttttttatttttttgagacagcgtcttgctccccaggctggagtgcagtggtgtgatcacaggctcactgcagcctcgacctccaagactcgaatttctcacaccttagcttcctgtgtagctgggaccacaggcatgcaccacgacatttgactaattaaaaaagtttttttttttttttttttttttagaagtggtatctccctatgttgcccaggctggtctcaaactcctgagcttgagtgatcctcccgcctcagatcactgtttttacatgagtaatatgctttttaaaaataagcctcatacacgtatgcttctagtacaacataggttgtacaataagattatgtcctctcccatagcattggcattaagcgcttaacttctggagtcatgcaaatttttttctttacttagtggctgtgtgaccttggataatttatccatctgtacctgggatgcccctatgggtaatgtagggaataacagaatctatgtgtttgggttctcataagatagagtgagttaattcttgtaaagtgcttagcataatgcctgcaccctataagggttaacaattattattgtggcttatttgtttaatggatattgaacatctactacacatgatattactagtctagagacgaagagggcagagtccttctcttaaaagagcttactgaggacacagtaaggatttacagggaaggaaggtcttgatggataaatgggaatttgccaattagagaagggtggtggaaagggtgtttaaggtagcaagaacgcaaatgcaaataaagtgatattatattttaggaagggtgaagattttgacactgctgaggcttaaggtctggggtgtatgtgttagtgtgtatatgattgtgtgtgtaggcctggagaagaagtaggggccgaattgtggaggtatttaaataccaagccagggttctttaccttttagagactatactttggacgatagcatgattatttaacttctccgtgccttggttttctcatctgcaaaatgagacaacagtagtccccgcctcacagagttgttttagggaatttaatgaggtaaggcatgaaagccctcagaccaacacctggtacatagtacggattcagtcagtattagcgtctactattgggccgagggagctaataaagtgttttgttttattttgttttgtgttggctggggagtgaagcaatctgctatgcctttgagcaagaacactctgatccctttgtggagggtggactggtggtctgtcttggagcacatctgtctgctgagaggaagaaatcagtggatagggagatgcacaaaggaaaaattacacacacttactggctgactgagctatttttagcctagtgtgtctgaagcaaaggatggattttcatggtatttttttttttaaagatgcaaagttcccgtaagccaaggtgatgtaacttgccttgtgacattttatttgcccatccttgaggtctacaatgtgggccatgaatcgtttagcggcctggggcctctagtcttgagttttcttcctgccttgatacaattgggacctgtgtgggaaaccagaagagatgtgctggccgtcagcctggcaggaggaccccacggtgatgtggcagggaggcaagggagaaggctgcatggggaagagaaaaaggcaagaagcggtgaaacctgacctcacccagcacatgggacatgagtctctgacactcagtttccacactgatagaatgggaaaaatcatctgtcaacatcagaggaacgtcccaagccctaagtgggcgggtatctggtgtggctcttccctctactgcatggtagttcatgccccattgcaggcccatatgctttgtgcattgaatgtgtgtttttcttgaatctttctcgtaccttcttccctctgtaaacttaagcctcggagaaatattttctttccctgagtctgtttcctctttcgactttcttggattagatgagctatgaacaccaaggttctctcttcagccgcagtctacgatcccagttagatggactgctgatttctgtttttaacctgtcacatccaacacaaagtcaaggtaaataacgtatttttggccctcttctgagcctccttcagctctttttctcccaccttctttggtgagggatcttgctggtcacagtgtcttgcctttcggcacaaactggctggagaggaccatgttttgcctcaaaatgctctgggaaccattgtcttaaaacccgcacataaaggaaggctcgatggttgttttttttccgtcctcataaaataagctcgaaatgcaaatgcagaatctactaaaatttatgagttcagtgggtgccctgcatcaccagttttttttagaaaggttaaaattcatctgaactaagactagaaaataagcttcaggtgttaggttattctgaaaagactgttaatgcctgttggctaagtgcattaaactgcatggaaatgatcacttgtgtgtactattttaaaaactgcttgctgggatggtgatttaaacctatttttttctggactcaaaacttcacatttgtctgttgaaaaaaaaatactgtatttgaaacaaataaacattaaaatatagtttattatatttccaggtgtttgtctgaaaggatacgtcaagacatttttcgttagaagctgaaatctcagccttaattcactccattgtatttccaaggagcttaaccctatataatattacctggtctctggagacctccttgaagggataccagatacccttaggataactaaagaatgggggaggtggggagagaatggagggggaatggtttccagtcctaattctatatttcctgtgacttttttttatggaggcaggggaaaaggagagaagaaagaactctgctgaaaaggagagaagaaagaactctgctgttagctttattacagctttgattttaaaaccatttaagaagtagcattcatggtggcaccctgtgttgtctaggatggaattgcattgactcattcattccttaataccttattgagcttttttttattatgtgctcagtgagggaggaccatatataaaccctgccctcaggatgctcacagcctagtggggaaggtagccagctgaacctccagttataactgagggtgccaagagtgagctgttgagagcagcgaggacagaggttttcccagccaggattgcggtactgagacatgcacacacgtgcatacacatgcacagacatgtacactcacaccctaaattgcttgtgctatgtgggaaattttgacccacatattcctatgtttaattgaaggcactgttaacttcttaacaatgctacatctctgatgattttaggaggaattagactgcgtaaacatctcaaaacagggaggtgaagctaggaagcataaatgccccagtgatggctgcaactaggtctcttaacttattgtaatctaaaccttgggtgagggagaaagaaaaaaagagcagctttttaaagtccactgaagacttcagatgtggcaaaaataatcattttttttctggccatgagaaattgtctgagtagagggtggaaaatttcatccttatcaggaagttaatcatagtaatttatgtggaacttccaggtggttacttagtcaatcttaaaaaaaaaaaaaaaaaggcccaaattcccctccccgaatgacagtatcgagagaactttaggaagaaagcaaatcattcaaagccttgaatggttagaaatccataaagatgaaggcaggagcctggatgaaaaaagaaagaaaatctcaaaaatccaggagcaggagccatgctaatcagggtgaatatctgctgagtacttaccaatcgctagtcccacagctaagtgctttacatcatggcctcaattaagccacacactactgtgatacgtagtggtatccactccatttttcagataagataagtgaggccgagagaggcttagtaattagcccagggcttcagaggtagcaagagctatctctgtgacttaagcctgggtgttcccaagttcagagctgaacttcacttgtcagctccgctgcctctccagacagcgcccactttacagatgaagacactgaggcccaggtaggttacagaaggtcttgagtctcactgtgagacgcattcaaagccttctcattggctgatgacttcgattttggttcctcagtgatccccacattcaactgtgggaccagtatctgtttactgagaatccactgtgagggtcacaccactgtgagagtcatagcaccaaggatttcttgaggttgggaacctcacctggctcctctttgtgtgtgtgctttttttttttttttttttgagatggagtcttgctgtctcacccacgctggagtgcagtggtgtgatcttgactcactgcaagctccgcctcccgggttcacactattctcctgcctcagcctcccaagtagctgggactacaggcacccgccaccacactcggctaattttttgtatttttagtagagacggatttcactgtgttagccaggatggtctcgatctcctgacctcgtgatccgacgcctggcttatctttgtatcagcagcagaggacacagggccaagggcagaaatgataatctaaatagtgcttgaatgaatgagggatatgaaagaagtagtaggctccgaggtttacacagagtaggagaggcaactaactataagcaccatgcagacaagcgctgttcctctcttttcaggcacagaaggctatgggacatgtctatgcaaactagaaaaacgtgctccttctgagtgagcctatggcccttttgtgaaaatgaaaagcttcctggtcttcctggcagacattagctccatggggcttagcaaagtgctctggatttcagccgttccttctccccttggtcagctgcctttttgcagtgtggaaactgcccaacaggaaatggaggcctgttttgatttaatttagtcacccagaacctgaattctaattgatcttcactaaatcttgactggacccatgaagaatttttaagatggtgctaaattctcttctgtcattaagatacagtgcataaagaagaatgtttaggccatgtgtcatggaggaggctgggatcggtttgataagggattgtaggatttggatttgttgggaaagaagaagggcatctggtttggggaaataaaggtctgagatgccatcaagcaaacacgtctggcataggaataggatgtggttggctgacttctgcacaggaaagtttctgcaggtgtaaagagagttggacaccaagaggagacatcattgtctctgtgttccgtgcttgggtaccatgtccatagaatgcagtgtgaatgaggcttcatggagatgttaaattggcttcctgtttctagggtagacacccttacttctctactccctctgtgttagttagaattctccagaaaagcagatatagggtatatatccaggaagagattcattgtaagctctagactcacattgttatggaagctgagaagtcccatgatctgctgtttgcaagctggagacccaagaaagctggtggtatagtttaaagtcctgagggccagagagctgatgatataaattccagttcaagtctgaagctctgaaactagaagcactgaaagtaggaaaagatcaatattccagctcttaaacagccaggcagagttaagccaactttcctctgccattttgttctattcaagccttctatagattgaatggtgcccacccccactggggagggctgtgtgctttacccagacaacaattctaacagcgagttctaccctaatctcagagtaaacaccttcacagacatacccagagataatgcttaaccaggtatctgggcatcctttggctcagtcaagttgacacataaaattaaccatcacatcctctcctgccaaaatgctgccttctcagatataatagaggctggtgtcagaggtctttgaatgtttgtctgaggactttggatctgactttattgcaatagggaatattatatgttcttcagcagatccattaacatcttattcattccctcatttggtacatctatatcaagcagagccaggtgtttagcatacaataccgcataaaaacagacattggcatttcttgcaggaaatttacaatcaagtaagggggctgtacagcaattaaaaactcatactaactaaagtatagttgtaatggataaaatgtgcagtatttatcacaatgtaatcagtgcactagaggaatcaagcatgtttctgtgaaagcgtaaaataaataaggaaagctgacctatattggtggcaatagtggttagggaaggctcctttgaggaagtgaatttttagctgagacttaaagaacaaatgagatttagctagaaaaattggacatgcgatgccaagatggcattttaaaagaataatagtaagcacaaaggccctgtagcaggagggagctgattgtccatagttcagacagcaaagaagctgatgatgcaggttggggtcagaccgtgtttgactacagataggatgttaagggttttggctttttaggtttttgttttaattctaaaagtaatggaaaatgtactccttttggtggtggtctgagagaaggtacatcattagaatgacattttgaaaacaacactcaggctgctcagtagagaatggcttcaaaggatttaaaagcagaagcagaaggacatattagagaaggattgtatagttttctggtaaaagatgacagtgaattgtatgggcgatggattagccgtggaaggtgttgagtataagtggtctccagccaaactctatggttactggaataagagagtaggaacccttctcaggctttatctttatctattcttgtcaacagtatgtacatgtgtcccccagccccaaataactgtacagtttaatgatgttcactctatacagttcccagaatccattggaaattgctgtaacagcatatcctcaatgcccatcaattctccacgtccaacttctccatggcctcctctgcctctgctgatctgtgaacttcccaagccccttcccctacctgcttttgattggctttaacttttacaatatcttcattactccaagtttgttcaacatcctttttatttttttaaatcatagattgatttagtttattctctttgccatttttgaatctcattatttctgtttctccttggttattagtggctctgttttccttcaattgcctcttgtctttgagaagctcttgtgattcttttagggccatttgccatttgattggtttgtcttccttttccctataagctttaaatatggcattatagttttatcccctttcctcttctttaggtacaactgcagacactttgctcttccaaggttactaagcagtgtctgacacaatgtagaagctcaacaaatattggttaaatttatttcttctattgattgttcaggctttgatgacatcacttaaaatgtttcttgtacacaccctgttttctactgatatatgtatgtgtatggctacctgaatccaggtttcttctaggaatatacagaaagtaattgatttctctgtggatctctaacagtgacaagaattttcacctatgcctgtgagaataccttcaaaagtattgggtgctcatcataaacacacatcagtttaacaaactcttatggatgcattgactttcccagttagttgctagatgacttcggatgatttgcataatgggtctcagtttccatatctgttaaatggcaataatcagagaattttaaaaaatttaaggacacctggaaagcttgaaagatccctagaaagcatgtgtttattccacatagtgggaactatgctagattccaaagacacaaagacaactaagacaacttagaataagaaggaaaagagaatgattcgttgcaatgatccccttgaagctccagttgaaagtcagagtattgccctggattggaagtagtctccaaactgacatcattttctttttcgaaccatatctggcctgtctctcttgccagttgcatattaaaggtaacagatttgaaaatgtttggaataaaagctctagttaggtgtggtggcacacacctgccatcccagctactggagagtctgagactcgatgattgtttcagcccaagagttggaggttgtagtgagctatgatggcaccactgcactccagtctgtgtgacagagcgaagaccttgtctctaaggaaaaaaaaaaaaagcactatacaaattccacattgggaaattttcactgaatcaatggttaaaggtttatacaatggatggagtatttggttagtgaggagagatttttgaggatcgatggcaatacttatttctagaaatagccttgtttttgctgattactgttggtagggatcagtttaatgctttttcccctaatgtacctagagatttgtggtagaattagctatgcaaattgaatccttaaaaaaaaaaccctccacaaacctgtatgttatatttataaactttacattgtactaaagtcagcaaatgtcacagaattaaaatcagtaaatgcaaaagtgaaggtttctatagcaacagtaactcacccatattgcacataaaatgaaatgtacattaggatttacatttaatcgcctattagtggagaaaagtcctatgtataacaggtgcaatatgaatacattagggtgaccctagcaactctttatcttttaaactccaggctctagctgccgtaactcttttatatctaccaagttttgactcctttagggaaagtgaggtaggaaaattagaggcagcgttagagcagaggtgtgtacccctagatttaaatgcagtggaatattaccattgcataaattatcaatcaactcagtaggtgtttcagagaaagaaatagacccagaatagtaaatgtttatgaaattgttgcacgtagggtacttaagaagaatttctgtctagcatagtcggtttatccaaaccttgagcgcttctgaaacatgctaatgcaagatgattttgtgactttgagttggttgcggaatggcccaataggagggtggcaggattggagccagggacatgggacatggccccagcccatcactctgcacatatggcctcccttgttgaatttcagtttcttcctataatgcattcctacttcctataatgcattcctacttcctataatgcctgctatccagggttctaagaatcaaataggagtggaaggagaaggatagagggtattttgtggaagctaaagctctctatatggacaatgatgtcgctattgtgaatgtgactttcataaggcaaatatcatccccagcagttataccatgcctttggctggtggtccctggagacggcctatccttggccgtctgcttacataaaggaatgtctcttcgctctgcagcagctcttctggtggagggctctgagtcattgctgagaataaccgtcatgcctcctccagctcagtctacatcagataactctagatagagactcttctattggtcaaaactttcttttataaaattggaagaaatttttctagtgactagacagatgattcactctaaaatgcagttgatttttaaaaataattttaagtaaaattgatcataagttttctttttcttttttcttctccatgagctttaatgttctttagtattccttggcttcactctgaactctttgattcagttggtccggagtaggccacaggatctgctttttatccagtagcatggtaatctttaaaaatttatttttcaattgataaattaattttgtatagcttaagacatcaaatgaggttatctgattaccacccagatcagattttgccagccccagaaaccctaccctgatgataacccctttccttgtatagtcttaattgacttttttggtattaattctcttatgtttccccagacactatgtttccccagctgctattgattctcagactggcctgccttgctgtccagtgaatacttgttggctgtttttgattccctgattttctggtctatcagatgttctctagcttccttcctgcctagaccctgataacatacatgtctatggctgtagtggtttgttccactggcttgtattttgggatgtcaggtccccttttcttttcaaatataatttttgttttattgaaaaaattgaaagagctttttaaaaacataattggaccaatttttgtcaagtgccactcttgtgcatacataaacaaggctataaatgaaatacattggttaggtattactaagacttacactcagggtctaatggtttagaattgttcttcaactcatggttgtccacgattttccacgtagtataacctttgtgccaccaaggatgttggtgagatggcattcttcaaaataatacttttagaaaacagacatgatgcaggtctctgagcaggctttgcattaggtagagcttgcctaattttgaatttgattttcaggaatgtagcgaatcttgttggatgcgcactctccctgactcttaccctcaactatttgattgagaggagaaagagtgatctatctgtccctccttttcttccaaaccattcgcacccattctgcaaattatgatgcttctgctttgaatatttgtacatgtacaatgacaatgatggcttgacagagagggtaaatcatagtctaattgtaaaacatgcattgagacatcagattgatattggaaaaaatgtgcatcttagaattaatgaacttatagataaatatagacacgggatttttctgtacttcttgtcttgtaaccttctttctcactttaaaatatattctatttatttattaaatataatataaaactgaatcttaagatctgcctattttccagcctatgcattgccatgatgatcttatcatctaattttgttataaatgttttccacgagtttttggtttggagtttgtgtagggagttggagatatttttaaatgatgctatcattgttcgtaacagtcaaaaagcagaagtaaccccaaatgtctgttaagcgatgactggataaacaaaatgtgatatatcagtacaatagggaccataaaaggatgaaatttggatccattgctacagcgtggacgagcctcaaaaacattatgctaaatagaagaagcctttcacaaaacaccacatattgtagattacgtggatggaaacagtaattcctgcaattgacatgagagaccatgttgggatcatgaaaacctgctgaaacactgaaactggttgtggtgatgattgttatgacttgggcaatttactaaaaattaaaacacatgaattttgtgatttacacattatacgtcaataggatcatgaaaaaaaactttgccaccaatgctgttttctcaaatactaagttttaagactaaaaatatgcagaataatataaaatataaaaacaatattaagaaatgccaaaatactccttgttttagaaaactctttaggaattggaataatttggtttttctttgttgaattttttaaggaataaagtagaagaatagaaagcctaaggacaaagaacatttttttttttgtcataagatcaactggtgaatagagaccattaacaccgtcaaggttaaccccaggccgaatgccaggttctcttttccaggttctagctcaaccctgtcctgtgctccagcactttcagtgataggcagcccactccattttgaggcaatccatcttattgacttagggttctagttaaaagaaatgtaaaaaaattaaagtcaagtttgtctcttagtcactatcattcaccagcccttttctgaacttgtacaaaataagttcattctctcttctacaggagagacctccactatccaaatatgaggagcttatcatcccaaggctccaggtcttctcattgctaaatatagcaccctgggctaaatattcccagggtgctcagctgtttctcaaatgcagaggaaatgcccgatacaccattctccttcacagcatctttaccaccctgccacttggcctttttgaacccccattagatggtgagcattttccttatctgattgctttcccctgtcactgggctgtcaatgggactcttagaattggacttagaagcacgtgggctccccgacaatgatctggacagccttgctttgaatatagtggatcttttgcttttcttgctttgcttgcagagctcaaggaaacatattttctgatcttgtcatcttttgctaaaacatactgaaagttaattaatagtcatggctgtgaaatcttttctctggtttgtttctgccttatactgatttctaaactatttgcaaatattatttttgattgtaacagtatgaaagggattgagagtcctgcctacactgacttataataaaagatgccatgaatttacctgagaatctgagaaggtctattgctctcattctttaaaaactttttttttgttgttaagtatctgctttatgccagtcatccattctcagcacaagagaaaaagaagcagtgataacaacaaagattcttttaaccagaatagaacttacaattcagttgaaggaaccatacaataaacaagtaaacaaatatatatatgccatagcattaagtagtatttgaaaagttttattcaattctgaggagcagtaactcatgttatggatgaatgattgaagttcaggtattcatttgtggtgaagaaaaataaagataaaaaataaaaaataaagataaaagaataaaaataatatgaagaaaaatacagtcacaggatagagacatatgatggacactactttagataacgtggtcaaagaagatgtccctgagtagagacccatgcaaaatacagaaatgagagctctatggataaatgtttaacaattgggtctttaaaaaaaaagagcgtgtatatacatacatacgcttattataagttttactaatagaaagatatatagtttacagtttatggataataataaaatatacaatattttttattataaattctgtatagccaattaattctcccaaaatgctttcattgatttctgctgaactcttatagtcatagcccaaatgtaattttcattgatgaataagagtagttctgatgtgggctgggcgcggtagctcacacctgtaatcccagcactttgggaggccgaggtgggcggatcatctgcggtcaggaattcaagaccagcctagccaacatggcaaaaccccttctctactaaaaaatacaaaaattagctgggcgtggtggtgggcgcctgtgatcccaggtacttgggaggctgaggcaggggaaattgcttgaacctgggaggcggaggttgcagtgagctgagatcgtgccactgcactccagcctgggtgacagagcgagagtctgtctcaaaaaaaaaaaaaaaagaaagagtggttttgacatgaatgttggctgatattttcttttacattaatgattaagaagacaatgaaacaacagagatgaatatttgaacttcattcattcatcagtgacatgagtcactgctctcctgaattggataatacttctcgaatactggaagaatatttcctcaaattttctgccactcattatgttacagcttcaggcatgcaaactttcatacttaattcatattattaacatttttgcatcactttcttaaatctacacagtcaacaaaataaaaactcaagccctgcattttagcatttgccaatttctgtagtaaatactcccactatggctcatttgaagctacatatattcaaagtgtggggttgagaaaagacacacaccattatacagtatttccatcatgcaacagacataaataaccccaagggcaccaataatagtaacatgtagcaaaataattaggaattttggactagttattacctttgctttcagtatgatttgtttaattggaagttagaggctgtctcacaaaatttctgaaaatttagcaataggagagctgcaacacactgctgagtgcaacatatgggtctcactcatttgccagaggaagcagtgtatgcaggtctaaatcagagataggctttttgggtttaaagaacgcaaggaggcagggcatggtggctcatgcctgtaatcctagcactttgggaggccgaggtgggcggatcacctgaggtcaggagttcgagaccagcctggccaacattgtgaaaccctgtctctactaaaaactacaaaaactagccaggtgtggtggcggacacctgtaatcccagctacttgggaggctgaggcaggagaatcgcttgaactgggaggtggaggttgtagtgagcagagattgcaccgctgcactccagcctgggtgacaagagcgagactccatctaaaataaataaataaataaataaagagaatgcaaggaagtgagtgttgtgggtatggagtggacacaagaagggagggaggctgcagagatggtgaggccagatcagagagggcttttatacctggtaaagagggatgttaaggggagtgggggtgaccgcaggtccccatatgctctgggtaaggccacacatacacaccccttcagcaggattgcagagcccctaattagctttgtgatttttaagagccacttccccttctggccaccacttttcttatctgtaagatacggaagttggactaatatgacatttaaacttccttccaattctaaccatctctggatctggataagccttcgctcctttttgtgtaatgaatgcagcgagtcctgttgcctactgaattcgtccatgtggcaggctcctgggctttctcactattccctcctattgatatggttatggttagtcttccaaacactgaatccacggcatcttctgcatctccttccttcacctctgaatgtcgtggatcgcctctgcagctgccttgtacaaaacacaatggctgcttcttccaataaagcatttggggttgctgctggctggcatcccaccatggccacccactcacataggctcatgtcaccatcacgctgaaagaacaagtccccaaagactgagatacatggctaagaaaatactgcaagtaggaaaacaggctcaaggaacatcctgagtgttgtttttggatcaccacattgactttctagatcacttccaaatttgcaacctaaaacagcaggatgttcctcaaatacttaagatggaaggcgaccaaaaatatcactgggtaaagtgaacatctacgtattggtatgaccagctccaaactcaaaaaatgaagcacgtgaactgtacttttgtgacgtaagaagctcgtaactcaataatagtcataattttagaaacacccatggtgcagtggttttgatttcaggcccaagtactgaactctctgcgcttggatttcaggtcgaccatgcctcagccaagtcatctaactgaagatgagtctgttgcctcatttgtaaatgcacgttgatagtagcagtaactgccttgtattggtgttactggaattagatgaattaatactgttccatagtgttcatataacatagttgttttagaagcaccttcacacccatgatttaattttctcttccaaacaaccctcatttctgaagaaagttgtctgatattatcacctccatgtctgacgggtcagcatagcacctttcccaaaacttcgagcatttctgagttttttttttttttatgacttttgcatttgtgtactagaattctgcccttagaactggcctgcctgagcttaatttctaatttaaaacattttactactgtgtgtctttgggcagttacttaacttctctaggccccagcttcctcacctgatgaatggggataattaaaataataataataacaataatgatgcccacctcatagcattgttgagaattaactgaaggaaactttatgaaccactgaggcacttagcatggtgtctggcaaatggtagcaccattcatcatcatcaacatcatctaccagcatcatcatcaccaataatgtcatcatcttcatcataatcttcattaaaatcattctcatcaccggcatcatcatcaccagtaacgtcttcctcttcattatcatcttcatcaacatcatcatcatcaccaaaatcattgtcaacagcatcatcatcgttatcaccaacatcattaccaacaccatgaccaccattatcgtcatcatcatcctatgagaagaaacagatcctaaaaacagttaaaagactgggctaacgaaaggcactgagataaaggtctttggcaattggtgtcctatgtgaataacaagtgcttctgtgttatactctgcatggttgcaatcacttcagtcttcatcctttgaaaggagaagtgtgggtgaaagaggaggagagacaaatccattcacacaatctgcaacttttcccatctgcctgagtgaatattcgttttgctttgccttaagattctgccaccagactttgattccagtgctgagtgactgtctggggtggcagaaggggttgggtgggggtgatgactctgacctctctgatattaagagtttatacagagaatagtatttgctgtgcattttaatcagcaaaatacacccccgtcagcagatgttaatttgcattctgacaatgctgcccctggaacctgagaatgtgatgttggaacaataaaaaagtttttgagtaataatacctttgtcctatcaggagtccccaaatttagaggtctggtccctgttcttgcctgagatattaaagcacagaaactatgggtaagcctgttatcattactcaggctcaactgacgcaaaagtaaaataaaatgggtgatacctactctcttgaagataaaactagaatagataatctattaaggtccacttaaatcactaagataaacgagtctaatgtgattaaaagaaaggtgtggaaaatgcatatgtaactactgtagggctttataatgacaatctttctgggctttggtaatttgagaggtctggactttatcagggatagcaaatggatttcattttatgtgacagctccaacagatgctagtggattgtttttgaagtggtcaggttaggttagggatagaatgttgtcatggattgttgatatcttctatgtgcataggaggatattcatatccacttggatatgaatgcccgacatttttcacccttggacttcattgtcttgaagtgtcttggagtgcagctatttgattatagatcacttcttcaccattgctcccaactaccaccttgaaatcttggtgctattatcatcttttgccgatgaattactggttcttatttctacattttaaagagccctctttaccatctcaagttaatgattctttaagtagctatatctcctggaatccttctttacctagaaaacactacaaacctgggcactgctatcctgtaccttagtggttctctagttgttcctgttttctattggcatgaaagaacatttataatgttctataaccggtatgggctatttcttaagagttgattgcagttcccttttcttgtctctgtgacagattcctttgtatttctagtgccctgagcagggcctttaattaatactctgggggtaattgacctacccatctttagtgtttactttaaattttacctgagtcttacacttactgtattgtattagattgtgtattaatctgtgatgagtattaatctgtgatctgggcagggctccgcaggttagctcatctcttcttccctcagtgttacctgcgggtgtttccaaggctgagcattggaatgcaatgagggcttgctcattcccatgtctggcagttgatgttggctcctgactgtgccttggacttccccacagcatggaggctgggttccaagggctaagcctctgagagacgctgtgccagacagcagtcatattatctttcagcacctagtccctgaaggtatcacttctttcaggttctgtttggcaaggttgtcacaaaagtccagccaggtttagggggaagaaacagagcctcctatacccattgatatgggaatatctacaccaccttgtaagaaaagcgtgtgggatattatgtgtattaatgtggccatgtttggaaaatacaatttgccatactctgcaaacaacacaggcccatttttggttcaagattttaagatctgattaatacagggaatgagataatagtcttggtgctgttaccaagacaggacgtttttgtatgttttatcagttaacatgtcagtggaatatgtcagatttttttccctatgtccagctccctttatgactcctttctttgactgaatatggaacataatgcattgggaaaagcaccggcctggagtccaacttcttttcaccctgtcttttcattgactaacctagagtataatgttgggccactcacttccctttgaggctcaatttcttcatctggcaattgagggtattagaccacacattctcttttctttccagattgttacaaaattctttgatttatttatttgatttggttggcttataaattatgtatttattttcttaaatgcattcttaaaattaataaagtaacataaagtagcattttatattttgaaaagtaaaaactattacttatttttccattatttaaattcgatattcctctacttcttcccagtcctttccaatgtagtttataagtgaggtgtgctactttgtaactcacatctttattaacttagtatcatgtgtattttccatattgatgcctttttgtgtactgattgtttttaaatggcacttcgcggaaagaaaatctgcacaatcacattcctattctccaggtcccagctcttatcacaaagtcctctgtagatatcctgttaggcaggaacaacaattattagacttccatgcggagataaggcctttgaagaaaaataaaatgggacaaggggttagagagtgcctgaatgggggtagctgatttagagaggaagtttctccaggggaacactggagcaggggcgtgcaggaagctgaggcaggaaccctgtgaaggtttggggaagaatattctagatggagaaagtggcaagcacaaaggtgggaatgtgtttggagtgtccatggggcagcaaggccagtgtggctggaaaggtgaatgagagattctattcctgagctctctcagatgaatgccccttctctttgtttctccaaagtcaaattggattatccccagagtgactgtagacagccacgtgcaaagagctgaaccctagagtcggttgtcaactgctctctgctggtgtgaagctgatttagcttacagagaaagaagagagttggagatgcttttttctccacagaaagggacatggacacatttaccagacggaaaatggcccttctcttggaggctggggcatcctcatgatcacaggagctggtgtgaggaggtgcccttagtgccatctccagcagggcttgtggagctgagactgctgccagcgcagcccgagcccctgtgcatcaagctggtcgcagggaacgttcccatgcttatttttccttcctgtgaagaatgcagaggcttcctgcaatagggctgagggcagtgatttctgaatactggtcactggagcccagggaggtgtgaagatgaccatgtaaactctaggtatgggctctttgtttctttctttttttgagatagagcctagctctgtcacccagggtagagtgcagtggcgctgtctctgcttactgcaacctccacccccaagcttcaagtgattctcttgcctcagcctccctaggagctgggactacaggctcacaccaccaagcccagttaattttttgtatttttagacgagacggggtttcaccatgttggccaggtgggtaggtctcttaactcctgacctcaagtgatctgcccacttcggcctcccgaagtgctgggattataggtgtgagccacaccgcgcctggccggtatatggtatggactatttttgttcttttctttttagatggatttttctctcttttgcccaggctggagtgaagtggcatgatctctgctcactgcaacctctgccccctgggttcaagtgattctcctgcctcagcctcccaagtagctgggattacaggcgcccgccaccacgcccagctaatttttgtatttttagtagagacagggtttcaccatattggccaggctggtctcgaactcctgacctcaggtgatccatccacctcggcctcccaaagtgctaagattacaggggtgagctactgcgcccaaccggtatgggctatttcttaagagttggttgcagttcccttttcttgtctctgtgacagattcctttgtatttctagtggcctgagaagggcctttaattaatactctgggggtaattgacctacccatctttagtgtttactttacattttacccgagtcttacacttactgtattgtattagtttggcaccaaggcatgcagagatctatggtgtcatctttctgtgcgaagaaagtccaagagacctattctattttaaggtgtttttattaccatatctgaaagcagggttggattttgatgtgatgaatcactctttgatttttccctgtgtttgtttcctagttttgcccttaaaacatttaccctggatctttagaatgaagatctaataaaattgtagaatagaaaagagtaatgtatatttgccaggttagactagcaactgaaaaaaaatctgttgaatctcagtgccttaataaaataaagggtttttgctgcaggtgtggcggtggtggtttttctctctctccctctctctcatgtgaatgacagtagagtacaggtaggtgggagtaggatgagattctgcatcactgaatcattcagggacctcctcatcagcagctgggcttcctttgaagcctcttcatccaaccaggcaacaagcaagaagagaatgtgccaggcgcggtggctcacgcctgtaatcccagcacttcgggaagccgaggcgggcggatcacgaggttaggagattgagaccatcctggctaacacggaaaaaccccgtctctactaaaaatacaaaaaattagccgggcgtggtggcgggtgcctgtaatcgcagctactcggaaggctgaggcaggagaatggcgtgaacccgggaggcagagcttgcagtgagccgagatcgcgccactgcgctctagcctgggtaacagagtgagactccatctcaaaaaaaaaaaaaaaaaaaaaagagaatgtgagtctggtggaggaggtcttagagtcaggcctggaagtgttgcacatccgacccacctctgttgtataaaactcagtcacctggctccagctccttgcagaggggttgggaaatgtagcagggtgtaactgtcaagtgggagaaaacagatatcagctcttacaaatagtgtttctcaaaatggtttgctccccacttgcaccacaatcccttggtgctggaggtgataagtaaagaaatacaaattccctggctcaaaccatcacctaatacaaatacctgaatgtggggcccaggaatctgcacttaaataagctggtgtttatgattattcactagctaagagaggagaagggggaggtgatattgcagaaaacatggtaaactctcctctctttctgctttctctatctttggcaccttttcaaagaggaattaaattaataagttgttgatttgtaactcttgccctttaaacatgcgagcactcagcaggctggatgttggaatcattagtcaatacatcaatactcttaaggactcgttcacttaactaataaagcaaagcccaggttgtttttttcctctgaccttggctggctggagcccgtgccctctgtgactccaacgatgcgggctgcccaggaagcactggtgatggatggcgcccttactcagctgactctgactcgctggacgctctttcctttcctcgtcctcttccttttcctgattgccaatctctgaggggcttggcatctttataacagttgcacaaagaagttcaaatttgctggacttcgggggcggaggactgtggctttcttcccatctctcttatcgtttggtttaataattccaatttccttatattcccgtgggaaactggacaccttctaaaaactactgatggttgcaaacattgtggtcacagatagagctatttagagagaattcaccaagggccagagccagagggctcctttttttttttttttttttttttttttttttgagatggaatttcactcttgttgcccaggctggagtgcaatggcatgatctcggctcactgcaacctccacttccggggttcaagcaattctcctgtctcagcctcccaagtagctaggattacaggtatccactatcacgcctagctaatattgtatttttagtagagacagggtttctccatgttggtcaggctggtcttgaactcccgaccacaggtgatccacctgccttggcctcccaaagtgctgggattacaggtgtaagccagcacgcccggccagggctctttgattcatgtaagattagaacggcttccatccttacactggtatcaaacttgggcttctccttccaaatatttaggagaaaaataaaaaaaaaaaattgaaaaaaatgatgtattactcaggattcaaaagaaagagacttaaaggattttagttctatttctgtatactaagcatgtgaagatatagcccagagattgtgcccattcttgtaaaataatctccttggaacaggaagataaaataacttttggatgagaattcactgtgtggcagcctcgatgtcctttatttctcacaaccttgtatgggaggaatcattgcacccatcttcctgaggaagaaactgaggtctgagggggttgggtaacttgactgaggtcaagggctggggcatctgagcaaagagtcaatttagttccactaatagctcttgagcacctagggagtatccccgcaggtgtataggttcgggaggatgaatctgcccagtttctatttgagaagacaggaatggcattgcaggcagggggaacagcatgtgcaagggaggactggcaaggcgtagtttgtctgcggctgtctgttgctaccatatggctagggcagcaggacctagctgactcgtggctggaggccacaaaaagccatatttgagattctgcagcccatgagggcaagccttgagagtttgaaagcacggactggcgtgataatccctgtgattagaaggaggcctgggactggcgagaaggttagatggaatggagtcagctgtggggaagggagaaagtctaagccaggctttggtcttcagggaagctgaagaattgttacttctgctgtgttctttgagcaactatagcagtatagtgatggtcccgtagggaacacttgtcaaagtctggagacatttttggctgtcacaacttggggtgggggacactattggcatctaataggtagaagacagagatactgccaagcagcagacaattcatgggacagtcccctacagcatgaaccatccagcaccaaggtcaatgttgccaaggtggggaaaccctgacctgcagtgattcagggctataactggctggttctgactgaaaatcacattctttttcatctcttttgatcagtttggtaagcctgtgcttgactttcctcatctgtacagcatatataagaagacaagaatccagtggtaggataagcatttttatgaacgttccaatgatcatatttgatatatatgttcttcatagactcagagtccagcagagaagtcctccataccctaatgaagcctgctgcttttggggaggtcttttgagttatcatgcctagtatatttaagctacagaatccttgtgtcaagacgaatgctgcttttttggcaaattattttagattgattttttttttatagctgtaggaatgcccctggggtattcagttttttcactaagcagatttggacccatgtggtaaagaattacagtgtagccaaggtcacagtattgctggatataaaatacattcaccagccatgacttagtccacaaatgtggatcactgccaatattgcttcagcattatagagtctctcattgaatagtctggtcatgaagcaagtgttcattgaatgagatcatcttagaatgctttgtcaagaaatcctagagcatttggctgtgagaaaccacctattttgttcagtccacctctattctgacagatgaacaaacctggaccagagatattgaatgacttacgtgaggtcacagagatgatgggtggtagccttaggtggcactcatttataaaagtataggcagatggctggtgtcattttcttcaagtttgatcagaggtgaatcagcgagatagagacctgtgggtttaacacagagataacctgagaagattgcacatctgctctgatacaggaccactttgtgggtgtgtgtgtatgtgtgtgtgtctgtgtgacagtggtgctccttttacctgaaagatcaaagtttctgaattattaggctgaaaatgcatttatggtgcatttcttaaaggtctcattagtatttaaatggtacaggaaagtgcagataaattgcgcattatgaaaagagccagtgggactggcaggtaacattatttccctggctacccaaatccatccgtcttcttccatgtttgtctcagcagaaatccatagttaggaagatactcttttggccaggttagggctgcactttgagtgcattttcccatgtttgaaataaagccagggccatgttgctgggtagttttgggtctttgaattctatctccatgactggcatggttttctgagaggttttctcatctgtccaacaggagtaataatagtacttgtctctaaattggagaagattaacgacttgaaaaaattcacattaagcgttttgcatagtgcctgacaaattttaaacgttcaatatatgtcactttttataattatctgtatcactgctgttatttcattacgaaatgtgtctggcacatagcagattgtcaatgaacattgcttctttttcttttcagtaacccctctggtactgtgattgtgtggcccttgaaaagtcatcttcctctttgggcatcctatttacaataaaacaaagatggcccctcccagctttacaagttctctgtactgagtctctgagtcaatgattctggtcacaccacagttaaagaatccgaaagcatagttgtagggaaaagtaatgcacacctaatgaggatgcaaagagcaggtctcaagatgctgatttggttgtgaaggtttgctcctataatccaatagatgtaattaggaggggaaaacagaaatggggtattgtagcagcttcagtattgccatactgttatggctttcaaaatgcggtttaatagctagtcaaatggctcttattaaggtgcacgtgattgaaacaccagggcataccaccagccttgatggtgatgggggcctagctctgtatattcactacttacagaattcagctgaacacaagttaaagcagcaaaatgattcaaggacaagtcatttttctttttctttttttggaacgtagtcagagatctggagtaggactcccagggatcagagtaagcattcatgacttattggtagtgtgattataccacgtttcttagctcagtttccttatctgtaaaatgggaatattaactgttgtggagtggtggtagtgctttaacaaaatgaagcatagtatagtgcctggcacttagtaatctcaagaaatgtcattttgttgtcatttgttttttaaaaatgtagcagttgagcaaagttctatctgaagactctttattttaaaaaagtcttaatttgaagcatggagagttggctgatcatgtgtcaattagcaaaatattttaatggatattaattttttaaaagatatcgtaaagaacttgggcaacgatacggaaagaattgtgtattgacgcagtttgtatagttcaataaatattgtatcaggtccaggatggaaaaaggatgttgccgaaataattgtgatgtgatagtttaaaaaaataaatccaacaataggccagtgtactggccagcaggaagctccaacaatacccccacctttttcctgtaccttacccggagttccttcaggcgacacagataaccgatgggtgataaagtcgaggaccgggtctggtgccagctgaaaatagaagaattagtgtcaaactgttatctgatcagaaaatggacttagcaaacacccttcccaagcagcgtttaagaaaagtttgttgtgggggaaaagtcttcttttcacctgaacggtccctcttagtcacagtgactcactgagacccagttctctggaagcccaaccactggctcgtctagttgcagggggaattcttgcatcatgcatgaagccctccttggagcaataatgtaaacaggaattccttgcatttataaagcgctctatgctttcaccatgcctgcccattctttattctacttagctctaggagcaactccttgctttgagtattattggcacagctgtgaacctgggaagtgactcatcctttctatgcctcagtttcctcatctgtaaagtggggaataatgatcttatctatctcactgggttgttactagaattgtgtgagataacgcaggcaaagaatttagcaatatagcaggcattacttgctgtattttaataatcaaataatcagtaattattattaatatcaatcttgtgagggacagtattattgccattttagaagtgaggaaactgaggctcattcagtcaatatatttattgaacaaccaagtcccaggcattattttaggttgggctgaggggagggagggagggacggtaaacaaataaacatgaacacaagatgtactgcgttctggtatgtgatatgaagagcctaacactgagtaagggaaaagagagtaaagaagttgggtcgggaggtttgcttgtttagacagggtagtcagagaaagcctcactgctgagggtacctttgagcagagaccttcataaagtgagagaatgaggcttgccaacatttcgaggaagagcatccaggcaaagggaagagccactgccaaggccatgcagcaggagggtctcagcgtgtcatgggaaatggcaaagacctctttgtgctcggagcagagtgagccagggcagtccggggacaggaggttggattaaaggaagccaggctttgaaggctgtggtgaacacttgtgattttgtccagtgggaagccacaggaggcttctgagttgagcttttgatctgaattaaactttgtgtaatgctcaccctggatgctatgaagatcatgtatggtaggtaggcaagaatggaagcagggctatccgtctggagactttttcagttcagactagcaaggatggtggcttggatgtgagtagtagaagtggaggtggtagagatggccacagacagtgaggaataaaaagggcacgtaagattccattcattcccaatccttgaggaactattggtctaccaagggacagagacatgtcaaagaaacaaagggcttccctcgacctgcccctgctgccacctgacaacatattatcattgaggacataaactccatgggtattccataagctccagagagaatgttctatgagaattagtaacggggtcatgatgggcttgcatggtcaacaaaagctctaagaagaaagtgggacttcaagtctacttcagaaaatttgaatagcaagaaataaaggcaggaaactacttaattttgaggaatctgtataaggaaagacacaaaccagatcaaatataatatttaatgtctctgaacatttaggttacttctataattttgctgtacaaaataatgctacaatgacatgcattagctgtataactttggacaagtgacttaaccacgctggactcaatttcttcctctataaaataaagaaaccaatagtatttatctcatagggctgttgtgaggattaaattggtagtaatgattagaacggtgcccaaagtctattaaacattatataggtgtgagcatttctttagagtaagtacttaagggtagaattacagagttacagaacatacacattttaaatataaataaagttttattgtaacacagctatgcccatccatttacataccctctatggatgctattgtgttgcagtggcagagttgagtagttaaaactttgacctgcaaaatcaaagatattgatatttaccgcgtggtttttgttgaaaaagttggctaacctctgtaatggacacagcttgattgtacttaaaagtgactttaccgatttacattccctttaggattcagagtatgagaatatccacttctgtctactcttgctaacacttgatattattaattttgaaaattttagtcaagctgatgaatataaaatgttatctaaatttaacttccatttccctgaccaggaatatcaaagattttgatctcaagctcatctgacactctttaaaaattttgagcactccaaagttttgtttcggcattgtttcaaaggtttgcaagtctctttaatatttgtttaataaagggtggatggattttcatattagtttctgcattcactccgctgatttgtttcgtttgaagaaaattggcctcacatagatttgggattggaaaagaaaggaatactctggaaatctcttgagataaatataaatattctttgttgctacatccaaactctgtaagtggtattttcttaagtgttagctttagtgtggaatctgaaaccatagcagtggacttttcatgctctgtaatattaaaatccattagtccatcttgcactttgaatggatattttacccactcatgaatttataataacatgcattggttatttggaaaatattagttcacttagttttgcgtatcttccaaatttgacacatttcattatgcaacaacaataaaaaaatcacactcattaatatcatcatcagtctcatcagaaaaggctttaagtgttaagaagctgtcacactcacataggcagatataactttcctaacctttatttttttcaagaaagctcaaagtttgtcattgacaataaatactgtgaattgtcttcctcgatgtgattggctcactttgttcatttttgagaaaatatctgccaaatatacatctgaataactataatttgtgagttgcttttcaactaaaatggtattgcacaaaataagccattagttgagcttgcaacaatcatacaagtgtttttcctagtatggtctttattcttctcattctgtctgtccctcagaaaattaaaaactcacgtactcgatggtagagatataatttataatttgtacttcttcatcagggaattttgtaaaactctgagtgcatggtggtgacaaatatgattgcttctttatagcttggtaccattgttaaggatttgtgatttgtgctaaggaaccccagtttttctcactattgctgtgcactctcagtgcagtgtcaacacaaagcaaaaggcaaatagtgagtgtagaaatttgatgaaaatagttttaatcatgcgtatccctggaaatgatctcggagagtacttgagaacagttactttagataatactgaggttgagcattattttgtaggcatttccttctgtatactggctgtccatattttttgcccattttttctattgggttgtttgtctttttcttactgatttttagaagtgaaattatatttatatataaatgatctttgataaatcttgcttcctaccctttttctgaatcttgcaactgtatctccaccaatagggcaaagcttaaataatcgtgtgcatccatacgtagtaaaatgccacagtgtatgaaatgtgctaacatagaaaggcttaaaatgtgttgttcattaatatagcgtatatcactctttaattctcctcctctacatgaaatagttatatatatatatacacacataatatacacatatatattataatgttatatgtaatagttatatataacatatatatagacgtaaagtatattacttataaattcttctccatagttcctcccctagggaaagggaattggtaagtaatatactctacattattgctttttttaacaataaacaatacatagtatatatttcacctgtgtgtgtgtgtgtgtgtgtgtgtgtgtgtgtatttatatttaaatgcacaggaaaataaaaaatatctggaaggacacatagcaaaataaccactgttattttggattgaggggaagaaagcaaaataaccactgttattttggattgaggggaagaacccacaacagaattatataactgtgacttcaagtttatttggtatttttattgtttacaaatagaatatatttatgaaataatttttaaaagtaaactttattgtgtatatttaaggtatacaatatgatattattgaatacatatagatagtataaaggctactatagtaaagcaaataacagtccataatctcacatacttatcaatttgttttgttttgtttttttctggcaagagcagctaaaatctactcatttagtaagaatcaactataccatacagttatattacctatagtcctcatgtacaaacatttaatctctagactgattcatcctacatctgttattttacattcttcaatctacctcttcccatttcctccccgctcaccccctgctatccctggtaactactgttttattatgtatctctgtatatttaaattttttaaaaaagatttcacatctaggtgagattgtgtaatatctttatttctgtatctggcttatttcacattgcatagtgttctccaggctcatccatgctgtagcagatggcaagatctcattcttttggtggtgccaaataatattccattgcatatatgtaccacagtttcttttccctgtcatccactgacggatgcttgttgtgcccacatcttgactattgtggaaaatgctgcaatgaacatgggagtgcaaatatttttattaggtagtgattttatttcctttgggtatatgtccagaagagggattactaagccacatgttagttctatgtttaatgtctttggaaacctccatcctgttttccgtaatggctgtaccaatctatatttccactaacagtgtacaagaattcatttttctccacatcctcaccatttatcttttgactttttggtaacagccaccctaacagatgtgaggtggtatctcataatggtttggatctgcatttctctgctattaataatgttgaacacctttccatacacatattgaccatttttgtgtctcttttagaaaaatgtctattcaggtcttctgcccattttctaactggattatttgttttttcactattgagttgtatgagctatttgcaaatttgggatattaaccctttatgagatacatgctttgcaaatattttttctcaatccataggctgctgtttcattttgttgatttagtaattaaaatagaaaatttaaaaattaaaaaacatgccttcttaattcttgtagcataatagcacatgaagagacatttgtattgcttattcaataggaagaattatagtacatgcatatttgaaaacgtgatggtattttctggaagagagggctttcttttggttgctttctaatgagaagtgatgcctacctaaactgttacagagatttgggccaaagatttttctaaacttaaagtgatctttctttttttatcttcaaattctggccaactaatataaataaacttacttcaatatttatatgagatccagggtacagtaaccactattacttaaaatatgtggatcagtttgtttaatttacatattagtgactgacttttacatgcctgtaactgcctttcttatatttaccataggaaaataaagtttttagtcccaaaagaataatttaagggatttaaaacaaatgttactcttgtatttaattcatacaaaaaacaaactgataaaatcctaaaaatagctaaggtcaaattaggaaaagctgaagcaagttaatttcctagatattatcttctgaacttattcatgctatatattctgatgattcataccaatggaatatgtaattggtaatgatcacaggtattcatataacatcttttgtccagatgatcctccaagtactttatgaatggattttccttcatgtggcagctcctagttcatcccatgtgtgtggaagttcaccacttcattgcattgcagatgtgtatgaagggaaaagaaagatccatcctgtttgtcttttcgtgtatctgacgctgtgtgatttacacagcagaaggaacatttccttcctccctagtcatgggtaggacacaggataccttggtaattttagttttaatgctctaatgttctgggtaagagatggagactaaaatgtatctaggacctactatatgccaggtactctgagaggtgctttgcatgttttagataattgcatcttcataaaaaccccaaaagatgtggttattattgtctccattttacagttgaggaaatgagtcttgtctgagatcacaaagctggaacatgagaggatcaggatttctcccaactgcctgtgatttcagaaatcaagctgggtcactactgtttcttttatggtaaaagtaatactaacagagtaggcagaagaacactgggcagccattaatctccaccatgttttggctgctacgcacttgtccaccttgtggctcatgtttctcagattgtgctcaaactctaccttactttgatcctctctctcactggagacattgcttgatttctctcctgccttcctaaaccattgtttggaaaagactgtctctgtatgtcttcgcttccttctcatttgtttgctcttaagacagtttgactagcttcttaccctttctctgaatctgtctctgaggcctcactcatctacacattggcaaatcctaatgacatcttttgtgtttacctgttcacctactggaattttcttttttttcttattattttttttttttggagacaagagtctcgctgtttcacccagactggagtgcagtggtgcgagcttggctcactgcaacctccacctcctggtttcaagtgattctctcacctcagcctcccaagtagctgggattacaggtgcccaccaccatgcccggctaatttttatacttttagtagagactttctattgtgattgccacaatccctactaagaaactcaagtgccttggttttcataacactattgtccttggttccttttttccatttactccccatactatttggttggttttgcctaatcctttgcattctctccttcctgccaccctcctgactcgtacctgcttgtgagagcatatgttaatttttcacaacttttgtaagcctgttgatatcctgttggtagcttgaagttggttatggtggagtatttacaccatagaaattggcagtggtttaaaatcagcttctcctcactccaagagcaggctgtttactattcactagcaccccactgcttccactgaccctcataattgtggatattttctagatagcccttctgaacaagttttcccctcacttaacacattctccctgggtgtcatctcccactccccaatacacacacacacacacacacacacacacacttatggttttaactattacctatatcatttctcctaagtatctatctccatcttgaactcatttcagagtttcagacctgtatgtccaaacacttcctggaaattcccatttggatgttgagcaggtactatagattcatcaactcccaaaccaaactcaccatcttgttcttttcctatgtctcatgtttcagtgaatgaccccaccatccactttctacccaatccagaatttgatctgccctctctctccttagctatgctaggatcaagaagatattgttaaaagggattatcattctaggggttagttcttggggtaatgatatgagggaaacggttactttggatcaccgtatggttactttttaattcttagactgttcaaatttctacaatgtgggaaacctgacatccttgtgttctcctctgttctcaggaaagggaggaaataagcttatgtaaattaaatatctatctactgggtgccaaggctttcaggagcttttccatgcataaatttacttaatcttctcaatatttctataatgtagatataaccatcaaattttttttttgcatgcaagggaaattgaacctcagctaagctcaatggcttgttcaaggaggttcagctaataggtggtggggctagaatttgtccaggccctatccaaagcctgggatatttcccttattccaggctttctctggctagatgtgtccatgtggagggaaactggcagttctttggcggctcccataacagactcacagaaagcgccgccgactttctccttacacaagagctccagaggccctctttctaatgctaccttcatagtctcccaaagccagcattcacctcccctccaaagatgtttatagcatatcacctctttgacatacctgaatgcatagatgcaaagtttattaatatatgttggagttttgaagatgaaagcgcttcaccttcctggggattgttaaaagtatgcctacttttcacagttttgtttttaaatcactcaccagtatgcaaaaggctaccagatgactagcatgtgtgctggaagagatgaaatgtaagagggaccaggtgtaaggctaagagctggtgtctgccttcaaggtgctgaccctccagaagtgggcagaaccctccacccagggaatggccagagagtgataagagggaattaagagcaaatgcccatgtgttcttgatagctattttttcaatggctacacttaaaagaatgtgttattttttgacaaacaggaaacagtcatgccatgaagtgtcactgtattaaatggctcccaaagagttaatacatcaattggaccagagggatttgaaggaggcagcacaactctctaagaaggctcctcagtgagccaccaggccctttagacattgcctttgggttcttgctgcatggaatgtggtcatgataaagtgtaactgacattcattctatcggtattaattaaacaattgcttgatgccaggcattttgaatgaaacaatggacacgatgaataagatccttttctccttgatcttgcattagaagaaatcaatttttaaaagaaaaagaaatatgatagcaagaagcaaaagaggaagatgaaagacagtacgtttggggctactttagttggggtggtcacagaagtcctcccaggggaagtgatatttaaacaaagacatttttgagaagaagccagccctgtgagcatcttgggagagaactaacaggcaggagccaatggcaagtacagcaaaagaaagacagagggaaaaaaatgaatatggatgaagcaaatggcctgggattaaattgaaggcatagtgggggccagattttttggtctttgtagatcggggaaaggaatttcaattttcaatttgggatttcattttagtgctttgagaaatctttgaagaactaccagtaagggagtggtgtgatttgatttaggctttaatcagatatatcagtagatgtagctttcaggcggccatgcagagagtgcattactggaaagagtgtggatgattgaggaggctctttcagtggtcaacaggagacatgattctgacttgggccaggatggtggccgtggggatggggaaaagtggatggatttgcgatgttgtttgctgatatatcagatatggctgacaaaggaaacagaagattaaaatatttgtcttcagcaagtatgtggatattgctattatttactgagatgggggttacctagatggagttaaaagaaagtatggggagaaggttatttcttttgttttagtgtatgacgctgcagcttctgctaaaatcctgttcaagctgaggagggttaatatgtccttaggctgcccactccattgttggatgtctctgaaggccaaatattcttccacatgctaactagactctgccttcctgcagcttctattcatgtgtacattcatgtttctctggaaacccatggaatacatctgctgtcttcttagaaatgtgtgccaaatatgtgaatactcaagatttttgacattgttttaaaacattaaaatttcaaattagtttgggtacaaatgccattaattagattatagtgtatatacatggacttctccaaattgagcttttcatctgtgtacagaaccatgttacatagccttaatttagaatgaacagtaagcctttattaatgacttgttgccaagaccctttacatagttcttttttgctttttaaaattcactttgtccctactttcaatataatatatacttactgtagagtgtaagaaaaacagagacaagtagctggatttcaaaaataaatacctttcagcattcatcaaagaccctgacagttaagtatttggcttatttttctcagtacttatttttattttatttttttcacaagactctatgtattttacatttatatttggctttttcatttgcattatagcagagatttaaaaatattactttaaaaaatgtgttaggctgggcgcggtggctcacgcctgtaatcccagcactctgggaggccaaggcgggtggatcacgaggtcaggaaattgagaccatcctggttaacatggtaaaaccccgtctctacaaaaaatacaaaaaattagctgggcactgtggcgggcgcctgtagccccagctactcgggaggctgaggcaggagaatggtgtgaaccctggaggcggagcttgcaatgagccgagatccgccactgcagtccagcctgggcgacagagcgagactccgtctcaaaaaacaaacaaacaaacaaacaaacaaacaaacaaacatgtgttaaagaacctttaccaatgattgccaagtatttctttcatttaataagatgataagttattgcaagaggtttaggtgtttctaacgattgttattttttaccactatggtaaacatctttgatgtaagaattttttcaaaatttgggtaacatccttaaggaggaggtgtcacaaaataagagtttggacatttcctaaaatcttcctctagaatgttaacactgagtttccaacagtattgagtaattgacctttccattagtatggatataagtgaccctctgaccacattctggtccctgttaaatggtatcatgaaaaaaaatattatgctgatttgagagtcaaaaattatttggtgttgatagtctcatttgtattttgtggcttactagtgagcataaatatttttctacatgttattacaacatatagaaatgtttttatcttgccataaaaacaattacgggggatttttcattaattggggtccaactaactagaacctcaactattcaaattttggggtgagagtcaaattgaaaagagaatgaaatgacacatactgaaaaaggagagaaattaaaatagagtggagtcttctccagctctcagtataaaactcatcaaggcaaaactgttttatttagacatctgggaaatgtactttgacaaacatccgcttgatgactgtcagtgtcataaagagactttgatatcaaaaatccacagaaattgttgaaataaattatatatttttgtgacaaagcactctttgcctgctcttttgcattgtccatgtgatttggctttggcatcttaatacaaaggagagccccattttcatgtaaatgacatgacagaattaatggagagctctagggagtctacagactgcaaatgtggcatctcccctacctgcttttagcaatgcttacccgtagttgcttttcagtatttttaacatataaatgtttccaaaatttacatattcagtgtttttatagctctagaaatactctctcaaactactacagaaggtaacaaaacatccttcaaaagtctgatttccatgcattcaggccataaaaaatatatagatagaatttttagactcacttccaataagttaaaatgcaacttgttctgctaaagagtttgatcttttgcttaccaacagcaccaggggtagacaagatagaatgtactttgctttctatttttaaaacctggattcactgggctatttggtatttgaaattattaaagctttgttagccatcttgataggtttacatgttacagctgaggcttcttatctgttaaaccaagtgtattagacaatgtaaaaacatgttaagaatgggcggaggtcttagggagtgcattgcatagaaaaagtctgagagttgagatcagatgaaccagaccttataatccagccttgctacttattaactttttttttttttttttgagacagagtcttgctctgtcgcccaggctggagtgcagtggcgtgatctcagctcactgcaagctctgcctcccgggttcaccccatcccatcctcctgcctcagcctcctgagtagctgggactacaggcgcatgctgccacgcctggctaattttttgtatttttggtagagatggggtttctccatgttggccaggctggtcttgaactcctgacctcaggtgatccacccacctcggcctcccaaactgctgggattacaggcaggagccaccgcgcccaggcttattagctcatttcttttgggcaaactatttgacttctcttgcaccatttcctaattaatatccccataaattaggactagtagtacttgaaaattaaggggttgaatgagatagtacacataaaccagctagtagaggacctacccatggtaggtatttcataagtcctatgcgattagtattgcttctggtcttattcctgtcactgttgctgtcataggatgttgctgcaagaaacagtagatgttgggataatagggaatcatgtattttgtagtagcccatatgataaatagtattagcaaccataacaaacatttatggaacacttaacatgtgtcaggtctttgtgcctgccgtaggaaggcaagagagaaaagtaagctttgcctattgccatctgggtttctttgatagaaaaagctgttactgagagagctaaaacacccaccagtgctcaaaggaaacaggggcggccatgggatagtcacagaaagagctgagaggagatctcgatgacatgcattgcagttgtgattgcagttaccaaaacggctctttaataaggaggcttaatgtataaatttgggagcaggggatctgcttacactcttgcattccacttctcccctggaaagccctctagagcttcagggaccacagaacaaaggccactgaccttgtgcagcctccacctgctagctttaatacagtgaaattgagaccccacatctctaatctgggactgggctgaaacatgcactgcatgagtctaagctgttgactcttaaagagccagagtgaactttcccccagtgggcagtagattccgctgcatctgcttatggatgtttactcttgacctaccattagcagagacgtgacatgatgtagttttccctcttgtaccttttaaccacagaccacaatccatttgctctgaatgtttaatacagtatcaagcctgaaatcaaatgagtgcaggtggaagaaaacattaggtgggttaggtcagggaaaagcaatgttttcagggcttctgcaaaatgtgctaatgttgtgaggaaaatcaacaataagatcagggaagtagcactcgaaaccaatgtcttaaaaagtcatggacaaaaaaacaaaaacaaaacaaacgaaacaagatgagagaagacatggggattgttcttgtaaatgcagagtcaatcaatttgatttcttaacattaaaacactttgtgctttaaggatgtatcccagttaccccatcaaaaagcagaattagaaaaaaaagtcttaagagaaaaataacagacaaatccttaatatctttaccataaaaagggatatgagagagccccaagtgttcttgtgaaataaagtttagaagttccttttccagatgtgcaactgcagaaatgtaaataaagctttagtaaagggaggtcattggccaaggaatttgaaatgaggcacccagggaagtgggaggagaagtgaggtatttagtttttacttctacagctgttgcttggtgactcaccattgatagatccttttttttttttttttttttttttttggagacagggtgtgtctctgtctcccaggctagagtgcagtggctgggcctcaggccttcaccttctaggcttacgcgattctctcaccttagactcccaagtagctgagactataggagtgtgccaccacgcccagctaattttttttttttttttttttagagatggggtcttgctatgttgcccagactggtctcaaactgctgggctcaacccgtcctcccattttaggctcccaaactgttgggattaccagtgtcagctaccacacttggctgattgatcttaatagggaaagcaaactccttagtttttaaagaaatacaaatttgctgggcgtggcagctcacacctgtaatcccagcactttgggaggctgaggcaggtggattacctgaggtcaggagttcgaggctggccaacatggtgaaaccctgtctctactaaacatacaaaaaattagctgggcgtggtggcacatgtctgtaatcccagctacttgggaggctgaggcaggagaatagcttgaacctgggaggtggaggttgcagtgagccaaggtcgtgccattgcaccccagcctggggaacagagcgagactctgtctcagaaaacaaaaacaaaaaaaagaaatacaaatttataaaatagcattttttttaaaatggcaccctgtttttatgctgtttgataatgccattaataatgtataggtttaaaatatctcatattttagaacttggtgatgaactatgtatacacttgcattcaatatttaacatttaagaatctgttgaagtggttcattcattcattcactcattcactcatttacaactgtttgttgtcagacctggctctagtctttggagactgaacagtgaagaaaacgacatgcttcttccccttaagaagcatacacagagaaaatgccttcttaggaaataatccagtatgcggaaaacgctaactttccaaagacatgtattataacgttatttttaacactaaaattgaaaataatcttactgtttaaaaactaaggaaatgattacttataataaattcactggatatagacattgaacaaggtgtttgtaagaaaagtgtttatgctgtattaagtaaacaccacagagtacagatttgtatatactgaatgattgcaattaggctgacaataaggaaaggaaaaagtacaaaaaaaatggctgcgtggtaagactgtcttttttctgttggcaatattgctctttgcaatattttctttttgtttaagtaaaataataacagtgtcctctttcataaacttactttgtgttaggctttatgagcttaatatacatttactcatttaatcctcacagtagccctatatcacaagtcaggaaaatggggcaatgagggttgtagaattggattcaaacccagaaataccagttccagaacctgacctcttaactactacgcaaatcgctcctttagagagaaaaattgttccaggtttaaaaatgtgaatccaaacgctggtctccagagctcaagctcttatgccttgttggtaagatagagatcttaacaatatccactactcaaaggctgctatggaatgaagcacatatgatgatgcttgtgaaagtgttttgtaaattttaaatttccattcaaagatcactcatggggtgtattcaaaatatctgagtgccttaataaatgtgtatattaaataatttaaagcacatttttgttgaagtattcacaggtaaattagctagtttatatattttaaataactgtttagagcatggattttttttttaatttacagaaaatgtactgaataaggtttattttgtaaattagtttcttctgctaggttgacttccttttgctctttctccgtttctctctctgacattctcagtcccaccattgtatgatttttcttgactttctcctttcattgaacaagcctcttcaaggtcaggaaaccactgtaatttgcacttcggaggtatttagcagccaaaggtttaaattcccagccagcaattgggagtccgggcttgggttgctttattatgctttatatctgttgactctgagtaaaaaataatgtgtggagtagaattacaaaggtgactcttaaaagcatgtttaaggatgataactttaaaatgtgctcaccaaagccatgaaaatagatgagttccccaagaggtacccagcaatacacctttatagacttctagaatgaatgtataaattccatgagggtcttgatggcctcttgaagaaactggggaggatctttgtgttctaagagtttacggtgtgttaggttgcatcatatgcatttgacatttaatttgaaagtggtctgtttaaaatgtcatctgtttttcatttgtaggggcctacttgaaaatggtaggttggaccctatgacctcctggtttcctcccaactctaaagtattgtagttgttcagttccaaggtaaatgtaaaatttattttccagcacaacaactgatatttgtgtacggcttatagtttacaaaacattttgcacatactgcatcctatctcaaagaaggagaaaagggggaagaagcccttgataaatctagattagaaaaaaatgcacaacgtgtctgctatttttctatgtgttggttgccttcgagatgaaaagtaatgttctcatttgaaggcaactgtgagaattagaatcttattcacatgtgatgtcttctaaaggattatcaaacacctgtttactaagtgcacatataatatataatgccattcaaaaagtagttttaccaggtgggaaatgttgaataaaccatgtcatcataatctaatttaaatatttggttcatctgtttcagatatgcaagagaaaatattgattgttctgggatattgtgaatccactcacattttctatgtgctaaaatagaccttagtatactggctatgttacctatgcttttcctggaaattcaggtctgttcagaaatgtcaaagctagctatggttatgcctgccctgaattttaaaaaatgtaataactgaatctttttttacaggggtaagaaaaaaaaatggtattctataattttccttagggacttggttagataagtccgggcatatgtggtgtacccaatcaaaacacaatttcacaggttatgagtttgcatgagatgcggtttgaatgtgcatgcagagacgggggaaacactgctgcaaccaagcaaatcctctttgatgttcctaatcaagtctatgttactggcggcaattctttccttgcagggtctcctctaggttggaccaggcagccatgagccaggaatgaggcatcacccctgttactgcaggcagagaaagagatgtctctgatcattcttggacaaaagactgagcaatatatcatattgagagctatagttttctggacacttggtgtgttatgcatactgcatcaagtgctataatacatttgacagtctttgtgagttgagcatctttgcttgagactgagagatgcaaaataagtcgtccaaggtcacaacttgttgacaagggactgagccagaatttaaacccaagtctattggaccttagagttcacagctaaccactgagctgtcctgtcactcaagtgatcccaaacgacttctgtactgtagataagctattaaagccgcacagtggatatggccttccctctttcaccttttcctcttcccactgctgactttctgtgagttttcctctatcatggcttcttgaataaatggccagtggctggaaaagaggacatggaaattattgatgtgtatttgtgattaggttcattgataaaagattgtaagatatatatatgtatctttttacatagttgtgatagtagcacatgcatacatttatattactatttgtcactcaaagtcattttcatctgaacttctctaaacatgagtgtcaagtatatcactggtgctgactgctgggctcagtgcctgagtttgccatttttgtctgataaatctatcagagttgatagttgagcaagttactcaacttcttaggtccttagctctttgtctgtgaagtgattatatttccttcctgataggattgttgggaaagttaaaacaggtgattataaagtgaggagggctatagacatagtatgtatttactactagcatgcaaaggatttagaagacctttaggctgttttcagccaaaaagacttagtgcacttcatgaaaatgttggccactttaggtaggcccaaaatgtgcatgtgtgtgtatgtgtgtgtgtacatattattcatagacctgtttataaagacttggattcagactcagagcagtttcctcatctacaaatcaaaggctataatttcctcatagcttatataagaaaatggatatattgaagctcatggcacagtgcctgacatgttggtatctctaaataatagtatcttttttagtttaagacttcctacatggaacacaggctggggtagcttcatatcactgttctaccattaattagctgcccatcctcttgggcaaattccttaactcttgacagattacttaacttgggaaaattacttaactttttgagcctcagtttgctcacgtagaatgaggatcatcaccaccaaactgggtgttatagtctgggtttgtatcctccaaatctcaagttgaaatttgctccccagtgttggaggtgaggcctaatggaaggtgtttgagccatggaggtggatccctcatgaacagattaatggggagtttgtgaattgtcaatctgttagttcccacaagagctggttgttgaaaaagcctggcatgtcctactccttgctcttgcttcctctcttaccaagtgatctctgcacacatcggctccccttgccttctgccatgaatggaagcagcctgaggttttcgccagatgtccaatcttctagccagcagaattatgagccaagtaaaccttctttataaataactcagtctcaggtattcttttatagcagcactaaatgaactactatgcttgctcatggttttgcttaaatataagcttgtatattaagtgtctagaatacaaagaataaaaaatagtttcattcccctctcctttctttgtctttcattgttggtgcagcattatcacagtcctgcttctgcagaatatgcttggggaagctggtctgctcttttgtgaggctttctcactaacatagagcaacattttaatttctcattcatcctagggaaggaagcttaaaaaacaaaggcaaatgaagtctcttgaagttaagtcactgatatgactatgcctattgtgcattttagagtaagttcttccaaaatgcatggaactaagctttttgctttttattctttgctcagtgcatggaaggctgaatcatttattagtattaatggataacagattaatgtccttttcctcacactggaagttgcctactctgccaggcagagaaatggttgagccaagtttggtgacctcagtgtgtgttgggagctccaaagcaagacacttcttccactgtgttctccagagagtgacagtacactctgggtgtccttttttaagtacatgacaagaagaagcatgctaacatcccaatagcacttcctaaatcttggcccaaaactctcagctgtaggtttcacagacatgtatttgtgtctttaaaggccaagagggagccacaagtgagcttgtgaataaagtttaaaagtcgcctttccagatgtggagccacagaaatgtcaacacaactatggtgaaaggtgccctcatagtcacatgccgagggatttgaggtagcaagcctggaagaatgaaaggcagattagtttgagtctctgcatctgttgcttgctgatctccgtttttaatttctcctaattagggagaaggtcaccctctcctagcgtaggacctggaatgtgcctttcgatgaaaagtttagctcatatatttccatgtcagaaaaactccatgttgtggaaaaactcatggctcaagaagatgcctaaatagctttgctgttcatacaaacagggctctgattttctttaaatgcaaatcaagtcaagctttcacgactgccaaaagccttattttgcaccttctctgtattcaaactgtgtgagatgccatgaaaatataaaccctagtccctgccttcagcaataccacagtctcatgtacaagttttatactttttacagaattcagtgcatgtgcaccaagcgccttccctgtgtgagctagcatgctaagtgctgtaaagttcaaacctaaatgatactttcctgcctaacatatcataccaaagtttagtgcttgaaacaaccaccattttatttgtttgtagtactgtgcgttagtaaatttgactgcactgaggtgagtagcccttctgtcagtctcagtctcagtctcacctgggatcactcatacaacttggcaacgtgggctgggtgattgaacgtggccttatgcacatgtttggcagttagtgttgggtgttggttgggctatgtgtctctgacaggttagcccaggctttttcatgcagagccagaaagcaatcctagtgtgcaagtgacttctaagtctctattttcatcctgttttctaacattcaatagactctgaacattcaatagagcaagttatgtagctaggtccagagtcaacgtgggaagagactatgccaaggtatgaatataggaggcaggattctttggtgaccatcactgtaacaaccactgaccctgacctaaataataagttattattttatttatttagtctctaatatgtgtctggtatggaagttgatgcttcacatatgctatttcattaaatatatatggtagttctccaaggtagatgttattattccagatattctgaagttagttaagttgcctaaggtcatacagagagtaaacagtcatgtcagaatatgtccatgtcagaaaaattctgtgttgtgagaaaactcatggctcaagatcaaaatgtctaaatatcttagctgctcatattaacactgaactgaataattccatgaactgtttttctctctactttgcattcagggtctacacagacctggactagcaaccattttgggaacagaagatgaagtatgaaattgtgtcaggcagataatggttatgtagcagttcagtgtgtgtaatatgaatgaccatttaaaatctccagaattaaattctagagattttaattagaccttcctacaaagtggaaagcatctgggctttggttataaaaagtgctaaagttcaaaatctggcaatgccacttttagtgtgtgattatttaaattttatgagcctcagtgacctcatttttaaagcagaaatacttttttaaggattcaataattccatgtgtgtaaaactctgtgcacagcattggtaactagacgaaatcaataaatggtgggcatgaatgatttggaaggaaaaaatagcagaggtaaaagggagggtatcttagacaaggggagcaatgctggaaggagggaaggctctgatagtagagaagacgttggcctctgtctgagcagtgagagctgccagtttgcagcagagatcaatagaaaatagcaacagttaggcaagataaagcccaaatttggagagctttgacatctgggcatctaggtagaggaggtaaatttgcccagctggaaaatggaaacctatggacttcctgagcacctgggagtaactaagatgttcatatgatttcaaatccagccatcctcagaacccagtttgttctcccattatccatgtttatcctcccagccaaacttttaatcagtgcagatgaagttctagattttagtcccacaagctcaataatttgagattcttcaaatgttgaggatgaggccaatagtggaatggaaagccacctctctcttctttgtgaatgaccaacctttggttcacaccatggatacacttatacatacagtcattatctttggaaaatgaatgttcttttctattgattgaatcttacagtgaagtaatggacagacagtgatgtgttaaagccaaccagtttgtgcatttctattgtgttgctagcttaaaatcatccttactggcagtatttacaccaaagaaattagcaaatactacaagtcaggaccttgtaccccaccattcctgaatgttctgttaaacatttaccagcacatcactagagctcagataatataaatgtgaagttgagctctatctggtagagcaggaaggagagttcccacctcggaaaaatgagtgtttcttttgagttacctcaaaacaaaacatcacacctatcaaatggctaaaattgtagagactgacaacagcaaatattgctgaggctatagagcaattaggactctcattaattggtgatgagaagataaaatagtaaaaccacttttaaaactctttgcctgttccttgtaaagtaaaacttacacctatcccaatgacctagcaattcgaatttaattacctaggggaaattaaaacttatatctacagggacacttatacaaaaatatttataacagccttaaaaaatagtcagaaaccatggcagggaaatggatgaacaatttggatctgtacatacaatgacacaccactcagcaataaaaaggaatgaatgactgatgcatgaaacaccatagaagacttgcaaaaatattgttacacaaaagaggctcaaaaagtaaatagtgatggttccatttacatgatttcaagaacaggcaagtccatctaatggtaattgaccgcaacattgggctacctctgtctggggtgtggggatggcattgactggcaaggagcctgagagaatgttctaggaaatattcacatttctgtaagattagtggttatacgggcaaacacatacttcaaaactcaaattgtaaacttgagatttatgcattttatgccacataaatattaccttgatttatgaaattaaggcctctattcttgaatgtaagatatgtctgtaattagcaattccttcattgtctatgcggcataataaccaagccactgggatcaagcagtctgcaccatgtacagctctgtgatttgggacaaggtatttcctctatgaatttcagtttcctcatctggaatgtaggaataatatattcatctgttgttcaaccaataattccatgtgccaattactatgtaaatggatgctgggagtacaatagtgaacacgacagagccttcctttccttcttgactcctgcctttttttttttttgagatggaatcttgctctgtcacccaggctggagtgcagtggcacaatctcggcttactgcaaactccgactccggggttcaagccattcttctgcctcagcctccccagtagaggggattacacgcacacaccaccatgcccagctaatttttgtctttttagtagagacagggtttcagcatgttggccaggctggtctcgaactcctgaactcgtgatccgcccgcctcgacctcccaaagtgctgggattacaggcttgagccaccgtgcctggccttgactcctaccttctaaagcttgcacctataggagtcacgtgctcgtaggggtgaagactatcactgatggaattctgtcccaaactgcagaacatatgccctatgtaaaggggacaacccctattctactttcactcaatcacgccacataggtgtgatggcacagtgatgtcagatctgatttttcaagagaatctggaaatactgattgtgaaagtttggcagttcattcatttttcccaaagcatattgcagaccaaatgcttaagcttgtgaccccttgcaaagtttattcatttatacacaattcattaataagtccctaaggtggatcaagcattgaggcaagccctggacattagtgaacaaaacagacaataagccctcccttgtagaggaggcagaacattagtaaataaacaagcaacacataatagagtatcaagaagaactaagtgccatggtgaaaaatatattaagttaaggggctactactgtagagagaatggccagaaatgatttctctggaaagatggcatttgagcagagacttgaatgaagtaagagagtgaaccatggacattgggtaagagacttacaggctgttaagagagcaagtacaaagatctaggggtggaggtgtgcccaggggagcagcaaagggctgcggagctggaatagactgagtaatagaaaatgaggagggcggggtgtggtggctcatgcctgtaatcccagcactttggggagctaaagcgggtggatcacaaggtcaagagatcgagaccatcctggacaacatgctgaaaccccatctctactaaaaatacaaaaattagctgggcgtggtggcatgcgccggtagtcccagctactcgggaggctgaggcaggagaatcatttggacccaggaggcagaggttgcagtgagcagagatcgcgccactgcactccagactggtgacagagagagactccgtctcaaaaaaaaaaaaaaaaagaggaaaagattggtggaaagtgaagctgttgggaccggatcatattgttagtgtgaaaggagataccgcaagaaaagacaactgacactcaataagtatacaaagaatgaaggaataaaaggcaaaggaaaattaattgtttcttctgttttgtgccataatatcacatttgtacatacttctcaaggacaccaatattaagaaatgtctattgaaaataagttataagaaaggtctcatcttaaagtcctttattgattaattagacatatatctcatcttaaagtcctttattgactaatcagacatattcccttttatgaatttcagtgaattttctagaatatcttattggcctgaacattagacagacctagcttttctagttataattgagtaagcatatttgatttcttttctttcagattttattatgccccaagattaagataaaagtgtgttttttaagtgaataaatatttatttttgtccaacagtggagcattggaaggagcaaggatttcatcgctgtttgtttccttatgagtaaaataggaatattcaaatgaacttgtgtgactgtgtgttaagcactcagtaaatattaagttattctgagtccctcaatttataggatttttcaaaattgttcagatggtcttgcagttttgctttctaggaatgtgagaggtttctaatttcaaccccagctaactcctgtgtccagtgtcctatttccccaggtatcagtagtactggtggtacttagtacttacagaggtcccttaagtctgatgatcctaatctgggcagtagtctttctcagagccttgtgggtagattgttaacacgcagctcaaaaaattctaagccagttacttatctctcttctaatcaacttcaagacttgggctgtgcaattttgtttcattatgaaatttgaagttacactgtcgaagtagagttagtgtcaatgtgcttagaatataccaaattcataaacattttctctaaaaaagtattaagcttaaaaagttaattcagtttaaggaatataaaccaaattattttatatttgaatctcaacataagaagtcaaaatgtaatgctgccagataacaatatcaaaggtatttttctttctctataatttcatcagtatgtcctctcccttttctcctatttgtcaaattttagcaaccctaactctgctaattataagctaggcaagtaatcttggacaagttatttgacctctcactgcaccagctttgttatctgtaaaatgatgataataccaacaccttcttcttggggtactgaagatgagagaacatgatatgtgtaaagtgccttccacaatacccagaacatagcaaacatgtaatgaatgtagtaatagtaattattttattttcttttgattcagttgggactatgttcagctgtaacagaatacccaaaataacagttttaaacaaattaaagttttgttgtgaagttttgttacgaattcagacaatccagggcttttatagatgcaccaggatcagcaggtacaaaggcatctttcctgatttctgccagtctcaatgcatgggttgcaatccagagtccaggatggcagttccagccctggttacgcccatattagcacacagaaagaaagagaaagggatgtgcctcttcactttaatcatagctcccactagatgcacccactacttctgctgatactccattagctaatgcttgcttacatggtcacacttagtttccagagagacatgtctggacagtcatgtgctcaattaatatccaagtgtccaattactgagaaaaaaagaaactagcacctttgcttggttgcattcttcttagcataagccacattctttttatgaagttgtcctcagttacttggatgcctcagttgtcctttcatttagaaatgctccttggacatcctgaatctgacttcttttgtcatcagcaccatcactaccactgccttcttcaaagccaccacgttctgtcccaggatggttgcaacaaccaccatagggactttttgcttctacttccacacaatagccagagtaagcttttgaaaatgtaggtcagatcatgtctctctcttctcttcaaaaccctccgatggcttttcatattactcaaaagaaaacctaaaactttgctgtgagatctatgtgacccggcttattcttcctcttactttatctctgtattgctcttcctcactctactccagccatcccacctccttgctgcttgtcctatactcctaaaagaagttcagtcttcccttatgatatttgcacttaaaatagaaaaaaaaaaaaaaaaaagctcagagaggctgagttgtccaaggtcatgcaggttagaagtcatggagctgggatctaaatccatgtcagtctgactatgagttctgcaccgttctattcaaccccattgcctagaggtgcttgattgctcaataatagattccatggacacagtcagctctttctgagaaaaggcagctcagcatttccatgagatccgcacatccttttgcagaagaaaacaatgtcttctaggttctctctctgctggaaccatcaggagcccttattctcaaccctgcagccttagaaaattaaaagcatcatcaggtctgaggtcggcacaggctaattggatcagccatcttcctttcatgaaccaaatgaaatgacactccttggacctcctcgggtccaataacttctgctgttattcatgcagaatcacctccatttggcacaggcagaattagatagagttcttactccattcactgagttgccttttttgctgatcattgcagttgatttaaaagaaacaaaaaggaatatgcttgctcttaatgactccttcatgtagatcaattattttacctggacaagtttcacttggcttcagagagtctgacatgccttgggaattatgtgagatctctcctccacacatatgtggattagtctgttcttacactgctataaagatactacctgagactgggtaatttataaacaaaggaggtttaattgactcacagttctgcatggctggggaggccttgggggacttacaatcaccacagaaggaataataggcaccttcttcacaaggcagaaggagagggtgtgggtgagtgaagggggaagagccctttacaaaaaccatccgatttcctgagaactcactcactgtcatgagaacagcgtgggggaaaccacccgcatgatccaatcacctcccaccaggtctctccctcaacacctggggattacaattggagatgaggtttggatggggagacagagccaaaccatatcaatatgtgtatgtgtttttcttctctttttcttcttttttttctttttgagatggagtcttgctctgtcaccaggctgaagtgcagtggtgagatctcgatctcagcccattgcaacctccacctcccaggttcaagggattctgctgcctcagcctcccgagtagctgagattacaggcacacggcaccacgcccagctaatttttgcatttttagtagagacagggtttcaccatgtcggccaggatggtctcaatctcttgacctcgtgatctgcttgccttggcctcccaaagtgctgggattacaggcgtgagccaccgcacccggcctgtgtgtgtttttcgagtgagaggatacacagccttcatctagttctcctaggcatctgccactccaaaaaaatgatgagaagtactggtcataaaaaattcctaagtcatttatttagcacagaacatacagactaagtgacatcacctccttttacttatgaaaacaaccccatgagttagtatattactacggtaatttcatagatgtgaaatctgaggtcagggagattcaattacttttatataacacacacaggatttaaccaggggaatcatgcttcaaacccagatctattatactcttaaaaatgtgccctctttttatattaatatatattttatcaaagcagcatatagacacacggttttaaaaaataaattgtgttttcaaataaaagttttcttctgctttctgcattgtctctttcttttgttcgttattttctccctgtttatttgtgtcagtttctctgttttgtattgggaactttgcctaattctggggattcctggtggtccccttaaacatatggtgctaacagctacttacaagctctgagtgtgatgaagcttttgcttagtggttctcaccaccgattgactgggtagccagtgagcatgttcactggaatcacccctgtgacagttcctagagttcttttttcctggatccttttcatttctccagagaagaacttactaacactctgcttagcatgagtaaggaagcaatgaggagttccagtgagggaggaggggagtgggtagggcatgtaagtgctctcacctgagaatgtaagtgttcttagcagaaccccaattaccaatcccgtgcttcacccatcttcttcagccacgcattcaagttctgagccttttgggggttctgtagtatacactggctcacttttctttggtattctttgctgcagggtgccgtgttgcaggtgtctccacttttaataaagataggagtatttctctattcaattaccatcttccaagaattcattgaatgatctcactcatcttacctcttccattccctttggctccttaagtcacactttttctgttacttctctatcatttcagataggatttttttaagtgcacgtggtcttgctgtaattctaaaatggaagtttctaggcttgctctttcctttatcactatactatctcccaatatctatcacatgataggtgtccaaactctgagagagatacaacaaaaacttacaggggattctgctgttaaatattttgtaatctagcactgatgaaactgtgctcatggactgtgtacctccaacacagacacacaatcacacatccaagaggaggggttacagattatgggctaaaaggaggtaactctcctaactagaggtatccagaaaagcacactggaggaggtggaaggaaatgtatttaagactagggaaacagcgtaagcaaaatcctaaaggcagagaagtgtaggggccagagaaaaaacagagtccatccgcttgacttgagtaaaggaatgcaggaatgtattgatacatgaatctggctgggcaccaggtggaggcgagccttgaaagtttgattagaagtttgagtattattttatcctaagacgatggtttgccacttacatcctgctaacagatggcataaagagcgtctgtaagaactgaggtggagcttctagaacgagaggattggagagcgaggagagcagatggaagcatcctggggaaagggaggaaatgcagctttgggactggaagggaaggaaatggtttggtggaagtgggaggtggaatgagagaaagattccagaaagagacaggaagtacaaaagtggcaacaaccaagagtcaaagaggagaaaaccagctgctcctttctgcctgatggccgttaggagataagaggatacgaaatcctgaaagggtcgggaggtctggcccaaccagtgtgtcatctggccagggcccaggtactggccactctgaggcttttccgtgaatctttgtgatcctccttgtttcttttcaaccctccagttgtcaaagcatagacatatgtgcaaaattttgaaataagaaaagcaagatcatgttgatcttgcagttctggcaaaatgtgaatattgaactgcgtgtagacaagagaattttcttgatctattcacattccacattacacacacacgtatgtatatttctgtttttccaaaataaggcctttttgacactaatttgcctagcaaatcttatgaactaaattgaaagccttgcaaagcctattgccaagcatctcagaattgtagtctttgcttaaccagttatccttgttctcatcctgttttgttttggtttggttttttagcttttccaagtatggtaggaaaattctgaatacgtttaagagcaaaaaaagagtagcatcttttcagatgcatcttagcacttatttctttcatcttgcatagctctacactcctttttaaaatctcaacctgtatccagcccttctgaattgcctcttattctgacactgtcctcctgctgtctctgcaatgctgccccgagtggagctgccttctctgctgatgagagagacgggtagtgccttcaaggagatatccatgaagcgcaacttgtgatctggattcttgtttcttggtgatggggttgtttttgtattttaccagcactcctttaagtgtggcaggatgtaatgatgaatagcaaataagaattttctgtgcaactggtttgcactttcttcagacttcaggttctcacgagggaatcttcctttacgttcctgtctctgaatcatgattatgattgagcttctacaccaatcaagcctagtttagtatttaatcaatctcaaattacccgccgagttgttgcagttcaaatgtcagtcttgatgcctcactaagctccttccatttgcatttaatataccttttcaattctttttctcctttattttccttttttttttgttctgccctttcccaaatgtttaagcttgttgaaaagagcagattttctcaagcatttgcagtcaaatgaataagctaataaatcataaatgggcttagaaagaggattttcccttttcacggtgtacattagagctaaggtttagcagttgttggaaacgcttgttgaagaactctgtctatcttataaaaccttttgcgggaggagcctggctcaccagagtgaggcagaaagaatttcaatgcactagaaagacaatgtcttttgcataacaatttaatccatccattcatttactggtgaatattcatattctggaggtagaaatttcaggatttacacattggtggaaataggaaatgtagatgagccccaggtaaggtaatatttatgtttttgttttaaatggccagaatctcttcaactgaatttcatttttgtccttttgcttttgtttacactgaaataaatatgacttggaaggttatagatgctgaactattgggactagaagttctctgaagactttcattctgtgacaattatgtgatttaaaatcaacctgtccaattatgattcgaatattgttttagtctcagtgttatagctatctcatctatctaatctatctatctctggatctatgtatctatctatatctatcatctttatctcctatctacatattagatagattaatatttctctatctagtctataatccattagtagattagatagatatatataacattagggctaaactaaatcaatattagtgatattaatttatacataaataatagaatatataatgataatatataatgaatatacatgacgtattatacatacataggcacatatatataaaattagtttcataggtgatttataaataaactatattttggtgctttaattgtattaaggcttcctagagaaaatgaaaattgctgtttattaaccattatgggaaagaatttgcctgtgtattgtatctcatatatcatttaattcctatgttcagtaacaacctcatgaagcagagagtgaagcccattgcccagaattcccaggccgtgctctggatgtttttctgtttcactagagaggccaaatgatgtcatttcatgaagtcccacctattgactggtttggctattggaaacattgtaaacctgggctcagtttaaaaaaaaaagagtggcctcacttacatgcaatgattgtggttccctccatctccctatatgaatagaattagagtctagaattagaagaaaaggagcacttttcttctttacccgcattatgtggccttgcaaagacccacatgaattacagactggatgtggccaatagatattcaaggtaccctgcttgccttggggattcaatgcactcagaaaggttagggtcttcaagtattcctcattctctgggtcattaacctggaaaaccctagcttctgtcttagaattgccattttggctataatttgttatttctggttaatctcttcactcagtaaatggcctatagatttagacacactgaggattcatattaggaataattggagctgtttattccaagttgttaacaggtctcattatactatgaaacaggtcgcttccttttgcctgtggtgtccttcccacattatatctgctaggtgagctactcatcattcagggtctctctttccagccaccccctccaggaaggctgcctccctcagatttcctaggcagtatctcagctaccactgcattgcaaatacttccctgttatcccacatgtatttactctgcatctaccatataccaggtactatttaggtaccattaacatgtatgacatcacagtgtaatgctttccttgttttatctctccctcatgtggctctaagcaggctgagatgctcactgtcttattcactttcctatccccagcaaccaggctcatgccaggacatggctggcactcaataaccatgtgttgagttaaggaaatccctgttcagtcttaaaagcatgggtgaacacccgtgttgtgggtaaattcttcagaaattggatggattaaagatgcctaaactttgccagtgaggagagtgtgtagaaccagggagtttaacagttatgaacatggactttggaactcaaacaaagttttgaccacataggtgtaggttcaaattccactttgcctcttggacaaagacacttaagtgaaaagcaaaatgaggatgataaaacctactacataagattgttatgtggattagatgagacaatgtttggacaggtctcagcacatagtactactgaatatgtggcattcattatttacagctttactgggttgtacaagcattcgtgccctgactttcatttgcagtatctcatgtactcatcccaacagctcgtcaagcaacttggccaaggcgtgtgggtggcatgtggtatgattaattttctaactcaagacttctaagtctaaaagctagtgatatttaacttgtactattctgctttgtatgaaagcacatttgtgtgcatacacacacacacacacatacacacacacaatctctcccctaataactcttattaatttttcatttgtgtctaaaaaccaaaggacggtggtctgccctccctcaaatggacatcccaaagtggcgaatggtagtgtcttacattctacgtgttgagcagtacttttattcctaaatttgcctgcctctgtggaatttgagtatagtatcactttgcagtgccgcacagtaacttgtgttgtgatgtggtgtttataaatagatgtaaatagttaacacttctttgaaaacgaatcaaatcctcacttatagcctttatcaaccagctggttcttgtaagcatcttcccggtctgtgtgcaaacattacttttaagtgatcagctggcataattaggtaagattgtacactagaagcacaattcagttttctcttcatcttggctggaagaagaaacaaacatcaggggtgatgatatgatggtaagttagatgtgggagatttttcctgcagctgcagtaccttgctaatcatcagagctagttatttatttatttctttttctgtttcagttcaaaggtatggctttgtggaacctcaggcagagaggtaattacgaagcctggtactatgggtgcaggcatcatcactggcacagaaagcagcttggctgtggttaagctttgtgttttattttctatctggatgttttcgcatttagtgctttctccttttaaaaaaaaatgtacttaaaactctcattgaagacttaaatcaggttcagggaaattgaatttaagacctggccagggatgggattggatgctgtgacttcagagacaagatgttgttaaatgggtaagaagatgttgagcaagaaaaccaacaaaacaaacttgatgaagtcaaaagaaagtgacttcttatctcgggataagaagaccaacattcaaacgttggctttggccattgggcaggtcactaaacctcctcacttgacttcatactctgatctgtaaaatgaggctttgtaaatcatccccagatgtattgactgcctgttgtgaatcaaattctatggtgacagtactgatgtgattcttacctcgtggagctcagctgcccaggaagacagacaaattgtgcttatatcaagtgtgctgtgaatcctggcaggaggagtgccggacatgatgagttagcagggctatgtagttattctcttcactgactctgcagctaggctatctagggtcacagccctcactgatttgatcagctgtgtgaacttgaggaaaacaccaacacctgcttaattggggtcctgcaagtattaagaatactaatagacatggaatatgtagactatctcctggcacatagtatgtgcttagtaaatactggttgttaatataagagcacgtggtcgggcacggtggtgcatgcctgtaatctcagcactttgggaggctgaggcgggtggatcacttgaggtcaggagttcaagaccagcctggccaacatggtgaaaccctgtgtctactaaaaatacaaaaaattagccgggcgtggtggcacgtgcctgtaatttccagctacttgggaggctgaggcacgagaatcacaccaggaggcagaggttgcagtgagccgagatcgtgccactgtagcactccagccagggcgaaagagcaagactctgtctcaaaaagaaaaataataataataatacaacagcacatgacagagaaaactaagattatgtagagagtatgggaagaccagacccctgagaggaaatatttaaactcagacctaaaaaaaattccgtggacactcttaaagacatcctccacttgacatactctctaggttagctgacatgctttctttcctctgtaaaacattgtttgtgccctaagcttatggccattagtcatgctatctctgctttaaccaatggtctattagcctacctactaccaggccattttatatcagataaaagaatatctactgtaaaaataatagttaatattcatggtggcagaccctagacacagatagcagctgagctgtacataggcaagtatatatgaattatctcagtcaacttttttttttttttaacaatcctagtaagccttcttttgatgtccattttacaaatgagaccttgaggtgataagctactaagtagcagagctaagatatgagtctaggtctctctggggctaagcctgctcagctgaaagctcttgggaaatttgttaggtggaaaaagtgagtgtgaacattccagaaaaagaaaactgttcaaaacctctaaactgagatgggttccaggagtccttccttccagctctcacgttcattatttaatcatagaggccactagtttcactgtagaaaatgaggcttagagaacctgggcgatttgcccagtggctttaccttataaattcctgattttttttttttttttttttttttgctttaatgttggaatggtttccattttcaggtaccaaggataaaattcaaatattccggccgggcgcggtggctcacgcctgtaatcccagcactttgggaggccgaggtgggcagatcacgagattaggagattgagaccatcctggctaacacggtgaatcctcgtctctactaaaaatacaaaaaaaaaaaattagctgggcgtggtggcgggcgcctgtagtcccagctactcgggaggctgaggcaggagaatggcgtgaacccgggaggtggagcttgcagtgagccgagatggcgccactgcactccagcctgggcgacagagcgagactccgtctccaaaaaaaaaaaaataaaaaaaaaattcaaatattccatgtagacggctagtggtttaagaggctatgagctcttttctacctttttgaaaaacaaaataaaaataacactcttgataccaaaacttgcactgaaactctcaggatagctagatcaatgcttcctttatgttaattgcttccaaaccttccctgtctttagattgagtgggaatgatgacggagcgagaaagcgagacaatttaacacggaagaaggtgccaaatgggtaaaatattttgcagaaaattagctccaactttgcacattctctactgtcaaaaaataatgagtatttttcttttatagctgtaaagcaattgatgagtggtcaatccatttaaaaattatcaactcataataaaaagttaaaaaaaactgtaaacatttagtatgtgataagaccattgccaatggaaatttgccatttagagaaattaggcttttggggagcggtgggggaaacatcccttataccattaaacattatcattctgatctttgtcctaaagtgactttaaaaataagattgaaatattgtcggaccattttgagtatgtactgtgcagaaaaattttactctattttccttctgttctctgtttttttttctctcaaaatttggaacaaaagggattagagttaaaagcatgaagaacaagctctttaaatgctgcatattcacatgaagagaaagcgtggtacacatgagcttctttacagagaacatgccaggcgtatttcctctggagcctctgccctaacaagttcactgccaggaaagctctgcccggtatggggctgactccttcctgccattcagatctcagcccaaatgtcacttccttcgatgttcccttgacctgcactgctgaagtcatcactgacggtttttccccctctataacacttatcacaatctgcagtgatcgtgttcctttgttttcttgttcctcccttgtcttccccctcagctaagctgtaaactccagggaacctgctcttgttcaccaataacaagagcagtgagcagtgcccaacagaaagtagatccccaataaatatttttgaataaatgaataataaaaagtgctttaaaaatactaaactacccccccatgaatgtattatcatgcaaaaattgaaatcagaaaagaaatttaaaagtctaagacgatatttggtcacatcatttctaaattttttgagtaaacaatatcttacattttccccaaaagtccatttgaactttattcctcatgtactatttacttgagtgccaatttctcacaattttagaaattaatattttgcagcataaagtacttctgcacgtagagcaaaaaatatatcatgcttgttggctgactacacaggaaagagtctgcattattttagatttgagaggagaaaaattacttggtcccacattctgaccaacagaatccagaggatcagagaaacaaggtcatccgcaatttatgttgactcttaatacttccaaataggtgcttgtcaacatttgtagaactgctgaatcatggaatttcagtgcaaaaggaaactgattcattcacctccttcagtccccaattccaacacttgaatccctagatcgctgctttaattttgcagatggtatcctctgagttaatttagcaatgtatgatattgctcacacttgtgttttaaaatattcccttgaggtttaatttctagacatcattatatttaataaaaattgaattgtgttacatctcaaattggaaggatggttctaatgctttttagagagtacaatttcattaaaaaaaaaatactgcttgaaatgaatacaaaatacatgacctgggtcttgggaatattttctgtgcagaaatttcttttttttttttttttttttcctgagtgcaggaaagtgaggttcagggagggttcttctttgaccaaaatctgacctaaagtactgaatgtttttggggtttgaataataaaatatgaactgataaatatgtcagatataacctaacaaatggccattttattcagggtcttgttcgaaatgaattagatatagcctctgttttatacaaaattatgatagaaattatgaatgttcccagaattatttcttttaatttagaaagaatcataaaaggtcacctagcccagtggccttcacacttttctatctgtaacctatagcaagaaatgcacttgtatgacatagacctgtacacacacacacacacacacacacacacacacacaagcaaccacaactgaaacgaaagattcacaagcagtactcattctttctgcatgagatgtactttactttctattactttgtttaaaaaatgttggctttgcctttatacaatacactgatttcaagtcacattcagaaaacaataatctggcccaaaccatttactctatagattggaagaccaaaatccagagagagcagcaacactgcctagctcatactaaattcaagtaaccctgtcttgaaattgagtgtgatagttaacatactgtctttatccccatcaatggtcctatacaataagaagaaactacagtttagtcaaagagaaaaaatatatacaacttccttcttggagctgaatccaggtgcttcattgggtagattctctaacctctttaagccttactgtacttattttttatagagggatttaaaccctcatcgtaacaagcctcaccatagccctggtaggtggtcattgagacaacaggaatgaaatgcctaacataattcctggctcacgttcttctattttacttataaaagaagtcaatgaaggaaaataaagaacaacaaatgatcaacaaattcaaaatattgtattttgactcaattgccagaatgttaactttctctataatacctggtgtggcagagtaggatgatcacagattcattgacagttctcccattgagaatgtggtccatttcccctctctttgcgttctgcctggagtggggctgtgttgggtaagaatgtgctgcaggctgtgaaagtgacacactgccagctctatctctagtctttaagtagactgatagctttcaccttgatccattggagtactgagccttgtgagaagtgtaaccaccctgctaaggaaccatgtggggagattgtggtactacacagagaaagagagaggttcagcagaggcccggccttccagttatcccctttgaggggccaggcatgtggagagtctcaaggactgtctaggtcagcccagccaccctcctcccatcaggctgagcgtcacctagtttaaacccatatgatgctacatggagcagagaatcacttagccaacccattgacccacctaattataaaatttaggaatataattgttgttttaggctaccaaaattttggggtaatttttttttaatttttttatgcaagaatagataaccagaaacactcaagttgttacaaatagttcaagtaagcagtttcctagaggcagcatgatacaaattctggagcaagactcacttgattgactccttgcgctcgatacttaattgatttatacctcagcttcctcatctttaaagtggagataattattatacccaccttatatgattactttgaggattaaagaaagtcaatactggtacacagaaagtacttagaacaggaccttccacatagaaagcactatgcaattattattattctacagcaaagaaatatatatttgaacactgacttagattacagctcagaggattgggttttactgctgttggattgtgagcagggctttgctctacattccaggtctcttgaaatctgacttgcaaaattaattcaaactggccttaggaatgaatatccccatggggcttaaaagagataaaaaattgtaaacaaagggcaaagagacaggacatttgtcagaatggcatttagtagcagggccactgttctttaacattagtgaggtggacaagaggttgagtagcacattaatcatatttgtgacatcaaatcatgcggaagactggggagaataggaattatatctctctatcaggagagagtaggaagtcgagctgggaaaatgaaacagtaagattaagtgtcgtaaagttcaagatttagaattagagccattgatacatcgatcctttacaaaaatatgttttgaagcattttagttgaacaaatatttactaagagtgcgttacatgcctggtattgtgctcaaaaatggcaacttctagcaactccttcacagggcctgttccccccacaaagagctcatggtcttgttggcgatgcaatactgaagccaataaaaataatacagggtggggggtgcaagaacagatataagtacagggcgcagatgacatacagatgagggactgaatgtttctacttaaggtggtatgcaccacaaaggatatgtagacaaaaagtttgaaaaactagagagagaaatgggaaattgagactatatatataaagacaaagaaataaaagactgcaagagaatgagatttggctgtgcccttcttgttgtgaaggacaaaaaagaaaacaggatgagttagaagctgttgtcagagaaaataagaactaaagtcaagtgtagtggctcacacctgtaatcccagcactttgggaagccaaggcgggcggatcgcttgaggtcaggagtttgagaccatcctggcaaacatggtgaaaccctgtctctactaaaaatacaaaaaaattagttggatgtggtggcaggcgcctgtagtctcagctacttgggaggctgaggtgggagaatcgcttgaaccctggaggcggaggttgcagtgagctgagatcgtgtaattgccctctagcctgggcaacagagtaaaactccatctcaaaaaaaaaaaaaaaaaaagaaagaaaaagaaaataagaactaaaaatgaagatataattgaagaaaagtgattcatgacaaaggcgtttttgaacttgggaaatgcattgctatgtgtttatatattgataagtaatatgtattaataccatggatatccacacatacagcatttgcatagcctttggaagtaataggattttttaattttttatcttttggagacagagtcttgctctgtcacccaggctggagtgccatggcgtgatcgctcactgcaacctccgcttccagggttcaagtaattctgctgcctcagcctctcaagtagctaggattacaggtgcccaccaccacacctggctaatttttgtatttttaatagagacagggtttcaccatgttggccaggctggtctcgaacttctgacctcagacgatccacccgcctcggcctcccaaagtgctgggattataggcatgagccaccgtgcctggcctgaagtaatatgattttaagccaaatatattagaactcttcatttgtttatttatttcctttcagtgaagatgatacaatggaaagaccacatgtcactgttctttcagagctgacagttcagctgagcaacaatcattaataaaataatcatgtcagcatacagtcacaactttgtcatcttacgagcagaaacctaggggagctgtgagagggggaactggaatctagtactgagagcttcttaaagggattcttccctaattcagagactttgtcttgagacttgaagagtgggttctgtaggtaggaagaggagaggtggaaaaggctgtaagacagactacagcctattcaaaggtcctgtagtcagaggatcttacaaatcagtgcttgtgaaaaatagaggattcactggaaagggtactagatttcaataaacaccacataaccttagatggaagtgtcttggatttactctagcttcaacagaaactcaggggtaattaagactccagtgaaatttggattgtgtaaaccttggatctaggagaaacaattaaaagaggctcttctatgtcctccacacacacctccccataccctgacaatgtcactagtttcagggatagtttagaggtagacttttaatctgaagtatttggcctggttaaaattgtgatcaacacagtattattatagctttcagctggaaaacctggttctaaatccagtgggattttacactgtcttcccaatggcaaacctgattaatgcaatgaaaaacacaatactttgccttggacttgcaattaaaaatgtttattaaagttcatgctctcctgctttgtgattattttcagagttgatgtgaacaaataagtaaattactgcatttgaatgatgtgaatacatagaattgtgtttccccaaatgctcttctccataaatcgggcattgtttattaaaaggaagatacttttgcttttgaatggagcactaatgtttttttcttccaacttctgcaagttcgaaaaagaaaggttgcaaatctcactctattttcaggacccaggaagttttgttgtttctccaaataactctgatttgcctgttttctgatgcctatcactttgtaccccctgattctagcactttgtcatatccccttttttaaaaactctcttaggtgcttataatcttttcatcctggtcatattccaaaccataatttctagcatagcagctggcaattgaaaagctctcaatatctctgttgatggacacattgtctatattgttgcatcagctagggctcttaagttgcagaaaacagaatgtgactcctgttaacttgagccagaacataaattattggaggattacaggggttgctcatataatgggcagggaggctgaagaatcaggcttgggggagttgggaacgagcagataggatttagcagcaaaaatgatttcatggttttattcaattgcagtctctagatggaaaccatttttttcttctgaacttgtgtcctgctattcaagattcaaagtcacaggagagagaatccaactgtctgaatctaggttctgctattgacacatggttgccctggaacagacgagtagccacaggactccctcagcttccgcgggtagcttggttcatttcccaacctggcctgtgcacactaagcaaaggtaattttccagaagcaaaatcacagggctgttagaaaaacagtatccctggccgggtgcggtggctcacgcctgtaatcccaacactttggaaggccgaggcgggcggatcacgaggtcaggagatcgagaccatcctggctaacaagtgaaaccccgtctctagtaaaaatacaaaaaattagccaggcgtggtggtgggcgcctgtagtcccagctactcgggaggctgaggcaggagaatggcctgaacctgggaggcagagcttgcagtgagccgagatcgcgccactgcactccagcctgggcgacagagccagactcctctcaaaaaaaaaaaaagaaaagaaaagaaaagaaaatcagtatccctgtgggtagcccctttacccgccaaagcccaaacgaacaaaacaaacagatatgtctattgcagatggaaataactccataattaatgaaattgagtttgttttggcctctaacttgctggtgagcttgggtgtgtcatcctctctggtcccctcactgtcttgcttattaaacttggtaactttgagttctctacctcaccagacagttggggggactgtagaagataatgtatctaagagtgttttgtaaatgaaaaatatcatataaatgcagaatactcttacagatttttgtgcaggaggtgtttgatgaatggaattgagaggttgactcctctcttgagtgttgaagctccagaaaacatataaaggtgactttctctcatttgcatcaagtattctaaagataataataatattgtctcgtatttactgagtattcactatgcattgggctctcattgaagacttcttctatgtcctactcacttaatccccacaaaaaccctattgttagttaaatgctatgaatagtcttatcatacaaatgagtaaactgaggctgggcacagtggctcacacctgtaattccagcactttgggaggctgaggcaggtgaatctcctgatgccaggagttctagaccagactgaccaacatggcgaaaccccatctctactgaaattacaaaaattagccaggcatggtagtcccagctactagggaggttgaggcacgagaattgcttaaacctggcaaggggaaggttgcagtgagctgagatcgtgccactgcactccagcctgggtgacagagcaagaccctgtctcaaaaaagaaaaaaaaaagagtaaactgaggcacgcctgcttcaaaagtgtctgtcatcaacatctttctctagctctgtgtcccattggtaatatttaaatgttaatttttgttttttcgccatcttagaagattaatgaggaaatgttggcataatatttagcgtttcttggaagaaagcttctggtgaatacaattatcgttgtgcattttcataataatgaaatatcacactatttttatattcttgttctctttaattaatctttccagtcccatcacaatcaacttattttctaaagccaaagactttggagtagttaacctttctgttttctcctaagtttaaatacacacacacacacacacacacacacacacacatatatttaatacacagatatatatatatatatatatatatatatatataatttcattgattccagcctcaagtatttatcacttttgcttttgttttccctgagggtcagagctgtagggctgaaagatattaaaccctgcgtcagagaagagtggtatctcccccggtggacagatgaccttatcagatttgaatttaggggaacaaaacaagcaaccgtatgttaaaactttaactactactacagaattaatatctgtgcctcttagatcataatgagcccttcctgtgttaagagaaaaaggaaaggagggagaaagtaatctagaaagaatttccccttgatatcttgtcactcacccaaatggctggtgataattggacattggagacagtggtaagatcagacaggctgtcacttccttaagaagctgcatctctgacaatggagtgtcagtcattgtctccagatgccgaagctctatgctttgctaatatcaatgtgctaaacctcaattatcagaaaatacagtgagaaattataaaggacgggatagaagacttcatccaggtaatagagtgcaagatatcttatttgtgataaatgtaaatttccctgtagccaaatagagataaagatttgatggggcaggattgaaggcttagaagacaaataatggaaaaaaatatttggaaaaatgtccacaatcctataaatgagctctgataattttgttaaccagaacaatataatagtccttctgtctgtatagtcagtcttccaagtctaagaaagtgctttctagtatcaaatatacatgtgcatatcctggcttcactctttttaccagcatttactaaccgcatttttatagtagtcttccccaatggagaacgtaatgttttacagcagagatagagataagttgacacgtgtgtctgtattgtaataggaacaaaatagttattctactaaattcaattaatatgtttaagggggagcagatatacatttggggttagataaactacatttacagtgtaacacaattccacagaaatgacagattaaatgatcattgtagaaaatcgggtctagtaaatgccctttccctaaaaggtttatttcaagttgaatgagtataccacagagaattgaagtttagtccaagtttagtcatagcaatatgtgaatacttgattaaaaccaatatagtagaataattcaaaggtggttctatccagtgtaagaatcctaatcaatctgacagaaagcatcaactgagtaaatatactaagtgaggtatctgcttggtattttgggtgaattaaccatgggacatagcaatgagaccacatgtgactcctgattagtgctcaataagtgtttgcaaaatgaaaggaaatataaacccagataccctgaaggtacagtgtgcaaagcacatcccatgaatcagttcacttaatccttttaacaaacctgtgctgtaactcaggggtccttaacccccgggccatagactgataccggcgttagattgtcaaaggagtgcaaacgctattatggactgcacatgcaaggaatctagattgtgtgctccttatgagaacctaatgtctgatgatctgaggtggaacagtttcaccctgaatccacccaccaccccccaccagtctgtggaaaaattgtcttccacaaaacctgtccctggtgccaaaaatgttggggactgttgctataactgattattcttacactaagaatgagtagactgaaaagtttaagactgagaggttacactcttaatggaaggtaataatattggaatttgaaccccagctcaattcctgtttggggtgttcatagaccccctggatcttccgtgaacccccctgaaaacctttttctgatttgataactgttcgtctttctaagggcggtattaatagttttcatcaacttttcaaataagatccataaccatgaatttgaaccccagttcaattcctgtttggggtgttcatagaccccctggatcttccatgaacctctctgaaaaccttttactgatttgatagctgttcatctttctaaggacagtattaatagctttttcatcatcttttcaaatagatccatcacaactacccttatcttccctcaaatttaagaagctcatatacaattgaaaaactgagatttagccataacaaaatagaaaacataaacagataaattaataaagttcaacatagataatgtgtgattaggtgtctggaatgaggtagagtttgagattgtagggacccccgtgggtaggatgattttggagggtttcttttaggaagatgcatttgagatgggtcatgttgaaggatattgctgtacatgtgtcatggaactgggtgccagacttgtgcaccgtgactggactcttcctccctcccctctccctttatagtagcatttgacagcaaggaagaattaattaccacacatttccctctgcctagagctgattacctgcaaggctgctccatgaacattaggctgagaacagcaaggaaaatgccatttggaagcattccactcagaacggatgtccagctgctcatttagatcatgaactgtttgtcaatactgacaattagtgggctaaagattgcattgaccacatgaaaagaatcaatatgtgcagtacttgttagttatttaccgccgagtgtattaaagcctgtagatttcttataaatccttcaaagccatcctgctatgatccactcgacaacatgcattgacacatcaataaatccttttgacaaggatgatctgtgaaaatcaataccagtttatcagcgagtcccatgtagttccgttttttttttgtttgtttgttttgttttgttttgtacaggccagcagaagtttaagatcattttcccaaaggaagggaaccaacatggtttaggtacaaaacttgtagtcactgtatgcctagaagcactgacattgattaaagtcctttgctcaaagaatcttcgtaaatcctataagggacagaaatccactccctgatacatagtggtaactgcagccacctttaagagtgaagtgtggagtcaaaggtcttagtgtatagtaattgtgcctgcatctgcccagtctttaactcttctctatctcaagaaagctcgagaccataccggcagattctcaccctcagtcctggacagcctttagcattgacacctgtttgttgaactgatttgctttacatttttttaccatatgagcttaattgaatatttgtgttaagcaaaaataccataattgagcttatatacaaaagtaatgtattaggatagtgatagctgctgtaacaaacaaacctcacaatgtcaatatctgttatgtagcatctggtcaatgtagctgtttctggacagtgagtgattttcctctacataatgattcaggggcccaggctcttttcaattgtagctctgccatctcctaagatttaggggatcttagactttcagcctgaggaagtagaaaaagagagtagagatacatgcccatgtttaaaaattcagatctagaaatgacatataattcttaggcttatattcctttggtaagaacttaaaacagggccacaaaatgcaaaagggactttcagagtagttcctttagaagggcagctacctgtcagtgacaatcccattcatgcaaggggaccacagattttcggtggagagctagccataaatgtacaccaggacccgctatttactgctgtactaatgcgtgtaatacagatatgcaaaacactgttctgatacttcaccaagttttctagcaaatgtggaaaacagtccatctgtcccaaactagcagaacttggacaggttttctttctgtcactagtgtttctggtaagcacactacaaaacaataacctttatttctctaggcatccatggacctcggcttttggtagaaaagtaagctgctaaatcaaaactgtctcaagtctctcctttgaatcttccattagcagcagcagttaagcagttttaaggtatattgaaagataaagggttcataatcatctcatgttttctctttaaaaaatccctcaaaacacaacaaaaacctcaaaggagtcaactgcactaaactttcaggctccccagcctccactggtcattactaaaatctgcctgaagctccatttgtctgagggcatttttgctatcttccttctttctgacttataagaaagtctctgctgaacagccatgtctgtgtcttgctgaaactaataaaatcatatctatcactctcttggggagctctgtctagagttgcatttgagatccaaagacaatgagaagctcctcctggcatgttgctataattaaagattccagagttttccagaggggcgtatcggaagagagacgtccactgtaagattattgaattttctgctttcctttcctttttttccttctttttttcctttttaatgattcaacacactatattgagtgtgtaaaggtgtacattctctcatacttttttttcctagcatagaagctcctttgacatatgaaattgggaaaagaaagaaattctttggggaaagcctaccttcacctgttgtaccttctccttatttaaatatttaaattctaacagaaaattccccgttggtaagagatacacttcctaagtactctttagttttttgccctgtttagaaatctttgacaatttctcatgtgccaaggctggaagaggaatgaatatttggaaggatagatgcaaatcaagactgggtttagggctagagaaagttgatcttttgtgtcttagcttttagccatcacagcttctccatatacaatgtttaaagggtacaccagggcaggaagggcttgtgtttctccacaactgacttggccatgaaagatctggtgggttttctgcagtatagcaaatgaaatagctcattagctgtaagcagccaatgatcttttgtgattcaccaacagctgctattcctcagggaaatttatgccaggcaaggctggaacagtaagagagcaagaagaaaggggacatgtaaaacaagggaagaatgagtgaaaacatgcttcacagccttacagaaaacacagttctgtttctcacacacacaggtttttcattgtattccatccttgtttataggctatttttagcatccagcattattcctggttagaagaatgactttggttattatccataattaattaaggccatatggctcttgaaatattctacttatgaatataataataattgcaataagatcattactgttaacatctttcaagtcatgatcacattcagttctaaccctgtgaagtacacaaggcaggaatttacaacccattctccagatgagatggcgatgaaattatacatatatcttaggattggctttcagaggcaataacttgaaacagggccacaaacacatgtaagagggacttgtcaatgtgtcccaggatgggactgatcagctccaaaaaccagttttcttggttcccaaaccgtggctttttctatcaaggagatttgaaacgcaaaaatactactaataatgtgtatatagcatttttctaagtcctttttgtgtattatctcacttgattttccaaacaatgctatgagataggctgtgttattagcactattgtgtagatgagaaaatgagaacaagaagaggtgaagtagcttgccctcagtgacacagctgggaagacgaggagctgggaatacaacccaggcagtctgtccacagagcttactcctaagttgcatgcaacatttccactcaaccctaaacagccatacatcccaatatttggggaagattcttgaaggtgtcccatggccttgaagatctgggattcagatcagaaacatgttagcctttctgagtcctgaatgaactcctgcaaaagtagtttttcagatatgtggaaaaaaattgcccacaaagcagctcctctgcaactgcctgctcacttaatggcagggctccttctacctccagcttcattgattgccagtgtccacttgtccctttcagtgcactggattcagaccagccccatgggcatttattggtaactttcatctgctgtgggctgagtgcccaccatgggccagtcactgagctggatctctggagaacacaaagaaagatacaccccactcttcattcttaagaaaatcagagtttcatggggaaagaaagaggtgtaatcaggtaattacaagatccacagtaagtgctagaacagaggaatatgcagttctggctgtgcggagtcaaagaaggtagaatgttaattggctgctcaggaactgaaatcaaacagatttgggttcaagtcatggccatcagttggtacctggaagatgttaggaaacttactttccttcactgttactcagtttcctatccaagcacatgaagatgctaattctgtttccctgggaggaaatatggtgagaattatatgagagatctccatatgaaaccaatcacatagtaagtgtttggtaaaggtaatgatagcagtgataaccatcctgacagcttcatggaggctgtgacacttcaggacagcctatggttttcagtcagagaagagagggtgcctgagagcagagagaagaaaattctcatgccagaaatcagcatgtgcaagccacaggataatttctccccatggcacagtcctgagaatactgtcaggcaataggctccacctgccttttctctctgcaggtttttcctactctagttgattctacatgcagtcagaggaatcatctttcgtccctgtaattgctatcctggcattttctctcctgagaacaaggtagtggttcccaattgcctcttgaatcagctggaatcaaattgatcacaggcttcaagccttccctcatacccatcagcttcacctcatctctcatctctctccataccctggattttctctctactccaatcaagaaagtggaccatgagcctgtgcattgttctccacctcttcctccccaggagacactggacaccctgaataagcatttgacaacatttctaaagtggatgtgtgtgctgtgattttaaagtgataaatgtgttgaagcctattaggtagaatttatctgttcataaaccaatgactttggcccagataaacacttgctgatatagaaatgagtttgttgacttacccagcatttaaaaatatttgaagtccacattatggaccgaatgctttcatcccttccaaattcataggttgatgtcccaatccctaatgtgaatggtacttgaagttggggactctgggaggtaattagggtcagataacatgggagcgaggccttcatgatagaattagtgtctttagaagaagagatgccagaggtctctctacccttctctctctctccatctccctctctctcctttctcttcctctctctctcttttcccctctctctccatctctcctccctcctctttgctgtatgaatacacagagagaaggtggatgtctacaagcaaggaagagagccctcactggaacctaaccacactggcaccccaattttggatttccagcatccagaatatgataaataaatttcttttgcttaagccaaaatactacccagtctattgcactttgttatggtggccaaggcagacatatattcaactttatagcttttagccaaaaacaagaagaaaaaaaatgagaaatcagcaaaaaataaataattaaacctagcaaatatctagctctcctcccaaatggcaacagttgcctcaagctgagtagaagctgccctttttccattgaaagctccagtttgccacagtcctcaccaattcctgttacctctctctgctatatttggtaagctgtgtctgtgcattgcctgaaagacaagtatagtcatatgagctttatattctgctttagagtcgccctttcttccttgggaacaaaacttcattgaagaccaaccattgctgtgttgcacaaatcaaacacaataaagtagcatatatgtatttataattaaaaaaattatgtcaagatacaggggacaatttagaagagttaatttccccttaattgtcattttgcatctcatttacccctaggcagaggcccttccaaattttgtttgtttctgtctttttctctctgttttaccccctttctatgtattaatatatatgtgtatatgtaatataaacacaaaatctaattgtataaaaatatgtacctagccaggagtcccagctacctgggaggctgagcccatgagtttgaggttgcagtgagccatgattgtgccactgcactccagcctgggacatagagtgagactctctcttaaagaaaaaaagtatctgttttttcaatttacacatttacatggatcaattaaaaaaactttctctaaactttcttcagcatgcaatcaacaattatattctaagagtactcaatcaagtgatgaaataaaattacagtcttcagaaatctgattcctgcagtaacatcaacaatacttaaaggtaaaaacctgtaggcccattattctcaaaacctggctgatttgaaagctatttcagttccatattagttatatattttttaaaaagtaaaataacaacaataagcattacttaagcaattcctctgtgcttgacattgtgctaagttgttctcttcatcttatgaacaaacctaaaataagtacgactatttccattttacagatgagaaaaccaagacacactgagattcagcaacaatgaaaataaagcacagaattgtaactcagatttttttccactagcccaattcttattccatttttgttatatttctcatgatatatggttgaaaaattgttggtcatatgtgaagctgtaataaatgcatttttttctcatcaattgttagcaatttggtgagtgcacaggcttaataaaatttgtgctgctttgatttaattttaaaataagaacaaactttgccctgtggtcaagtcttcctttataaattgaactctggaccatttttcttaaatgatataaatttatacttgtttttctccaattcccaagcaaatactcctacaaagtttttatgaagttgcaattcacgtaggaagtcagcatccttctaatttcttaacagcagcaatgttttctatctgattccccaaaaactgatgacttcagtgatttgagtcaatgacttgatataggcttaaagacttttaaactgaaaaaaaatggtaggagatgggttagcggtaaaagaaaccaacaaactagggtcagtgagttctaaatctaaatttagtgatattcgcccaatgcacaaataagctatgccatccttaatgtagtccaacagggagggtctttacagtagaatattactgcatcaaacaatctccctattatgccaactctgtagcctttcttctaagccatgagtttaaaaaatgctctcaggagacagcggtcgaggggtctctggctccagtgacagccccctgaatgtcctgaggttcagcttgaatctcagggaaggacacaagggtgggtcctatttcacactcttccagcctagaggatttttctcttaaaacttggtctgaaattaatgatcctggtcgtcaggagctaatacgagcccttagagcctctcacataaactccacagttggtgtcccaagcctgcctcagttccattggcccccatgattcaattatctcccactgggtccctcccacaacacgtgggaattatgggagctaaaattcaagataagatttgggtggggacacagtcaaaccatatcagtcacataggcctgtggaggagtaaataagagaatccacatcaagcacttagcatttagctctggttctcttctagtgtttcttttaatcccttttgtgtctcttcaaacagacctaacttgtttcctgaaaggtgaacatgagagtcagcaatgagatgcagctctctagcaagaagttctgatgggacatacaccccagcgccatccataggagttcttccccaggaaggaacacacccacatcctcactccaggctgcttgtttggcctctttttctgggattgcttttgctggcagattttgttcattcatatgaggaacagggaaaggaaataatagctggtgaacaacaaagaagcaatagacaatcagcagtgactgctgcccctgaggcggggtgggtcttgttagaagagtctaggagggatggagcctgcagacatttgtctcagttcactttcaccacaaagaggatgggcgtccactcactgtggagatggggcagttggtgatggggatgggtggggctaatgcttactgacacttggagcccttccctacacattatttcgctaattcacctgtgcaaggctatcaagtgaataactttgacaaatggaaaccacagcctccagagtaagcacactttggaaagagagagctaaaactcaggttgtcctttggggaatcctcaggagttagaggattctggaattccatgggtgttttcaaatgataactaaaggtagagatgggacagtccattcaaaaatgattcactagtttgcctctttcctgaaagcaccttttccaaactcattggcttttctccaggtatgggtgggtgggggtcaagcatatatttattctttcttccttttaaataaagattgtctattatttttggaaagactataaaacactgaaatttttggtagatctgttcaattttataattcgatttcataggaagagtgatgaacattattatgttgcactattgaataatgtaatcattaagtctgtgtggttaaacgaaaggaaatcattggatgatagtgaatcagtacttgggggagatgggtgactcagtgacttgttccccaaagtgttttcctaagaaaatgtctacagtatgagtctgcttgccctctttcccgtatttcttatcccttcaatttccttctcctctgggtataagtggtcctattatacttccagtttcatttattcattcagcaagttttttttgagtctcactgtgtaccacaccctctgatggaggtggaaatgcataagtaaataaactaaagcaaatttcgatccctatcctaacgacgtgcagtctaatgtctacagacaattaaacaataattgcaacacaatgagaaaagtgctgtggttcatgaagcccaggggcttaagagcttacaggatgggcttccatctaaaccaaacagaactgaagacgggttggagggagccccattctgagggggtgggaaagttcctgaaatgccaaagacctggtggtaaaacagcactgcccaaggcaagcttgccaaccaagatggggagctttgacttcatcctcagggtcatgcatccgaagtatggggacagtgtcccatggggagtgagaagatcagatttatgttttagaaatgtcttccggccgggcgcggtggctcacgcctgtaatcccaccacgctgggaggccgaggcgggtggatcatgaggtgaggagatcgagaccatcctggctaacacggtgaaaccctgtctctagtaaaaatacaaaaagttagccgggcgttggtggcgggcgcctgtagtcccagctacttgggaggctgaggcaggagaatggcgtgaacctgggaggcggagctggcagtgagccgagattgcgccactgcactccagcctgggcgacagagcgagactccgtctcaaaaaaacaaaacaaaaacaaaaacaaagaaacgtcttctattcctctctatccagttcattttatatgactccctatcaccccacaaccacttaggcacagtcttcatctttgacttcctttcagggtcactgtgcagagaaaaatgacaaactgtcaacggatgattgtttataaaaggtaaattaacaaatcttctaaaatgaacacatgtcaaatattttttaacccagtaactaatgaaagaactggtaagatgttacaagcaattgaaaggagaattccaaggaccctaagtttatatgcactaaaagaatggtgaaataggtttataaacagatgcagagactggtctgttcacagggcaataatcaactcgatacaaataatgcatgtctacacacaagaattatttacattattatcagttttatggagttgctgaatagctcaaagacaacatatggtggagataacccagatggacaggacacccttgaatcttttttgcccatttgaaagcttttcacatttttttttttcctgacagtaaggtaaagaaatatgtgtctagggttctggaaatctatatttgtttcccagctccgccactctcgtttgagctttcccgtcccggacctcagtcttttcctttttatctactcatatactgggcctcggtatataataccatttgaacaaagcaaaaaataactattgaaaaaataacttacactatatgtagggttgccaggtttcccaaataaaaacatgagatgcctggggaaattggaatttcagataaatatcaaatactttttttagtataagtatgtcaaaaatattgcatcggacatacttatactggaaaagtattataagtttttttctgaaattccaatttaactgagcatcctgtatttcatctggtaaaccctaactatatgccaagtgttaagcaaaaggtgtagctgtgtattacaagaatccagaaaggtcaattcgagaagactcaggaaccctgagactgcatttcccatgcttttgcctttgttcttgttcaatcataaatcctctatacatgtgaggggagaaatcaaattcaatacaaaactggggcacagattacaggttggcaggaacctaagttcctgaaggaaaggaaaggatggggcaagagcccgtggagagaatcctttccttcttcctattcaatgtttgcaggtgataggctctgacaagtatttgtcactggcagaggaaactgggcatggggcttatatcccgtgagtgactcctctggccctagaaaatagttccatctctaagtgggttacctactatgtgtctgtttgaggccagcaggtgcctcaggcaccatgttcagtgtttgggagttcacagcacattgtgagttggggagacttctttctagatcctccagacttttacaggattgcatcattcatgttggagagctttgcatgttcttttttttcttaactgcgtagatggctgacagatgaaaaccccagtcacgagccgggcgcggtggctcatgcctgtaatcccaacacttcgggaggccgaggagggcggatcacgaggtcaggagatcaagaccatcctggctaacacggtgaaacccggtctctactaaaaatacaaaaaaaaattagccgggtgtggtggcgggcgcctgtagtcccagctactcaggaggctgaggcaggagaatggcgtgaacccgggaggcggagtttgcagtgagccaagatcgcgccactgcactccagcctgggcaacaaagcaagtctccatctcaaaaaataaataaataaataaaaagaaaaccccagtcatgctgaataagcactgctgaatctctgtcacttgaggtgactgaaaattacagagtccagctttcgaggctagagccaaagaaagaaaagttgtaggaagtcttccacgttgtagggaggtgagctgaacatttcaggggcagattctgttcttacagagaaggccaagtagagaatgttccactggttactggcctttaggagatgtgtgagggaagagggaggtggggggcattttcagctttagcacaggtggcctgtctaccaagactttctgggaggtggcagtcactagccaggaaggtgcttctcaaattacaaagtagataacaattgattttgttggtgtgtttccatgcatttattttttctcttatttcttggaaagtcttctctctcctggattctcagggtcctattgctgctttccaagatcctaagtcatgtcctcagctttaggcttcctccaagatggacttgatcccatagttatccagttgtgtgacctggagcaagttacttgaactcacttctttccctataacatgatagctgggaactacttcatataataatattcacaatgcagagaaaggacacatggaaagccctcaaaaagtcattttgagggtcatatagattgaggaatattcatttatataaacacattgaattctcacaataaccctgtgaactaagtggcatcattaatcccatttttcagctaaggaaaccaaagcacaattaaataaaataatttgcctaagattatacagcttttttttttttttttttcgagacagagtcttgctctgtcgcccaggctggagtgcagtggcatgatcttggctcactgcaacctctgccttctggattcaagcaattctcctgcctcagcctcccaagtagctggggctacaggtggatgtcaccatgcctggctaatttttgtatttttagtagagacagggtttcaccatgttggccaggctggtctcaaactcctgaccttgtgatccgctcacctcggcctcctaaaatgctgggattacaggggagagccaccatgcccagccttgattatacagctcttaagtagtgatggtcataggtgagcagggagtctggctcacgggataaagttattaaccacgaagctcagagcctctctaataaatgttagctattattattatcattcctaactattctagagaaccctaggacccgagaatgtaacagctattcagttctttagtcatattaatttgggaatactcaaaatgtctcagcatattaaagcatttgagaagtcagatagtaaagacatcatttattttttttaagtagactttttactttagaatgcttttagatttacataagaattgcaatgacggtagagagaattctcatgtatgctgtgcccattttccccagctgtcaagatcttacgttagtatgatcttagtctgatcttagtatgatccttagtttgtcaaaactaatgaaccaatattaatacattacagttgacccttgaacaatgggtttgaactgcatgggtttacttacacctgcatttttttcagccaaaggcggatcaaaaatacgcatgtgtgagatgaaaagccctcatacagggcgggctgaccttttcgtctatgtggttcctcagggttgactgcaggacttgaggattttggtcaatgcaggggtcctgaaaccaattctctgcatataccaaggaaccactgtattattagctaaactccacactttattcagatttcttcagttttttcataatattttcaggcttccctgcacaataccacgttgcatttggtcatcatgtctctatagggtctttttgcttggaacaatttctcagacttttcttatgtttgttaaccatgaatgttttaagaagtgctggttaggtatttggcagaatgtccctccctttgggcgtgtctgctgttcttctcatgattagacaggggtgatgggttttggggacaaagactaccaaagtacagtgccattctcatcacatcctatgaaaggcacatgttaccaacatggcttattagtgacgatgttaagcttgatcacctggctgacttagtatttgtcaggtttctccaccacatgattactcttttttcatgtttccttaccatactctttggaaggaagtcactaagcccaagcccaagcttaaggggtagggaggctccatctccttgcaaggggggtgtctacataaatcacttgtgattcttctgcatgggaaatgtgtctcatctcttccatttatttattcaaccatgtatgtatatcagcatggattcatggatgtcagtattgtacattgagttataatccagtactatgttatttatcttgttattcaaatttttccacttttggtcactcattgctactgaggtgttgttgctttcagactctctcagcagtgagagtttagaaacatatgtgtgtatactaatgccatttaatgttttgttttgttttgtttgagacagagtgctcactttgttgcccaggctggagtgcaggggcacgatcttggctcactgcaaccttcgtcttcttggcccaaggaatcctcccaccttaacctccccagtagctaggaccacacgacaccaccatgacgggctaattttttttttgtagagatgggatttcaccatgttgcccagactggtctcacactcctggactcaagagatctgcccacctcagcctcccaaagtgctgggattataggcgtgaaccaccgcgccggctcatttaatgtttataagcaaatgtttcccaaatttctttgacttcggggacctccttccctctcagtaccccaaacattggttaacacacctcagaaggttaatattccatgggatccaatttgctaagtgggactatagcaatagcatttgtctatctcaattttaacaatagaaagtattagtaacagtagctacaattataataggtaccgtttagcgactatctattatgtactggtcctacaggttaaggtggtgggggagactcctgagtcctcattctcaagggattcggagtctagtgaaagacaaacaaattacagatcagtgtcataagtgatttgctggagataaaggcctccattcatggtattgttcatgcctgaataactgcctgtctttctgccttcctctttcctctctctggtgcattacccaaggtgagctagagtgaaccacctcaaatgctgttaaggaagtatctctctcctttggaaacccttcaagggtttcctgttgacctcaagataaagcccagcaggactaggactagagggagaccagcaagacacctcaggacaaatgttaggaagggcttgctcagatgcaaccttgcacttgcacgttcctggcagtgagcgcatccttagattgtgcccagatttcttttggtgacttacaaggccttttatgattgggtctctgtaatatggactctttaactgccgtctccaccacaggctctctttctgcagccacatctgacatgcttctcttccccaggctctctcttcacagcaaggtccaggtgtttctggaagaatcttctcctcttcatctgaccaattcctactctttctgccagtcttgggtaaaggttatgtgctccgggaagatttccctgtcctcaactcaggctctccatcgagatcctattttcaagcatgtcttccccgctcctagcgccctctactggcctagagaggcactgattctattgattgtctactaggttgtgtctttcctgcctggattttcgctcactgtttaatttccactgcctggcacgtggccatgagtgctcaatactgtcaggttgagtaaatgaacacatgattgtatgtgggaatgaactcagactgaacatcaggaaaggcttccaggagcaggtgatgcttaagttaaatcaaaaaggaaagatgaagcttcagtaaggctgagaactttaataataggttgaaccccatccaaaattgtcatttatgtaaacaacaaatggttgagtgttcataagcatcaacctaataataggtaacatcattgaatatttagtgtgttatgctctttaaatgtatcaatttattattgatgctattaaccccatgggataaatacttctattatttacatttgaaaaatgaagagattgaggtacagagaaggtgagtaacagacccaaagtcacacagctcaataacaaagccagagctccagcctaggtcatccactctggaactcagaacccttggcctgcatcatgaaagcaaggacagggaaggtataagaagatgagacgtgcatttttcatagagatctgttgcacagattgaaggtacagtgatagctgaggaggagctgcagtcatcttgaggtggtcatcctaatatcattacatggtttcttttagccacctgttcccttagccaagataccccctgacttccacctcctgtcaactaaggcaccttcaggatatagaatatagcctggcattttagggggtgtaaaccaaatcatctcagctctgccccagggtgtcagccccatgctgcctaacccatatatttgagctgcttgttgtgggctttaaggtcgttagtaagctccaagaaggccctgttttgataagagagagcagtgctgtcccctttgggcacggcccttcccctggaaggatgcaaacagattttgaatatgtaatactaactgaaagaggcagtatggcttaatgacctttagctggtaaatctaagacattaccgagaggggtaggaaaggagctgcaggtcccagataagtgctttaattgcaccaataaccccatgtagttttccaaggcctcagtttcaatatctgtaaaatggggatagagcctgcctgtctcattacattctggtccctcttaactttcatgttcacttatggttcttaccacatcatggttcagattgatgttctatacagctgtgctccaaatacattttgggttttatatttcctaccccagtggagtgacttagactgcagggagaggttacaaagaggaatcattaaaaagcccttagtaataattggtgaaatatttacatgacagatttagatttattcaggtgattttattcctgaacaaaacactgctttttgtatgtataaatggctgcttaaaagacaaaaaccctttaacatgagaaaaaacacatcttgggtaaagacctgcacgattaaaaataagaagcttcaaatggcaacctgggagctgatggtttgacggtttgggcttcagatggaattccacctatggaaccctccaaacctttaagtataattaagcacaaaataccacctgaaggaacactggagattagacataaacccacagaagccagaaaattcaggtcaccagcctcattctgccctggttagagggtgctttgatgctgttctctccctgggggtcaggagctgcatataatctcctaaacgataaggaccaaaaaaagggcacaaaagcttgaattaaaggcaacgcgtataccaattttcagctgcttcccttttgtcagctgaaggaagcctatagattctatttagcacacttagaaatgaagtttcctgatttggaaaatcaaacgtttaagctgtacaaagaaaatagccaccttcaacctctacttatataacctgaaatcctgtacaatatactccaaccaagggggtccatttctttggggccctgctccttttcttttgggtttgaagagggcttgggattgttgaacttgctcaacatcacacagcaagaatggagcagagctgggatttgaacccccaaattgatgtttatttctacaacagtatgctgaaaacattttgaaaagtgcctttataaaatgtatcatgatgttccttcctccttcctcttgttaaagcttcctgtaagaattttcataattcctgcctgtaagtcactgagcaaaaaggactgtttaactgcagacaggagccgaggagaggccagggacatggataactgggaggaatggcagcttttcacatttatctgtccagattggcagggtaatgtctatgggctctttgctctccccataaccatgatgcatctttcgaaaaggaagagaagttgctcagaaggagcagttagataattggttgtggagaggaggacttagcagacagcaacaggtatcaactctgtgacactttcatctacattagaaggtgaaataggtcttaaaaaactatcctgtgtgatacaattacatggtgagagaaataaaatctcatggctgagactgaagtcagatcaaatttaaagcacaggtaattaaagagacaaatcagtatctatcttataggcttgtcatgaggattgaatatttgtaaaacactttaaacacagtctggcacacagtaagaatataagtattcagaaagtaacatttcatgggtcgccctgttgtccagactaaaatatgaatctaaggatagagagctcatattcctattacacagtaagtgctcaacaaagtttagtggataaaaaacttaggttaacactaatgatctcacaatatgtgaaatcctcaaatccacacccattttgtttctcatcaagtgtgtacatgttagggtattggaagtataaaacactgcaaaatcaagattatgagactgttcaactcctctccttcaaaattgagagtttatctacgtaagtcactaaaaacattaaggggatcaggaagtatcacataataaaaaaatgtttggagcttcaagctttccccatgtaaataggtaccaccatttcacacagctctctgaagtgctcaagttgctgaaatgaatgtacagaagttatcttgtttctggagattataggtaaacattttatgatacctgaagggtcaattcgtaatcttcaataaagtgctggtttcttcgtgcaagcctcccagcctcctttacaaaatcaaaaacaagagaggtactacagcaaattacctgattagctatctttcaaaattaaattggttctgatctggatgttgtcaaaaaaaatatctaaagcctggggaagattacagtgtttgtaaatcaaaagcagctgcttctatttgtaatggctgtctttcttttttttttttttttctgagccagagtctcgctctgttgcccgggctggagtgctgaggcatgacctcagctcactgcaacctccgcctcccccgttcaagcaattctcctgcctcagcctcccgagtagctgggattacaggtgctcacgaccatgcccagctaatatttgtatttttagtagagtcggggtttcaccatgttggccaggctggtctcgaactcctgacctcatgatccacccaccttggcctctcaaagtgctgggattacaggtgtgagtcaccccgcccagccgtttttgttgttgttgttgttgttgttttggttttgtaagcctgatttgacaatccccttttaggtttgagttcacaacaaatatgaaaactaagcaaagcattaaagcacaaagaacaggctttgtcatggaaatcctaaaatgctcttagctgttgcaggagtgtgagatgttggcttgggcatcagtagagaaagctaacctggtagttgataatgacaagtagttatgtaagtagattttctgagccaggcagttgggcttttctagaaaatagaagttgctgagcaaaaagggtgtgaagaaagggcctggtgtgcctgtatgtatagctctcatccacacagcctaagtcctggattgcctactgaagtctctactcaggataccacaatttaacagtttcacacattgctttgggttttaggcaatttttttttctttctggttcatacctgaaagtaactttttgcaagagcattaaacttaactctgggttacctggaagaagaactggaaatctcagatgactcacatttcctgtgctgtaactccaggattttcaaacatctgacactttcatcccggttatcgaggaaataatatgttagctccgtcagactgctttgaatggtcatgcattgcttaacgacaaggatacgttctgaaaaacgcatccttaggtgatcttgttgttatgcaaacgtcatggagtgtacgtacacaaacctaggtggtatgtacatttttatttatatatttttttcctatggaaaaccaaatgttccagcactattactgaatatcaatcatttcctctactcatgctgcattgctgatatctagtgccatgtatcaggtttctatatttgcttcaatagaaccttataggaccactgtcacataggcagtctgttgttgactgaaatgtccttatatggtgcatgaccgtattatgttctggggtagaaacaaaactttgagggcatgcagacctgagtttgaatcctgccttcctgccttaagagttttgccatgctggctaaactcatcagcctcttggagtctcgatttgtaaaatgcaactagtaaatgctgtcaggaaagacttccttcctataagcactcagtgtctggtatttagtgggtgctttaatcactggctactgttattcattgtagacctttcaaaagggtatacagggacaacatggcattaaaagtcacctactgtgtgtccttgagcagataactaaaactctctgagccttgactttcttgtctatagaatggggataaccacacccatctcatagggtttttgtttgtttgtttttgttttgaggtggagtcttgctgtgtcacccaggctagagtgcagtggcgctatctctgctacgtgcaacctccacctcccaggttcaagtgattctcctgcctcagcctctcgagtagctgggactacaggcgtatgccatcacacccagctaattttttgtattttttagtacagatggggtttcaccatattggccaggatggtctcaaactcctgaccttaagtgatctgctcgccttggcctccgaaagtgctgggattacaggcatgagccactgcacctggccatatagggttttaagaaagattaaatgaaatattcggtgagtgtctggaacatagtaagcagtgagtaaatggacaaatggtagttgtgttattttcattattgttgtttgcagctacaactgccaatgaaaaactaaatcacaaacttcctctagatggtcccgttcactttactcgttacattggtttcagagcatccaaagtttgagcttctttctttgtttcttctctcactctccttctagaatgtaggttcatgaggtcagggaaccttgtttgtctggttcactgcattttcctccatctcctagttcaacatctgactcatcgtaggcctttgataaatatttgtcatggaaatgaatgaatgagtagacactttaggcagaaccccattttctctctcccacttgggtccgtggatcactgtggagtagctctccagcatctgcctggtgtctgatggctctgccatatgcatcatccttccagtagattctctccacctcctggcatcttctcaggccacctctttccgctgcctgctccccctcccccaaccagtgtgtgctcagggaatgcaaactaatttaaccaaagccaaacataattaggagagtaaatctgctgctactgctgctgctagagcagcagaaaaaaaaaccccatagcatgcattccaaaatgaaatccggtctgggggctttggggagcccctactgtaagtgtaatggccctgctgcagtgggctgctggcttccccagtaggctggacaggaaggagttaattgcacagtagtacccttttgcttccaggagtataaggaggcagggtaacacccatcttataaagttgcctgttcttggggctcactattaatgtcattcgacgcaaggcagttccaaaaccaaactcacttctttcctaccttccttcttgtcttcattcattcattggttagtttgttttttcatctaccagtgctcacccttctgctatcatgctgggtactgtgctgagtattagaatcactgcagagggcagaagctggtccagggcatccccataggggttgggatggcttggggcccacaccttttagaagaccagtctgggatctaaagtgtctctcagtttctcttggtttcgctcagacacttgaatggattctaccccattactctcccaggaacaggagggattagcatttgaagaatcagcatagcaagtattttcttttcacttcaattttatgttgccaagggttgcttgaggtggggaagcttgatgcagatgacacagggcatccccttcccatcaccacccccaaagtccctcttgagccaccccttggcatccggcactggcagtgagcaaagcataccttgccctgtggagagcggaggctcctgttaatagaatggtctggagcttcttagctactcttgccgtaggtgaaaggctattgagaaagctcttgggattttcttaaagccagatatcttgatcgccaactcgcagcccaatgcccagccctcagcactatacagggaatgcccatctggcagagaggggggggaggatcgacttctgcagccaggaagaaagagagtggccaggcacatgcaccccaagcttggtttcatttattcctataggaagaaagagagtggtcaggcacatgtaccccaaacttggtttcatttattcttaagtagtgggaagcaaatctgaatttgggtcctgacttccctttctagtaacaatatttacaatattttgagtgtctgcagtgtccatgtgctttgttaaactcactagctatgaaatcctgccaaatccttagggcagtcctacaagacactaaaaagtgttcccactttctgagtaacaaaatcaataggaagtgcaccatatgccttctaagtggtagaactggggtttgaaggaagttttgccccctaatatgctgttgtaacaccctatgttttgcttatagttcatcttgttgcacccccactcttttttttctgagatggagtttcactcagtcacccagactggagtgcagtggcgtgatcacagctcactgcaaccgtagcctcctgggttcaagtgattctcttgcctcagcctcccgagtagctgggattacaggcgcatgccaccacgcctggcgaattttttgtatttttagtagagatgaagtttcaccatgttgaccaggctggtctcgaactcctgacctcgggtgatatgcccaccttggcctcccaaaatgctgggattacaggagtgagccaccgtgcccagtgaattgcaccctatttttgttacctatttattattggcattcctccataggctgtagactttttgaggcaggattgcatcttgatggttctctatagatcctcaactggtagcataatctttgacacagcatagctgttcaatacgtgtttattgagtggaaaagggaacacctaaataaatgcctcttcagcacctgctactttttccctcttttgcagccaaaaaaacaaaacaaaacaaaaaaacctctcaaactattttagagggaagctttttatttccattttgtgactgactttatttagatatcaacaataggttcccccttccagcaccctaaaacttcaggggagatggaaatcatctcacagatgggatagggaccctgaggaggccagaagaaaggtgtactgtgtctaactccaccggtggtagggttcacaaaagattcgggaatagagtgtgcagggcttagggcctggtttggtgagggaagagagacaggtgcctctggtttctgacaaggcatatgtatttttccccaaacaataatgtttaggcatttgaagagctctcagttgttctaagtctcttatattgacactgagaggttggcaaaagagaaaacaataaggggaccctggtagcccaatcccactccctttcctagcccctaatgtctgtgccaactatgtgactcttagaatatactcttgctagtttctctgtttgaatatgtgtttatgtgtgtgtatccattcagatacaggaaaactgaaaaactatgcagggtaggaccagtttgcattcccaggctccagtttctcagtacacaagagagtcacagttagtaaagatgtactgggagatcccaaagtgccaggcagagttctaggcacagggctgcagcagtgagcacaacagctgaaatcttctgcttccttgagttcacattctagttgaaatgagacagacaataaacaaataaacagacagcagatgctcaaaagttttgtggttgataacgatgccgactacagcatttgccagctctgctaatgagtctccctggaaacttgagtggttgataagaggattaagaacctagaaaagtcttactggtagatcggctgacttatgagttacagagcctgtggatcatggtggatataggattctgtcagttacattctggctgagaagaaattcaattaaaatatatatgtttaaactttcttcttaaggtatttgttccagaaatcagagctcccttttagtggttgttaatatcaggaaatgaatatctgattacatttttctaaggcgagtcccttagcagcaggcagagtctcatctcatcgtatcttctgcataattcattttggggagagtctcttgagttttgctttcaaaacttaaggaggaaaatgaagctggtttgagggtcataagagtttttaacctttctggataagcaaaaatacctaatgtgattccaggaacggaccctgaaatgtgaatttcttgagaagtggtagagaagataagccttctaagtaggaaggctaggtgattctctgattggtgtggatgtgggtcgaggggagcaggcagacttaggagtgtgagcctgccagccagccagcaaatatgttgtccatgccaccctgtctatctgccatgcatttctcaggaaccacttctcatgcttgactagagcttattatcacagaaacattacagaacattgttttctctgctttcacccgatgcggctgctgcccggccattgcagccacggtaggcgatgctgccacattacattttggcctgtttacggagtcggaatgggcacttgcaactgctcattacagtgatgcatccgtcctcaccatgaagccttgtgtttctcagcagagcatgaccacgtctcccagggaatatggccctttcctcctttgttctagactggcctgaagttgaacttggacccaggaagtgattgagaaaaggctggcattggttggtgcctgcttcagtctctgctaggatgcaattgtggcctggggtgttccaaactgttggatggaggcatgtttatcatgctgacagacattttctttgtgtcacgtttagttctttgggtcaccgagagaatttcccagaggatttcttccaggcttttaagaaaaaggatttatttttacaaaattgggattattaaatatacgtacatacacacatacctatataaataacttgatattatttttctttcgtttactattataagcatgccattaataacaatgaaaaaaaaactgttcttcaattatagagcaacacccactcattgtaataatctaggtgctgtgggagaatggagggtatttaagggtggcagagcaaaggggtgtcgacagtctacacccagggagcagagcaccagtgagctaggaaacgattgttttctgacattatggttatttttagggagaataaaaccagatgcagagtgcatagggtatataatggagagaggatagagttgttgggaggcggaagaaggagagagtggtgggctaccatggcaggctaggattagaccccagaaaggcctgaatggaatgctgaggaatttgaactttcttctccagataaaggattccactctagactttgatgacttgataaagtgagcagaggtagacttaaggaaattcacagcattcttggttcacacagctttggccacctctgcctctgaagctatttctaggtcctgaaccattgctctttatggaggggaagaggaaaaatatctgaggttcttcacaagagactctcatgcttgggaccagcctctgagcccctgggaagagatggtgtttcctattgcctgctaaggaaatgtgcacattcttatttaatttttatactaaattttcaaggtggaattaccagccccagtctacagatgaggaaacagaggtgtagaggttcctactacagaagcagaatgaggtgcagagagtggctttggacttccaggagcttggttggccttgtagctctgacaagctccgcatggatgtccttggacaagtcagttcacctctctgaagaggagaatttgtttcctatgtggatcacttttgcctatgtgccccagggtgccatgaggcttacatgagatgaaacgctgattattttaaaaattctttaaaaattctttttaaaatcacacaaaaagttagcaagcaaagggaaccactggcagcagggtcaatgcactatgcaaaacagatactaattctgtataatctgattcttgtccagtcatcttaaatgaaggctaaaagtgattcttcagtaataaagggaattacaattcctacatgattgtagaagcttggagagcaattctagcacaaagcaagcaattatacattgcaacaaaataaaaacttttttaaaaaggcaaaaggggggaaaaggaaaccaaaaaccactcaaatccctttagaaacactatttaataatgcaaactctcttttccatagaattccaatcaaggggcactttggccatgaggaagcaattaggaacatctatgatttaatgaaaatgtaaaaaaccaagggcaaagaaaacaaccatgtaacaagagtctacttctcatatccctgccaccaaactgcaggacacagtacagctgcaaggcttataccactgatggctaatatcagccagagacatgatctccataagccagctctgccttgtctttttgctagaatgcaaagaaaatgatgctttaaacaaagcaagagccaggcatgaatggcaccaagtgaggacaacctccgtgggtggccattcaggccttctgtgatttaatgaggagaaaatgcaaggtctggctttgctctcttgggccttggtgagaacatgcatccttccttatgcaggatttggccatccatggggctcccccttcctgaccataaacatctactgtaattttaattgtaaacaacgttccttgcaacagtaaagtataaatcactcttctatgacttggagctcttccggcctcagacaatgaagcagggtcaatctgtcctgctgacatcatcccatacccctaggcccctgcttctcgttcataagccttctttctgttttctaagcactttgtactaacttatgcttcgggtcttggcactagctgtcctgctgcctgtacgcctcaaattcttcacatctttgaagacatgagtcttattatttgggtctcagctcaaatgtcatctcctggagagagagaggtctttcccagcaccatttaactaaagtaaatccagttactctaagtattattctattttattttttttcaagtacttctcattgtctaaagttatctacaccaataatacacccacatgtttgtctactggacttatctgcccccttcctctactccccctctagataacaaggttcaagaaaacagaattttgtcttcttatttatcactgtgttcccatctcctagcacagttcctagcatagagtaggcacttaataatatcagtagaatgaataaataaaatgctaacttgcttggggtttgtgagtctttggaaagactgtgttggtcaagaagtatttattttgctgggcgtggtggctcacgcctgtaatgccaacactttgggaggccgaggcaggaggatcacaaggtcaggagattgagacaatcgtggctaatatggtgaaaccccgtctctactaaaaatacaaaaacttagctgggtgtggtggcacacacctgtaataccagctacctgggaggctgaggcaggagaatcacctgaacctgggaggtggaggttttagtgaaccaagatcgtgccactgcactccagcctgggagacagagcaagactccgtctcaaaaaaaaaaaaaaaagtatttattttattcattccttctttcaacatttgttgagcgccaagtatattccaggagctggagaaagagcagtgaattagatctgatttctgcccacaaggaattcagagtggagatggagagaaagagaaggaagcagcattgcggcctgatgtgagatgagcacgtcatggtacgaaggcttagccagcgcttgacatggtaatgatacctggcctgcggtttggaatagtatggaattcagtggtcctcacagttaagtaagtgggcaaattgtttcctaggctgccctaacaagtcaccacacactggtggcttgaaaataacagaaattcactctctcgcagttctggagtctagaaatcagcagccttggttccttctgagaactttgaggaagaatctgtcccatgtgtttctcatggattttggtggcaccccttggcttgtagatgtgacactccaacctttacctccatctttacatggtgggcttgggggtctctctctgcttcttattttaaggacaccagtcattgaattaggaaccacccttatcttaacctattaatctgcaaggaccctattttcaaattaggtcacattccgagattccaggcagacatgaattataggggagggggcaggtgacaccattcaatcgagcacagttggctacaccttactcttattctgaaaaagatacttaactttgatgagcatcagtgttctgagggatttagtatgactctccactgagcatttgggtgcatcagagtatgaggagtgacccacataattctccccatgatctactccatctacttggggaagaggagcaaagtaggttagtggctggctggtaatcctcctcactgttcgtgccttctgtcctccagactccctcagctgagggctcgtactcatctgctctgactttattttctaactcaaagtctgatctgtgtcccaccaaagcatatgcccagttaagtgctcctccttggagttactctgtgaagactcattctcaagtacaacagagcagctaaagaaactgccgcgcatgacagctgccttcacttctgtgtggcccttaagatcctagccccacatcctttgctgcccactcttatgcctcagcctggcttctgatctgtggcatccctattctgtttcattcttctgaggcttccctccaaatcacagttgggccacagtcttagctcttcttagtaatgggaaccaaagtccctgaagtcaaaatagaggaccagaaccatggaaagagtcaattaatctatttaaaagagaggtgcttagccacctccaggcaaccctaaaccccagagatgcccagaaggattcaaaacatggggttcagtggaaagatgacaaacatgagaatccaacagcccggagtccaagtctaagccctaaactttattagacatctcactgtggataaattgcttaaccttccaagaagctattgcctcactgacatcaattcttaccatttagttaatgtactcattaaattttaaaaagtaataaagcatttagcccaatttgagacacgtggaatgtgtgttcatgaaatgttttttgagttgtacaaaaaaaaaaaaaattgaaatacccaacacagagcgaataaacttgtaaaattgagagaaaatactggattgggatctggagagaaaggctgtcatttccactgatacacaaatacagcgtctccttggcttgcattcttcaagtaaccttaatgttacctcctctggtggccttgtggagccacctatatctaacaggaatcatcttggccaggtgcggtggatcacacctgaaatcccatcactttgggaggctgaggcagccggatcacttgaggtcaggagttcaagaccagtctggccaacatggtgaaactccatcagtaccaaaaatacaaaaattagctgggtgtggtggcaggcgcctataatctcagctactggggaggctaaggccagagaattgcttgaacctgggaggcggaggttgcagtgagctgagatcacaccactgcattccagcctgggcgacagagtgagactccatctcaaaaaaataataaaataaaaaaaattagaaatcatctcacttctgtgtagtctcagtccattttcctcataccaattcttactagtaataatttttttggttttattcacttgtgtgtttattgtttgtcacctgctctaaattttgagctgcataaggtttttttctaaactctattcccagcatgtgtgacagggaagtctacttgatgaaagttgttaaatgagtgaacaagtaagtaaataaacccagttagagcaaatagagatgctgccatattttcacattttaacagtttcaaaaaaacaaatacagaaaagaaagaagatcttgcattttggagaagaaaatgaaaaaagtcaaaaataatttcaaattatatttctacttgcaattataatagcaagttaagaatgatgagaccttgcatgtcatctccagtgggcacccagctgatgcctggaacacttggacagcagcactgcattcagtcaactgaactgaccatggggaaggggaaaactaacttgccctattcatccatttcctttgactactcagcattagggctggtttaccacttgacagccctaaacgttagtctcttttaaaaaatgtccttcaaatatatgaggacgcagccatgtctcctatggcccttcattttctccaggttactcacctcgtgtcttcccactccttcccaagaggcagagttgtatgtttcaggtcttctcattggccaaggtggcaggtggggctaacagcagagccacttaacttgccacctagtctcgttctgaagtgaataccaagtgtgaatggaaaagatctgcaggcagacccaggccatgcatgcttcgaaagcgcacttagtttctcataaagccataaaaggttttagatgacattttgcttcaaaaaagacagattcttaaatgagggcaatttcaaggagatcagacatcctgtggtgcacttagcgggggaaagcaaattgcataaacattgctcatctgagcagcggtgaggcgtcctgccagtggtggtggcacaagttcaaatcccaggctcccaaagccaagttctgcggaggctcccctccagctcagtgcccccaacagctttatggccaggctaagtcattcattcccccatgtttcctagaacaaaagaacacaagagagaagtaaagtgaggtttgtgaaaacaatgcatttgtctcgaaattgtccttttctaagttatagggagacaatgagataggaatgaaagaacattggcctgggaatcagatgttcttggtctaatattagaactggaagggcccttaaaccagagctagttcagttctctaactttacatccaaggatattgaaacttaggttaactttgttatatatttgtctatgtgatcttgagcaagttgctaagcttttctagcctcagttcccaatctgtaaaatggagatgatgacaacattatctacccttaaataattgtgatgattaaaccatatgggataatgcatgtcatgtgcctgagagagagaaaacacttcaaaatggcgagctaatattgtttttctatcaacaggtagtaattgggcttctgctgtgtatcaaactctgctccaaataatgaggatacaacaagaaatgaacactgaccttgtcttcttgaaggctgagggggaagacagacataaaaacacaaactcacaaacactcttgatggtggttgtgataagcggagagatggtggcagtggtagtggggaggtaaggtgaggacaaggtagggcgggcagggagcctctgcaggtgttgactagtagaaatgaaccagactgggaattatgcagaaagttttatatagagaggagtttcgtagacatgatatagctcatgaggaagcagcatatttgtcttgcatgcgtgtgtgcgtatgattgtgtgtgtgtgttgcatgaggagtggtttgatggtcctcaaagggaacagttgattgttcttggagacattcccaagacaagtctgagagctaacattcagatgtcagaccttaaagcattcatgcatggagaaggcctctttgccgtcagttttcagatcaaatatgtgtgcccaataaggactactgatggagaatataaagttgaggtatgctgagagctggcaaccaggtagtgtcatagaagtagaaacgcagggctctgggagcagcggtgtgaactgtcctgaggtggagagggatgggggaggaaggcagggcagggacaagattgaaaaggaaagctacaccagcaataaatcccagtcaggcgttggtaagcttccaagagaaagaaaagaaagtgatagctaatatttgtttattaagagtgctatgaatcaagactaacagagttactgatcatgctctgtgtcacagccctgttctaagcactctgcacatatgatctcatttgatcttgacaataaacccaggcagatgtgattgctgtccccattttacagatggggaaaccgaggccagaagagagaaggaatttactcaaagtcacacaggtattaaggagtggagattacttggtctcatcacaggagggacctagaactctaaattgatcatgacacatgcctgcttaaagcctttctatgatatcccattgcttgtaggaaaagaacccacatcttgtttggctttgcaaggtcctgcatgggggttcaagccctggcgcttccccagcttcatcttcagcctcccaccgccagcttccaatgcctggatgagcatcttcctttcagtcccttaaaggcatcacagttcttcaatctcagggctgttgtacttgctgtttcctcatgtcggctgaccaaatcctctcatgcctcggctctcggttgaaatgttgcactaacaggaaaccatttctcacctcccagaccatgagggtgcccatcctctcccctaacaccgtatgctccaccctcacgtcattcatcccaggtgtaatttgatcatcgtcgagaggatatttgatgtcagttgcctgtgggagggggctaggctattcctgttcaccctctacttccagtgcctgcacagaatccttctaaatccctgtctggctccctccctcccattcttcaggattttattctaaatgagtggtgctcaaactgggacaattttgtccgcctgacccaaggacatctggcaatgtctggagacatttttggttgtcacaactgaagggggtgttattggcctctagtgggcagagggcagagatgctgctgaacaccctagaaggcacaggacaccccgcagtgaagacctggatagctctaaatgtttgcgatgctgaggttgagaagcccagctctaaagagacgttccctgcagggccttctgtggttatcccatgtaaattttacttctccttccccactcccgtatttcatgtcctcattttctgctttactgcttttctgctgtacacttaatgctatctaataaatgacatatttcattcatctttttcattatttgtcatccgctagtatacagggtcttcaaggacgtggatttgtgtcttttttgttcactacatcatcactaaatcctagaagagtgtctcgcgcaaagtaggcgctcactgcatatttctgaatgcacgaatgaattcagagtcctaggtaactacccccattccatcaaagaggccccttggggttgaaatccatttgccatccctatggagactgtccttggactttggaagagatggaatttagagatttcttcttttatatcctttggttgtgatgttgtctccactttagccatcactaagatcccccaaaaatgttttcactgaaggcaagagtggggaaagtgggcaggttctctcagtaaacaacaaattcctaaagcagtgagtgttctggtaggacctctttggaaggacccttggaattgtccttatatttgacagatggggaaaccaaggtccaagcacaccctgtaaggacattttgaacactgacgattttttgatttggacttacttaaggtcacccatcaaagaagtatcaggaacagaatcagaacccagtttcctgactcccagggagatggaagggggaaagcgaaaagttctgctgatctaaatatggatgctggcaggcaagccacaattttctaaagctctcttttctcttgcaagttgtgatctctagttgacaaggaagcaaattgaatagctaaatggagagctttctgagatgctgagatgcaaattagcctgaacaatgtgcaactgtggatttgaggttggtgtgcaaaatagaggcttcgcttcagtcagtctgcttgaaaaactcactctgataggtccttgctcttttgcagccagacactatgccaggcactaggggtacaggaaaaattaaacaccgatcctgcccttgaggagtttgcagtctcatttctcatgagggagacagacagtggagggcatgctgtttttaatccaacaaagaggcactgatactgtgagtgtccgtgctttgtcaactgtgtgtcaggacccggctaattggatcatgcatttcctgagaatagggaaacccatcttgaatgtcactgacaaccatagtaataatgatggataacaattgttgatgcttactgcattccaggcactgttctaagcactttaatttatcagttaatttaattctcatagtagcactatgaggtagctacacttattattaccattttttacagtgaaggcagatgagactgagtaacttttccaaagcaacagagcaaagaataatgtcattgatgtctagacccaggtcctctggcagcaaggtgtgtaggctgtatttgtaagatgcattatggatatatattatttaatatccacagcaactctggctttgggaccgtctctgccacttaataactgtgtcctttgttgggcatttactctgttccagtcactggtccatgtattatatagcttaatcctcacaattaagagtgaggtataatgatatccattttataaataatgaaacagagggacaaagagctttggtaatttgtctgagatcacacaggtaataaaagccaggattctggacattttgtgtaaatgaaatcacccaatatatggccttttgtgtctggcttctctcattgccatagtgttttgaggcacatgttatacacagcatgcatctgaattttctttcgtttattacttctagtgtaccattgtctgaagataccacattttgtttatctgttcattagttgatagacatttggagtgtttccatttcttggctgtagtgaacaatgaagctatgagcatttatgcatgcatgtatgtaaccttttattactaggtattttcccacagtcccctgtctcttgctcacacacacacatgcacacacaaacacaaagaggagttcaaagggaagagttctgaggccagattatatgactttgatcactgactccaaactgtaccagctgtgtgactctgagaaaattaagtaacctttctgagctttggttttcttcacctgtaaaataaggataataattcacctctctgatagtgtctttcaaaggcttgacttagataatgcacgttgtttggctcataattacacaatcagtaagtgccaggtaagcaacaagaatacagaaaacaacccaaagaagatggtgactccatccatgcagtgcacagtctaattgctgggacataaaaggataagaactgggcataatgtaaaataaaataaaaacataatattacaggaatagtcaccatgaggttcccattaattttttaaaaaaacgcatatctcagtctagaaaataaagacttttctgcaggttggaaggtgtgagaggcgttaggatcaaggcaggacaggatggaagccttgaggaatgaacaagggatggttgagaaagtgtgggagaatgcgtggaatgagggcattgcatcggactagttacccttttttttttttttttttttttttgagacggagtctcactctgttgccaggctggagtgcaatggcgtgatcttggctcactgcaacctctgcctccctggttcaagcaattctcctgcctcagccccccgagtagctgggattataggcatgcgccagcacgcccagctattttttttgtatttttagtagagatggggtttcaccgtgttggccaggatggtcttgaactcctgacctcgtgatccacctttcttggcctcccaaagtgctgggattacaggcatgatccaccgtgcctggcctgactagttactcttgaggctgagatgggagaatccctcgcgtccaggagttcgaggctgtagagagctatgaccacaccactgcactctagcctgggtgacagagtaagaccctgtctctctaaaaaaagaaaggaatatgaaaaaagaaatattgcaactgtagaaatggaggggagtacgggttcctaacaggaactggtctgtgcatcaggaggtgtgacaggtcagtgaatgaagcttcatctgtatttacagccgctcccccatcactcacattactgcctgagctgcacctcctgtcagatcactggtggcattagattcccataggagcacaaaccctattgtgaactgtgcatgcgagggatcgaggttgcacgcttctcatgagaatctaatgcctgatgatccgtcgctgtctcccatcatatgccaatgggattgtctaattgcaggaaaacaagctcagggctcccactgattctacattatggtgagttgtataattatttaattatatattagaatgtaataatagtagaaataaagtgcacagtgaatgtaatgcacttgaatcatcctgaaaccgtcccccagagtgtccgtgaaaaacctgtcttccacgaaaccagtccctggtgccaaaaaggttggggactgacggcttatagcattttctcctcttcagacgtcataaagacagatatcctcctaccttttcttctggtaggttttggctttctttatttacatgtttacttcctccagaacttacgtttggttatgtgagctataacctaatttatttattatttgcgggtgaaaagccaattgtctccacactcctcatcaaataattcttctcaacctcactacccggcaatgccgtatctaccagatacttattttccacacaggcttctgtctgtgtcttggttctccattctgtcccactgttctgtttgtctgcctatttccttcactttatattatcatgtaagaatgtgcttgtgttattttaaaccatgtgtgaacattatattttaaagatttctgttttctttccggtggacatatcagtttcttgaatcatttctctattgtagggcaaacacattgttcctagttttttgtgtgtgtgtttttttctattatgagtgctcctatggtgagcaatttttcgtataaagcatttacatatttttggattatgtcctttggatggagtcccagaaatagaattactgagtcaaagggcatgaatatttcttaatgcttttaattcacagcatatatttatttaaaacattaaagtgaataaagattctggaaagttcctggtactctatgatgtggttgtaatcagctgggctgtgccagctctgaaccttggtatggctgccctgtgggagttcaagagggagattaatgtgtctccttgatagatttatcttttgtctttggtagtttgtctaacacattttttgtattcatttattcaggcagtcatttttaaccacctattatatgccaggcttcagagcaaagcaggcaataggatcttatattcccaatgaacacaattttttgtatgtaagaagacaaacaaacaaaattgaatgatcaaggaaaaatatagactgatgtgatagcaagtaggcttctgtagattggatgacccaaagatgacaaggatgctgagatttgaatgaggagaaagagaaaaccacaccaaagagaggaaaggcatccactggtggtggacgcagctggttcaaagggccctgtggtgtagtggagtgcagccctgggcccgaaggaaggtccccaaggtaagaacctagatctgcgggctgtgctgagagtgcagtgaaccaacagcaaagaagaagagaaagtcccatccacacaggagagtgagctccctacacagcaatgacgaaccatagaaaagttttagctgggagggtcacaatctaatgggtattgttaaaagatcctccaggcttctttgcagagcacaggttacaggggaacaggagtgggggctgagagatgagttaggaaaaagtcattgttgtccaggctgaagttactggaggcacagagaaggggtggcagtggaaggaaagaaacatgggtggatttccattcatgtgttggaggtaagttcatgggatttgctgacagattggaggtgtggagttagggtaagacaggaatcaagagtatgttctcaaatgctggcctaagtgactgagaaactggaattatattatggagatggaagagaatgagaagaattggcttgtaggggatggagttgggggagatatctggctttggccatgttaagcctgagatgcctctttggttaagaagtggagaggtgagtgaggcagttagagtcacaattctgaagtcccagggagaagtttggagctgtaatatgtacttgggtgtcactgacagagagaattcaagtcccctggtaaacagatttgtaaacagagaagagaatagaaatgattgaccatcatcaagaaaaacattatttttttctaggtttcaagaatattctgggtttcttatatttgtctttgtgaacaaaaatttttttttcattttttccaagtaggaagagagaaaatcttgagttttcttatctagtggtttcctgtggccttggtcctggcacagtcctccaatgtttagtggtgacttgaagaattattcttgtcatttgatcaactattcaaatgcaatagggtgggtcacagaaacaagattttgaatcttgcaagcttttccagaaacattcccttgtctgctgtgtttatgttggaatggaaaatttgtgcctgattttacagtgaacttttctcaagatatacgacttgctgcctcatgacattatcctgcatctcgggacctctcacacctagatggtgtgatgtaatacgatgcgcggtgctcactgccacagagctgtcatgaacaaaacctgtgcttctagagtaatgcctttccacgtcattttcaaagtggctttgcatagggttcccagtatattctttttgattgtgagagtacatgtctccatgtttgagtataaaataggaaatttagttattaaaaaacaaccaatcctctttcatactagaatagtatagagtagagattgcaacaggcagcgagtaaagctttgtggatggaaataaaaatttatgagtcagagaggatgcaaattccaatgttgccgcttatttgatttgtaaccttgggtacatttcttaaccgcttggggcctcagtttccccactgacattgggataagaaaattaccaacttgatagagagcctgtgaggactagaaaatactacattttgaaactctgtgcattttcactgattcagtcatcaaagaatcaaagcccctgtttcacaaacatgtaaatagagcagagagtggcagtgttcaattatcataaaattaaaagtgctggttttcttctgggttttgagaatatgctgggttttagttaaataaatatttatttgttgaattaagtgatttaaataattaaataatggagcaattatttgttgtcttcctgccatgtgttagatactgtgcatgtaaaacacaccagacatgggtaagatgttgccctcaaaaagctgacaggaatcccaacttcaaaaaaaaattatttcatcacacttgtaataagtctggtagcaaaaaaagctcaattgttggcacatacacactgaggcatttgagtcattgcttttagttattctaactaacatttctgtttggactgctcagaattaattactgattttgtggatcaaagctggagattcaaatacatgaatttctcaggtctttggggggaaaaccactgatgtaacttctactgaagagctgtgtctactggataccaagtcttgtctttctgcacattttaatatgcgactttctcaaggcagcatccacaggcactagacagggaactatagtgagcaccttctaaaagggagggcttgatttgtgagtgaaacaccgagatgctctctcaaaacacacaatttgctatgttggtagtatgccgttttataattcagttaaaataataactaatgcttacagttaaataaaatgcaatttagctgagaatgagcaaatcacagttgagaattagagaagaaaaattcagtctctagaacatgagttgtttaagaaaaaaaaaaaaaaaatcccatagggctgggcacagtggctcacacctgtaatcccagcactttgggaggctgaggcgggtggatcacctgaggtcaggagttcgagagaagcctagtcaacatggtgaaacccgtttctactaaaaatacaaaaattagctgggcatggtggtgggctcctgtaatcccagctactcgggagcctgaggcaggagaatcgcttgaacccaaggggcggaggttgcagtgagccgagactgtgctactgcactccagcctgggcaacaagagggaaactccatctcaaaaaaaaataaaaataaaaaataaaaagaatcccataaaaataagtaaaaaaggggagatttaaaattccctctctgcatccttttcatgcttgtgcagctaccagctggcaagggcaaatggtcttaccttattacttttatttgtgtgtcttcaagccgaattccataggtgtgatggaaatccttgctttgggctgcctgttccagagagagacccaaacgttcagtgcacttggccttgactggatgttgaaacaactaagaagacagatattttagagatattgttttgaataaaggaacatcataatggagcagtcatgagtctaaacttgctagccagtagccagagtccttggggttgaactctttcgtggcaatttgatagctgtgtcatgttaagcaaatatctaactcctcagtgcctcagttttctcatctataagatggggttaataatgctacttatattatagggtcatggtgaggttttaaggggtttataatgtgcaatgagttcagaagggtgactggcatacaataagtgccttgtaactgttgactattattattaagggaggctgattcaaaataaacatggttcgagatagacccttggttttggagaaagggtggcttgtgattaaggaatcaaaaacacagttacagtcttggaaaacaaatgacctgagcttcctacagtgtgagagggactctaggtaacagaaaggcagaaggcatgagatttgggattttttttttgtcttctttcttaatatctggatatggcagaaaaagaaatgtaggcagagcaagtgtagcaagtgtgtttctgcctcggtcatttcaggcaaatttatcctttcttcagtatcttctgagaaaggttagctgatgcatgtaaaacaggagtgactaaaatagtaagatacaaattaatagtgttatttaaatgtgtgtgtacaagagagtagggttataagatgagacattctcatttttttctagaaccacaagatactgaagaaagtcaatgccctcccatctcccatctttcagaccccttcagaatgctctccactttgacctgtttaagtttattttaataaaaaaaaaacacattttcaaggaatagatgctttaagtatggttcattctttggagggggtgtatgtgtaccacatgacaagtggttgccatggtaatttctcattattgttgaattgaaaaataattactctggcaaaaatcccacgtaacctgtcagtgcttaagttaaagatgccgaggggcagccctggcaccgggatcctgtttttggtgaagagggatagggttgggaacaggagagaatctaggatggaagcaaaatgcttctgtagatttttaaacataattaagactctcttctgctatttgacatgactgtgtgtctcatcctgatatatgattaggctgctggtgaaatttgggttcacctgtgagatgggacaaaaggactaaggactgtaatagcacaaatgcatataggggattgtttagaataaagaagctttgatgatattttttcctaattaaaatatggaagaattgtcaacaaccacttcccctgtctgtgttcaggctgagttaatttcatctttatttacctggaggctgctgtatgctattgttactttctagctttggggaaaagaattcactttttacttattaatattcactaaacactcgccacacacagttcagatactaaacaacagcaagaattggaagtagctgtctgttgggaaaacacgtgtcccagatcagaagccctgtggcagtgtgcaacagagctcaatctacacatgagttcgggcatttggtactcagtcctcctgatccatgagtcattgtggagtggcatggaaaacctacgtttgctttctttcctatgcttgtgtcaagaaataatcctccttttggttaatgaaggccttaatatacactcctcttttaaaagaatgatcggcaaagttggagtattattagtagtgttactccatttttgcatcttttttggacttctagatattcatccttctcccagcagagctagtctctgtttttgtcattaagctgctcttgctactagaacccacttggaaatatactgcttaacagtactctttgaatctctacccatgcatcaatcagaccagatgcagatgcttttaatatgaaagtacagggacctcctaatgaaaggaccaaaatatagacaggtacaaaccctatgtctaggcatatccactttaggcatgtgcctgagagaaattcttacatataaacacaaaaggaaactacagagacatttatggcagcattgttgggatgaccaaaaaattaggaactatctgagattattagtagcaaaatgtttaaataaaatgtattaccgcatatctattcagtgcattagtatgtagcttatataaggaaagagagaccccaatatataaattggggccaagcacgctcatgcctgtaatcccagcactttgggaggccgaggcaggtggatcacctgaagtcaggagttcaggaccagcttgaccaacatggtgaaaccctgtctctactaaaaatacaaaaattagctgggcgtggtggtgggcgcctataatcccagctactcgcgtggctgaggcaggagaatcgcttgaacacaggaggtggaggttgcagtgagccaagattgcgccattgcactccagcctcggtgacagagcgagattctgtctcaaaaaaaaaaaaatatatacacacacacacacacacacacacacacacacacacatatatgtgtgtgtatatatatacacacacatacatacatttatatatagacatatatgtgtatatatataaatgcacacatatatatgtgtatatataaattggataggtcttcaaacacaatgttaaatttaaacaaatcacagttaaggaagaaaacataatgtatcctatcatgtaaataaaatattaaaaacaaaataggactgtatatgagtggaatcatgcatgtatattaatataaaagatgggctaggaagatccatatggttttcatgagacagttatttatggaggtctgagagaggagagagaaaaacagagtaggatatggtgacccagaacatttatttatatttgtaacatttaattactttagaaaaggaaaatgcaataatattgcaataattgttaattccgggtaatgggcccatgagtcttcatcatattctcttttgttctctatttttaaaattaataaagtaaaatttgtcttgattaatgacagccagtcaagtgcattcatgtactaccagcaaccttaaccaacatttcactgagatgtataatactccaaaggtggctcaaaagcgtggcagtgtaggtgtgagataatttatttaaatttctgcctccatatgaactcctgacatgcatgcctggggcattccattattgtgagatgagataacagtgatgtgacagagagaagacttctctcgaacactgtcttggcccctagccactgaggttagattttaagattcctacatttttagagaaagaatcttactcgccgtgtgggtagggccttatcatctgtttagtccatttttctactccattattgggtactaatttataggagaatcctgctgaggatgcatagatacataatgtccattccctatccttaagtaacgtagtctgctggagcatactttaggaaaatgtgtattacaaggtgatgattccatgataatttcatatacgctctattgggattatagttgtcaagatttcctagtacaggagacagtgaaagaggggtccacaaactgcatcttggcatttgctggacattgtaggtcaaaagaatgacatatgcaaaggcagggaggcacaaagagttgagaaggagcccttaaccctgacacgtgagctgctggaggtcccttggctcaacacattgctgggaggccaactccagggtcctgcatatgctggctcctttctggtgtggtaagaatgttttttctctggatagactctcttttagcttagatgcacaaaatgttgtatctcttatatctgccagtcccagatgtgcgtgccacccaatacacctgggaacaagatgtcagacttgtggttgtgttttaagagcgtgtgctataccatttacttggaagtcccaaaaggttgatctttatcttttgggcaaagatgagactggtcagtctcaatgcacctcctggttaatctccaagttagtttaacgtgtgatgattatgtgtgtggagtaagagtgatcagctgcaccctgctttgcctctaaactttagcggaaactggatttagtgagctgctctatgggatccttcatcaaaacggcttatagcttaactcacacagcctcctgctggccgtcttgctgaacttggccacattgccaggtccaaaaggagaatgggccatttttgtggtacttccgcatcatttctccaatgatgttggctctaagtttacggtcagcaggtggaactgctagcctgtacataaagctgcagaattttaattagtatcttttctttcaaatgaccatggtctctttttcttcctcacatgtggccaagctagagtctgtgttgcagggtccataccattctagatgactgacaattaaaccttggaaaatggagggaatgatttttttttttttttgtagtgattgtccataactcataaggtagctgtgtcaccaagaactgagtgtctaccagtagagttgttagatcttctgccagagacttctatttggctcagcagaggtcttagctgtatttcagccactccctaaactcctaatctctttattatccacattacttctacaaaattgcctaactgatcccaggaactacaccagacaacagaatggaagcaagaagtgttccaaaagatttattatcaggaaaaccatgtgaaggtgggaaaaagggtatgaactccgaaaggttggagggggaaatttcctctagtcaatgctgacctcttcctctaactcttgtaaagcatttttggtcttcaacccaaagtgggaaataactttttaagtaaaattatttacaaaaaagcatgtattggagttaggcagacttgctacgtgaactttagcttcatcactttcttgctttctaacctttattgagtagcttaccttttttgaattttagattctctatgaatatcttaagggttaaatgagataatgataaataataatagttgacacatattgaacaactactatatgccgggcagtttctgtttagtcctcacagcacaccgagattattattcccacttacccaacaagcaaacagacgcaaagaaattagatgtgttgactgaggtcatccagctattaagaggcagaaatcatatgtgcaagtcagtataacatagaagttaaggacataagttctctataaggctgcctgctctgccccttggtagcaattagggtagttgtgaatataaaatggttcaatacatgtacagcacttagaaaattctggattacgatactaacattaaccctgggccctcaaacatgtgctctttccataataagcttccttcatatacagccaacacaagaatggcctatacccaacacttagtaatttttgtcttaaatctctattacttttattcctttcctaaataaacatttgttctgtcataactaaagactaattcaaaaactctgtgtgtgtgtgtgtgtgtgtgtgtgtgtgtgtgtgtacgtgtttacatatggggggagattgaaaattacaatttaaatacacagaatgtcatttttatgcgtttaaaattattgaccaacagacaaagtagggtccacaatcaagttctccggacaactttgtaaagtgatttcccgagctgagtttgtgatgccacgataagaaatttattccatccatctatctattaatgtgttctatcagccaaacaaaaatattatcttatctacctattatatgcctggcactatgaacttaaaggttacatttttatttcgaggatgttctttcaagatttgtgaccaaaaccaattacgtgtgtgtgtgtgtgtgtgtgtgtgtgtgtgtgtgtgtgtgtgtggtgttacctaatgtgcccattctcccagcagacctcttctgaaatttcctgagacgttgattcatcccatgttccactgaagctagtttgaatcatatgacatttctcattcttggatcattatgtctctttcaacttctgccaaaactcacgtatgtatgtaggccctgtggaacctgtaacactgctcatagacattcctcgaacctcattgtaacttgagtactttcttttctcccggtgacctcagatcagccagcatttctattgacttttttgcctttcactggttcattttccagcagaagtgtcagagaccaagagttagattatcagaaaatagaggatgatatggtttggctgtgtccccacccaaatctcatcttgagttatagttcccataatccccatgtgtcatgggagggacaaggtggagataattgaatcatgggggtggtttcccttatcttgttctcgtgatagtgcgttagttctcacgagatctgatggttttataaggggtttcccccttcactgggcattcattcctctcctccccttccaccatgattgtaaatttcctgaggcctccccagccatgctgaactgtgagtcaattaaacctctttcctttataaattacccagtcttgggtatatcttcatagcagtgtgagaatgaattaatacagaggggatcccgtcactgggcctctgaataatgagcaaagcaaatgagaagtaatacattttcattcagatttttaacagtgttatagacagatgctgttgccagggaaaagggttgctaatggttgaagtgatagggaaaagtgctgatttataaacagactattttataaagttcattttttttttgagaccaggtctcactctgtcacccagactggagtgcagtggggtgatcttggctcactgctacctctgcctcacaggttcaagttattctcctgcctcagtctcctgagtaactgggattacatgtgcccaccaccacgcctggctggccaatttttctattttctattccatttagttttctattttctattccactgagttttctatttttagcagagtgtgggtttcaccatgttggtcaggctggtctcgaactcctgaccctcaggtgatctatccacctaggcctcccaaagtgctgggattacaggcatgaaccaccacatctggccataaagttcattttcagtgcagttctttataaagtggaatgcctcctgccctagatatgatattaaagatggtagacagaggcagggaaagggcattttattgatcttcactgtctttggggtgctctcctgcagattttatctcctgaagattttattgatctgcactccctttgaggagcactttatacctactaatttatttagtcctcagatctgtgctgccagatagtaactattgttgttgttattgttatcctcaggttctaaataagtagacaggctggggaaggtagaataagttgctaagttcacaaagctgggagggggcagtgttacctgcaggactgaattccgccatgatgtgttaccaactgctttactgtgaaacgccaggcagtctcctgagcgtgagtcctggctgcaggtctgcacaaggcaaggagctcaaagaagaaatcaacctcagactaaatattccctttcaactctttctcccctcttgctgaatcctaaccacagcctctcaaagactgtcagggaaatgtagcaggttgctgtacagagcaaaggatgggtaggtcgggggtgtccagtggtctgagttgaaattccatctctgacatttatttgctgagtgtactggagcaagtgacatttactgcctaagctttggtttctgcagttgcaaagtagagataatatgagcagcttcattcattcattgagctgcttttatgagtaatatcctaggctagacactgttctgggggttgggagataaagtagcaagcaaaacaaagcccctgtgtacaagaagcttatatttgtattgaagagaaaaaaaaaaaaccacacacacagaagaagtggattcgtactgtggattaagtaggaaaatacacataaagtcattagactagtgcttggcatgtggtaaacactcaataaatgttaactgtgactctttttccatctgtgtagtgatttaaagtcgaataaaccaatgtatccagtcttccgaatagggtttctttccctggcagattcctccacttccaagcccactgagttttttaaaagctccacaagcttccagagcattgaggacgtgtgccacggtctcagatgtggagtgaagctgcctgtttagttgctcatgtgattgtcttctgctagtgggctttaagccctttgagggtagggaccagtctcttattcagctgtgcattctgaaggcctacacatagttaagtgcccaatacatatttgtttctgaaaggagaaaaagcagagtactttgtacgtggatccatgcattgctcttcggtggtttcctatctaccctgttttactgagaaagggattggcttttgctatggtgattggaaggaagccaaagagagatgcaaaaattcatttgtctgagcttcttcttttctgaaggagaggacggcatcaatcttccgtggctccttaattattcttgctgggactgagggttcattcctaaggcctgccagtgacaacaacttaatgttgtcataagcagagcaacttaatgggaagaagagaggcttgtggtatctctgccaggactcagtagtgggactattacatggggagtggcaattccccttctatctccccttccatctgacaggcagctgggatgcatcttgtcttcaacttctaattctctggaaaaacatggtgcttaagaattttgggataaatcaggtcctatactgagaatttgactgggatgtgattcctcctgtaaatatgacactctgtataaccttcttaattcactgtgagaggggccttcttctccccttggagattaacagtgattctgactgccttaaactgggccgcttccaaagtgttttctgcatgagcaggagaaacattcaacccaaaacaaacaaacagaattcatatggatggcctgcattctgctgaactgctctatttttaatactctttttaacaacaagctagtggttgcctgtcctcttaaaacaatcaagaacagtccatatatatgtgacaatcgcttgtgtgtgaacttctctatcaatctatccatccatgtatctgtacctgtatcttttatagggatatttgtgtatagtagagctaggaacatctctgttgattaaattatgtatgaaaattatgtttaacctggttgtaatattgtggtttctatttataaaaatgaactcttaaaagagcagagagagagaaagagaaaaaaaagtcaagtgtattttacattaaatgcaaacccttttgtcaaaaaacatcacattgtgttttatagcacatttattaaatctccccaaatatatcctggagaattaatttttattcgattggtttgagctcacttattgaattggaatttggttcctatttgaggcaattaatttgaagagtgaccgcccacctaccctttcctagaacacctacacacatacgcgaagtaatgagcaaggagcagctgagtttttctttctcttcccttttctcttcctctttgagatatttcccactttcccttgttaaataaatgatctgtctctttgcaggatagtgacaacctctggtgggacgcctttgccactgaattttttgaagatgacgccacattaaccctttcattttgtttggaagatggaccaaagcgatacagtaagaaagaagtttatttttctaatattacctcgttttgtgcctgtaagaaaaccgcaggggtcttcagagaatagcacagagctgacagcctgacaataatacctccactcctgagaatgttcttgcttctcatcgagtcattgtcactgggtggcagccctagttggctctgacaggtttccttcgaggcttagaatgtttgggtatttgcctgtttagagagtgaggcaaatatgaaccaagtcacccagtgatgagtgggagcggaatgatggacaatttccatgcatctctttctgccaccctcttttatccttgacggttcacacttgacatccaatgttctgcttctggaggttcttaaaaataataattcctactgtcactgtatcagccacatccttctaatcccctcttatcaattatctcaggtatttatttgacaagtgctatctttttttggggtgtggggaggccacagttgctttgaacatacagtttgggattagtgttgacagaattatagttccttgtctttcaggcgagtgataactctgtaaagatcctcaaattacagcgtgtggcaccttgggtaacagctgatctgtcctgattaggttcagccaacttgtcagagatcagatttgctagttgtgctatcagaccaggaggcatagatgcatcagcacaaaagcaattaatgtccagttagatcagagagagatgtgttttcagaaatcagtgttgcacctaggaaagaatccatcagaggaaaaacatccccactgtcacaaacactgaaatgatgagggaaccagccatggaatgatgaaccagtcatggtatgaatgagtcaatccagaacatttgaaaaatttataggtaatagggttcttgatatgtatgattgaaagctctgattgttgctaatctatttcaaagccactagagaacaacaattaaacaaaaaattgggggaggctttaggcaacttggtgctatttgcatactattagcaactatactagtagaatcaattgcataattaactgattaattatgctaatatatgcacatggtgattctgcaatagtgttaaacacgggaggagcagcccggagtggacttgctgcccaactgaaactggttgccaggcgcatctctcatgtttgtgtctcacggacttttaaggacgtgggacatttctaatcaatattttgggcgagaggaggggcaggtagtatatcagaaaatgggctgtttagagcacctttatattcaacaaagtgactcctagtgtaaacactgataagcctacttcacaggggtcctgctgagttaacttgctctccggtgtgtgggtgcccccaagcagcctcatgccctaaagaggtgtttcagaagtccctgggagataaatgaactcagcagtccgacaattactccctcctcaaaaagctgcctgatcaatggcgtttaatttctaaccaagcagtcatccatcctgagccaccttatttttttctgaggcataagctcagataacttcaagttatcattgttttatgttcttgtgctttgttggttcgggaatccatcagggactgctcagggaactagaattacagtattaaaatatgtcctaatacaacagattctggctcttccctctgtccatcccaccccagcatcatttgggagtgaatcacgatcatcgcctgtttaagatcttatctccatgaacaggagtaaatgcctgactaccagccattgttgcccaggcctctttgtttctccgagccaaaatatttcccgagtggagaagagaaacaaagatgattgacggtcttgagccgagtctcatcagctgccttgctgacagcccggtgatgtgcacacgctgctgatgtgtgggctggtgacagctgattgacagcccaagactgagagacaaggaagatgaagcttgcttagaacgcctgacgtgcactgtttatgcagcgctctgagctcaggcgctggtaccttaacccgttcgaggtccaggcatgctgtgccaggctgggcagactcctggctgtcctggggctagaagctgcagctcttccttcatgcttccagggaagctgaaagctttgtttttctgatgaggaaaataagatttggctgttgcattagtatttgttaaaaaaaaaaaatccccaatcacacacatatgaaataataagagatattttagctgagggttttttttttagcctttactagaaaaaacttttcattcttcctccccatcgctggtgtctaggggggtccttttgggtctataatactttatctctaagttgccataaatcctgtaataggcgtctgcttatttatttattgtatgtcattccttattagaatgttatttccatgtggatgagggctctgttttgttaattgctgagttctcagattaatacaggaactcatacataataggtagctcaataaatatttgttgaatgaaggaataaatgaggacacaaatgcatagacatttgtagaaaagtttatataatcaagtaaaatgttggcaaagctatcctttactgagatctttggatttttttgaacaggaagaaattaactcacagtggtccactggcgtactcaaacaaactctgggttacgatctgatctttttttctttttttgagacagagtctcactctgtcacccaggctggggtgcagtggtgtgatctcagctcactgcaacctccacttctgggttcaagtgatcctcctgacttagcctccctaccgagtagcagggattgcaggtgtccgccaccactcccagctaatttttgcatttttagtagagacaaggtttcaccatgttggccaggctggtctctaactcctggcccgaagtgatccaccagcccagcctcggcctcccaaagtgctgggattacaggcatgagccaccacatctggctgttctgatagattttaataggaacaaaagtcccggcagtataataattgaagagatgatgatgttctgggtgatatattgttcctttcattcagaaagcagaaagctcctcagtattgaccctcttcctccacgtgctccatctcttaagcccttcactcccctgatgggggtgtgtccgcccaggtgagatatgattgggcaggtggaagctactgatgttttcttagggaacaggtggtaattggtggggagagcttcaggatgggccaggttattagactatgtgagaaattggcctgtgcatccctaaggccacttgcctgcccccgccctggacaacaccaggaaggtactactctggcagctggagaagtgggcagttccatggaggaagttctatcctttgggtaaggtggactctaggaaagaagagtatcagaggtagacaattccctggcagcaggtcagtagaataaagaacattagggctaaaaacggtcctttctaaaaatggaaacttggtccagagaggttaggtgggtgccccacaggtgaggctgagcctcaggtttgctgattccaaagccagcttgctctctctctctctctgtctgtctgtctctctctctctcacatacacacacacacacacacacacacacacacacacacacacacacacacacaccctattcctacatcatgccatagctaaaggaaaataaatgcttttatcaacacacacatttctggtaacagaaataagggtcccaaataattactgtcctttatctgaaacagaagacaaagaaagccagggatcaggttcctcaaagccctctgtgcacctgctctgcagttctaagtccagcataaagtgttgctatttccttctctgtcttgggttaggctgatcacttgctattagtttcaagcacaatattaatttccctttgctccttttaggaatgtagcagaaccgttccccacactattcttctgccttatgacagtcacaaccaccatttgagtaacatgcttctcagctgacctagcctgtgtccaggtccaggtccacaatggccacattcttaggaaatacgtggttcacatctcattcggaaaatacttccttcctaggagagatacgtggagaaggatctcctgaggcccatctcagcaggcaatgcagggctgagaggctggatggtgcaggagaaagggaacaggggttcaatgcaaacattcttgggctttaatccatgctttgcttgataaacagagacttcattttcttatgtgcaagtgagtataatactaccatcactgggctgggtgctgtggctaacgcctgtaatcccagcactttaggaggccaaggcaggtgaatcacctgaggtcaggagtccaagaccagcctgaccaatatggtgaaaccctgtctctattaaaaatacaaaaattggctgggcgtggtggcatgcgtctgtagtcccagccacttgggaggctgagataggagaattacttgaacccaggaggcggatggaggttgcagtgaaccaagatcatgccactgcactccagcctgggtgacagagcgagactctgtctcaataaaaaaaaaaaaaaaaatactgccatcactggcttgtgaaaattaaatgagatgttataatcaaagagctgaggaccatttgaagcatagaatgatcaatacttattatcattgatatgcatggccttggcctcaccatagcttctatgcattgaaaaggcttcccactgggcaggacttatcaagtgaacaatgtggacagcctgatgccgaggctccctggccaggtgggagtccatatgacctttttaatgggcagttcctgctgaaatgcaggactgaggagattaggctctgctcccaacattcaagtgcagaaacccactctcgcttctagtaagtggtgagcaggagaagggagtagagaggggaacagtgattaagaatgtgtggggcagaagactccagaacacttggttaaactatgtgtaagtgggcatggctttgcaggttagtggggaaatagtgtaactactaaaacgctaccttgtttcagagcactttctgttggcctgtttcttagagaaaaacctaattcttttctaagtggccttacttgaaacgtaagggtttgatgggatggtgcatgtaaagtttttggcagcgctttcatccctttgaaaatgctccataacacattgatgggcgttcttattagattggattccaataagcacattgttttctctagactgagatctaggacaatgcagataaaattttcattaacctttaactactatttgtggtttggggctaggggtcccagtaattctctatcacacatttgttatttcatcttgaccttagtaccctgtctggaacgaggatttccagagagaccacacacattcatggccacactagccaaaagctattccatggctgctggagggacatttcgctctccaaaaagagaaaagttgttttaagaaatgtcatcactctctgtgcttttcttttcctcagtcaccaaggctcattagatagtctgaagaaccacaaatccacacctctgtggagccatttctacacttgctgtttctcttttacattgtcgttccttacctcctttatttttcctgaaagctccaatagctttgcagtattgactaagttcttcaattttgtcttgtaatatgtgtttttatgtgttgtgtatttggacatgttcccctaaggtagagaaattctgcaaggggcccaagtaggttcactatctccggtttctgtttctctactgctttttattggttcgaactcacccagctatatttgtactgtgcttgctatatacatgatttaaaacatgtttctgggaaaatcactccttggtaatatgcataaggcattttgacaccacacttaataactactatggcaggaatgtggccactttaaaaagttacatgcaaagaatgtgctctgcagcacatggggaatgggatttcaagtgcaagaatttaagacccgtgtgtgttttttctaggaataatgcctttgtggtgtccacctgaaacctagaaaggcacaggttcctctggccactgcttaaagctcttgagccttctcagaaggcatggccagctggccctgcagacttggtcttccataaagtaattttgcttccctaaacattcctccttctttttttttttttccatccattgagacagagataacattcacggattttggatccacgcagattcattttgagtctttgctcctccataactgccagatgttaggcatgtgagatgacattagacatgttgcttaaactaccttaaccccagtttcttcatctgtaacatctgggtaacaataatgccaacattttagggttaaatgagatgcacctgtaactttagcttagtgccactcttgaaaagcacagagtaaataaatatttactgcatgaattaatgaatggacgaatgacagaataagtgagtgagttaaacctatgagacaacagccacttcaaattaccatggagttcccattatttatttggcacatagtgggaagaactctggttttgggcagagccaaaacagacttgtcttctttctatacaggaaccaagaatttaagaccaattggggaaaaaatgaatattaatggaaaatggtgagttaaacaaacaagttccaaacaattacaattaccacatctgtccaacagagggtgagattttcatcccccattttgctcagagagcaaggaactactaaacatttatcaagtgctggtaatttatttgggcaacttatatgtaaagagtgggctctgtatcttgttcactgaggaccagaggaaaggaaattgattttgattgcattcaaaaatttattttcaagaaaagaatacacttcctcagagtagtccttcatgtttaattatgggaatggattcttgcctctgactgtggcatcttggttgcttaaaaacataaatgtcgttgtctcagatgaccctggaccatgcatttattcgcatggggttccattaaatggtttccagatggctctagcacccgatgttgtgattttattttatttttattttaaagatgaggtctcactctgtcatccaaactggagtgcagtgggaactgatattgtgattaatgagtgtccatttcagtagcagtcttcattaggctggtgagatttgtagcaaattcagttagaagtagagcagattgtcattcgaagttgatttgttcctgcactcattcatggattcattctttcagaactcactgaactcttgctgtttgtcagacattgccttcctaggccagacagttcttgggagaaagacagttcatcacaaatttttaaatttacttttgatttgattttatttaaaactcttaccttaaattagcataattgcctaagttgctcagaaagagaatattcttgtgacattaatggaaaatctaggactagtcataaaaatacttgagagaaagcccgcaattgatagatgaactgacagatttctgaaagagaaaaaggagacccatctcttcccatttgtggtttcaaattgatagtatcagaagttgcaaattggccataacagtggcttgaacagacattccattctctaatgtctggtaaataccacactaatgatcgcatgagataatggacagaaaagtgctttgaatgaatttaaagtgcggtacaagttgaaggtataattattatcatatttataattaacgtttcagatatggtatgtttttattatcccctaatatgttataagtcaagctgttatgaaatctgaggtggttgttagctcttctcttagggggttacaattgtcaaacgtacaggcttaaatgcaagtcatatctatgactgccctcacgagcttgttctggaggtctgaatgaggtactaaccagaaaatggacattatgtgctctttgcctgactctgtgtgactatgttatctatggagtcctggcacgtgcatttcctgactttcggttttagggagtatattgcctatggtttccaaactgaaacaacactaccccatagtgggtaaaacaaagtgtgtcaaatcttttcattgtcacaatgacaggtgttgctgccagaatttattgtttggggactggagaagagaactgttctacacaataaaaaattattgagaaacacattatctgactcttcttacctccaacttattatctttttgaagttagggttgccagataaaatgtaagtatacaaatgcaatacttgagacatcatacttctactacaacattatttgatatttatctgaaactcaagtttaactgagcatcctgtgttttctttgttaaatatggcatccctacttcaaggaccccagttcatgttcaaatgtgaaatcttgacaattccagagcagctacaatgtggtgtgagcatgacccatgatacaaaaaagactaagagatctacctggacttcttattcataagtcttgcttctgtttatttccagacactgtactcatgagccccagttaaagaaagaaatgccccagcagaggttgggagtgaggatgcaggtcaaagtctgcctgaatttaagtccaaagtctgcattgcaggccttctaccgttgactgtgccaggcatctgggcaggtgttgagcacatgcataggagtgtgatatatatggcttgcccaagggaacttgcagtataacaagggagacagacccatacacgatgaactctaatgcaatagcatccaccctgtaagagtagtgcaagcaaagttctgtggtgcactagagacctaatgtacagcataatgactatagtcaataatactgtattatataccaggaattttctaagagatgatttcaggtgctctcacaacaatgaaaaattgtagaaggatatggctatattagtttgcttaattgtggtaataatttcaccaagtatatgtatatcaaaacatattgtatatcttaaatacatagaatttttatgacaaaaatagaattaaaaaatataaaaagtacaacgaggcatggagaagcgggtgttgatgaagtctgctcttaatggaaaaagattgagcctgggaaagacttctttctaaccttctaaaagccttagttcttaaactcatgagagaaaacgctctaccacaatgtccttcaaatacaaagctttcaatagatatttgtaacttgaacagttgatgcaatgctggtaaatagcacaaatgtgacccatgatgtctgaatatctagcccacaggcacattattaaacctacagtttttcccatattttaataagtttccaccatcacaatctcaagtgactgcagcctgttttgtattatagagcaatctagaaatttgtccacaaaagaacaaggacttgagactcatatatatatatatatatttttttttatttttttattttttttttttttgagatggagtcttgctctgtcgctcaggctggaatgcagtggtgtgatctcggctccactgcaacctccacctcccaggttcaagcaattctcctgcctcagcctcccgagtagctgggactataggcgctcacaaccacacccggctaatttttgtatttttagtagagacgaggtttcaccacattggcgagactggtctcgaactcctgaccttgtggtccacccacctcggcctcccaaagtatgagccaccacaccccgccgagactcatattttaaacttcaaactaaaattatgcctacccaacctacaatgctaagactgattttttgtctttggtgctttggaccatgagattgctagagtatttcaccacatagtctcaaaacttcctaggaaatccaattatagcatcaaattttacagaataagtaattctcagcaatggttaactgggtacttgaatcttattgaatgcatcttactgggtataatttcagtggaaacacctatttatttatttaaccttcctcaatgacttcccatgtgttacctttctgtgccctggggataagaagatgaatgaacaaaatctcttgctttggaggagctaaagatccagcgagcttttgtttcaaagacttgattattagcagagcttagccatgttttttcatgtagataccctctgcctctgtttataaatctgttcctaataatgcttcacactctatttttacacattatttccaaacactacattattactattttttaaacgtaaagcatttggaaaaatcagtgttcagctgagatgtgtgcagtatttcttttagataataatggctggtgatattttggtttagtggagtgagccaaatccaggtatcctcccctacaatccaatgtgtagcttaatcttcatattcatgtcatgttttagaactgtgaacacaccttatttatgtagatgaggtaaaataaagcatttgttgaagtcaggttaaattagcactcttctacgactgtattaagcaatgttcagatggatttcattaagaatgtagaggctccatgacaaaattacccatcagggtatgttttatttattgtttaatcaaggtaatcatattggagtatttgaatttaggagcttacagaactgggtgccttcatgtattttgcttttattattcattccagaagaatcagcttcacaaaccattatgccatacttgtttatttttatgaagttgtcctttcccaattggtattctccttactactctttgatgggaacttccctgtcacaatatgtatttttggcttttcaacaagtcaggagaacttgaacttgacaatgatgacactaattatcattctgaagatctgaaaaaggaggacataaggtcacctgggagcctggtgataaagcccctcccatttaatgaagcacagcaccattactcccttacacatcaaaatttgttctccattttattgaaagcaatattacattatttttacaaactttccttaaaaaatacattatgtctgacttattcctgcctttgaataatcttatttgcagtttgattgtttgtctttttttactttgaaaaatgcatcatttgctatgtcaggatgaggttgttacactgaaaacaatgaaaaaacaagagttctttcaaaatctaattatgagcttgtcccagtcagtaatgcttgggagggtatttcctcatagacacacatggtgtctccatgttactctcatattccgatattccagataaaaatcaaccacctgagatggttctcaggtaaaggataattatttgtgtctgtgttttcagaattaattcaagctttgaaaaaaagattaaagttagctagctgagagatgtatttgtccgtgtaaaatttcctctggaaatgtttgtcatgtcatatatgagaagtactagcatctggtaaactcaactatacttattcagtgttcacttgaggcatttagaaagtccaactttcaagctttaaaacaattaataataattctctttttcaaatttgcctgcataaaataacttaattctcatacttatttgctttccttcaataggaccataaaagaaatgataaacggtgtttcactgattatgtaaataaaccgctaattatatccttaatagttctccacacttctagacactgtactggaatgtatttcttataaaatgctttagtacttggagctctattatttttttaaaagatgggcccaaaatcagtaattatgagagttattattcaggttcacagcagtgcagcagctatttttcacttgataattaccttgttaaactaatgtcagaccagcgccatgccttatttaagaaaatggtccaccagccccgagtaagcaggcccagctgtggaaatattaaaagatttattaaattcaggctcgtcttcagcattgtctcatcgacattagttatgggacttgtaagaagttttctatttctcattagatgtttgcagcatcattcttgaggtcctgctgcagcttccgacagctggtgtttccattgtgttccttctatttctagttctgggctttgtggccaaccagggcaccttttaattggcacaatcttcattcagaaccctgaggagaagatgacccattccccggaaattaggaatgcatatgattacatttcacttcctattttcccatttttttaattagttatttatttattgagaccgagcctcactctgttgcccagcttggcatgcagtggcacaatctagactcactgcaacctccgcctcctgggttcaagtgattctcctgcctcagcctcctgagtagccaggactacaggcgcgtgccaccatgcccagctaatttttgtatgtttagtagagacggggtttcaccatgttggccaggctgatctcaaactcctgacatccagtgagtgggccgccttggcctcccaaagtgctgggattacaggcatgatccactgcacccagccacctattttcccatttttaaagttgcagtttcatttattacctttttccctttggaaaagaaaaaaaaatcaagactgtccaatattagccgtggctttggctaaaaagagacagatacagatttgaatttttagtcccacgtaagtacttcttgctgtgatattataatttgccaaaaaaatggagtcagacacgtagttggttcttggtgtttttcaaatatgttcaataatgacttactggattagttaataagttaaaatgataaacattctaataatgctttacagtttatgaaatgctttcataaatcaggaccatctgtaagcttactgagggtggggactgtgtgtcattcacctttgtagtcactgtgcctgtttctgtgatacagaaaggcccatggtcaatatttgctgagtagtacttggtgaccatgcgtcattccatcatcagtacaaacctgggagcaggtgtcagattgatcattagtgttgaagagacgacaaaagcgaggccttcaaagatgcagaattcaactcttctgccatataggcccatactgtgtaccctttaccatcccactattcagaacttttttttttttttcaacaatagagaatctttaaacgtgacctgtttggattaaaaaaaaattctaatgtcttactctggatcctggacacttacctccttctctcctcatttgctcctcccagaaagagcacaggttaagcataattagttcttcgtggcaaatgtgtacctgcagcctgtttttcttattgtagttaagtgtggattgctgaaatcccttcgacattgctgctatgaagctgacatttataaattttctttcttaacgcagtatggggtcctccatatgtcttccacaataactctctgtgttttcagggaatctaaagatttatttccttccaagtccttgttgctggcattttctccaagcctccaaaactgccaggagatgaacttcaatttagaggaactgttacatttgtcattgtgaatttgctaaactttggataaatttgaagatttatgcttattcgcaaatgggccctgagaatatctttggagctcagaaagttcacgcttgacttccttttcactgttctaagtaaacgagttcttaaatccccgcagtctccccgcctgggctctgggtctctgccattgcctcagcctgcattcatttggaccaacaggaactgagatgtgacttacctctgaggtgtagaggaggagggccttctgcctgccttgttctgtggaaatcacatactcagtctgtatttccaggatgacccaattagagaatgccttacataacccctcactttaaaggcaaatagcccaggcttgtgagtcagacaagcttggcttcaaatcacgaccctgtcctgcagttaccatatgacctcggatgttacacctaatttctctgagtctcaccattttgatctgtataatgaaaatagtgtctatctgacactgttactatagtatttgtgagtaacatacatacaatccctgatacacaggagtttttcaataagtaatagctattataatctgtatttatatgtacagctaacaaaccaaaaaattgacttggctttgacttgctcaaggcaacccagctagctggtaataaagtcaggattcaaattaatgtttcctaattcttcataaaacacgtgacttggctgggcgcggtgtctcaggcctgtaatcccagccctttgggaggccgaggcgggcagatcacgaggttaggagatcgagaccatcctggctaacacggtgaaaccccgtctctattaaaaatacaaaaaaaattagctgggcatggtggcgggcacctgtagtcccagctacttgggaggctgaggcaggagaatagtgtgaacccaggaggcggagcttgcagtcagctgagatcaagccactgcactccagcctgggcaacagagtgagactccgtctcaaaacaaaaaacaagcaaaaaaaaatcacgtgacttggccaggtgcagtggctcacacctgtaatcccagaactttgggaggcagagatgagtggatcacttgaggtcaggagttcaagaccagcctggtcaacatggtgaaaccctgtttccactaaaaatacaaaaattagctgggcatgatggcgggtgcctgtaatcccaattactcgggaggctgaggcacgagaatcacttgaacccaggaggcagaggttgcagtgagctgagatccagccactgcactccagcctgggtgacagagtgagactgtgtctaaaacaaacaaacaaacaaacaaacaaaccacatgagtctatttattagtaacttgctaaagtttccatactctcattttcattttaaacagtctagaagaaacctagtttacaaggaccacatatcatattttgttctttgaatcatcttcaaaatattttagagccaagtatagggggaagtgtcattaactgccttgattttagtgatgtgtaaaaaattggagacaatctatttgataggtattttagttttcgattgcagaatatcaaattaccaaaaacttagtgaatcgaaatgacacacatgtattatctcacagtttacctgcatcaggagtccaggctaggttgctgggtgctctgcctagggtctcacaaggcagaaactgaggtgtcatttggggctgaggcttgttggcagaatttgtttttttgcagtggtacgatggaggtttctgggtttttttttctggctattaactgggggctgctttcatccctggaggtcttctactgctccctggcatgggggtcccctctacaacaagcagcttgtctttttaaggcaggagaatccctctcccttcaactctccaacgttaagtgcttgcctcattatatcagacctgcccaggaaaatctctcttttcatgaacccaaagtcatctgattagggactttaattgcagctgtaaaatgagtcatgggataatatcccatcatagtcacaagagccactcatgatcaaggagagggattatgcagggtgcatataccaggggtgggaatcttggaggccactcagaattctttctaccaccagggcatgaggcagatacataattatattataatatgagacatcctgacaagcatattttttgagatgaagtctcactctatcacccaggctagagtgcagtggtgcgatcccggctcactgcaaactccgcctcctgggttcaagcaattctcatgcctcagcctcctgagtagctgggattacaggcttgcatcaccatgcctggctaatttttgtattttagtagagatgggggtttcaccatgttggccaggctggtctcgaactcctgacctcaagtgatccacccaccttgtgctcccaaagtgctgggattacaggtgtgagccaccacacctggccctgacaagcatcttcaaacaagggaaaactgccctgtgaagccagaaaacagaagtcatttcctgctgtaggggttgggaggcatggcagaggcaatgagtatgatttgagtaggcagaaatagaggcgaggggcagtgaggtagaaacggagtggaagaagcacatcccaagggaggcaaagaaggtatttcgggaaaatggtgaatgcttttggttggctagaacttgctactctgtggtttttaagagacttgtgttttgaacctattgaaatctatagaaaaggtgatggggacactcttgggtatacctgattccatgagcgtcctctgcttttttcatatactggctaatgaagaagaggagaatttggccacatgtctgttgaatgtggtgcgttgaatcctatcaccatagtcacccttcaggaccttgaaaaagtctttcttctccaccatttctgacagagaattccaaacttaggggcttctgtgtcttgtaaaatgcctttctcccttgtagaaaaggtagacaagtctgaaaaaagtgggttcaattctgtaagctacacattaaaccagctggagttggttgtaggtaaaataactcaaaaccatgttgtataagaaatgtgttggctgggcgcggtggctaaggcctgtaatcccagcactttgggaggccaaggtgggcggatcacaaggtcaggagttcaagaccatcctggccaacatggtgaagccccgtctctaataaaaacacaaaaattaattgggtgtggtggcacatggctgtagtcccagctacttgggagactgaggcaggagaatcgcttgaacccgaaaggcggagattgcagtgagccgagattgtgccactgaactccagcctggcaacagagtgagacactctcaaaaaaaaaaaaaaaaaagaaaagaaaagaaaaaaagaaagaaagaaaaaagaaaaaaagaaatggtgtatggattcattcatgtgttcattcagctaatacataccatgttcctgctgtgttgctcaatctacttttcctctggggatccattaaacaagatagcaagagcccctgacctcataaggtttaaaatatagactctagatcatagataatttagactttaaattcttgcagaataaggagtttataaagtaaagcttacactaattattaatgaattttagttttgataagtgctttgagcaaactatatgtgatgctttaaccaatctctccagggggcagcagtgaaagttggcatggggtgtgtagaggggagtcaagctaaacctctctgagaagttataataaaggatgaaaaaaatctaagtaaagaaatacatcttggagtttttgcatatatctgttgagctgacagagtgaagagactgtagatttgggatagactggatctgactggactcctgtcttgtgttttcctgatctacaggttcttatgcatcacagcccacctcattccctagttccctctggaggattaattgtcccttctgtctgtgccagtgacatgtggcacacatatctgttatgttacagctttcatagcgcgtggtcatctgtttatatgtgctcagctgggacctctctggagatgtccttggacagtaatcgcagccttttcaccccttaatctccaatatctgatatttcacctggcactatacttgctagtgaatgatatttgttgaatgaatatatcacaactagttggaaatgatagaagtcacatgttgacaaaccgtagtgctttaaaaggaagatctttcaaaacaacagttttccaaaatgcgacgatctgccccagaatgacaggcagagctcaccatccctggagctgacaaacatcccagaattctgtgtatacaaatcagaagcaaagcagaatttgaaaaactcaattataactacactcaattatcaaattacatctttgatgctattacttgagaaagtgaatgcatttttttccacaggctagatttatgtccacaagttgcattactgattgagagagtctttcctagccatacacttctgagttgtgctttgcattttggtctccttactgaaagttgtatttaaaaggaggataagattttttctattataagtaaaatacacgcattgcattaaagagatattccaagtaattattagggctgaaaagcctgtcaaactatgaatgaaaatatgcctgtgcaatagagtaaggcatcaaggcagacagaataattgtcacttagtatagaagaaaaatgtatattcatatacatgaattagatctcatcctgaacacagttctccaatggaagagagaagcataagtggttatgtcccagaagtccatgagttctattagacaagtatcacattagcatgagacaaaaatcaaaccgatgcagaaagttcatgaggtagtacctgccatgctgcttttagcagcaggaagggcaaaggatatggagggacaatcaaaagaacagctcgcacgattggaggcctggtgggatagatccatgggcaaagaacaaaagatgtgcgatgtagctaagcaactgttacagaggatgcatcgtgatagacacctataaacctccaaggctcgcatgtggcctgtttagggcagtatgcgccaggaatataactgaatgcaaaaagacaaaagaagagtttaaatagccgagtgtgtgccagaagaaaaaatgatggaaactgtgtcttagcattgaaaacaaagctgatttctttcaaatggaagatgtcacagtttagtgctaaaaagacaaaaccaaggaatatttatggagctctcacagtcaaatatctggtgactgtttcccatctccaattccaagtttaatttttgtttttcttccattaatcatattaattgtaccatgtgattgtatgattcctttattttatgttcaaaaaacctccctcatgtaactcagcaaatgaacagatacttttatgttgtgattataagttttaaaagtatgaacatctgaattcaagtgtgaaaggcaatgtatttcattaaaaatagttgctttaatatacttggtacctttattttatgtttaaaaaaaaccctcatataatccagcaaatgaactgatatttttatattgcgattataatttttaaaaatatgaacatctaaattcaggtataaaatgcaatctatttcattaagaatagttatatatatatgtatatgtatgtatatacacatatatgtatatatacatatatacacatatatgtatatatacatatatacacacatatgtatatatacatatatacacacatatgtatatatacatatatacacacacatgtatatatacatatatatatatatatatatttttttttttttttttccctctgtcaccgaggctggagtgcagtggtatgatcttggctcattgtaacctctgcctcccgggttcaagtgattcttgtgcctcagccgcttaagtggctgggactacaggcatgcaccagcacatctggctcatttttgtatttttagtagagatgggatttcaccatttggccaggttggttttgaactcctgacctcaagtgatctgcctgcctcggcctcccaaagcggtgggattacagtcatgagccaccattcctggcctactttaatatattttgaaatcgtaatgacttaaccttctttctttttttgctttttacttgctgtccacacctccaaaaattgtctccaaaaaattttaaatacttatatcatcaaaaggagtttcagaaactgacagggtggtcaaaattcaagattttaaaggaagatgatttggggggcgccttagattggtttaattaaagagaagcccacttgaaagtttcatctggaagaattggaaaaagccttctctttcaatctctctcagtttctctctctctttctttcctaattattttcttcttctatcacaaagattttgaggcatattccagaatgatagggagtttcccaagttagaagaattgggcccagagttttaaactgcccctctcattaaaggaccccaaattactagaaatatcagccagcctgaattcagaagatttgcataaagtatgagtaaacaatccctgataagaatttattcaatatgggactgcaaatgttatttcatccattcgcatattcattcattctacacttaacactgctaacatttgttcattaatttgccaaatgttctctgtctccttgtacttaatacatgtgaaccagattttcacttccctctgtggatgcctctggtagccttaagagtcttcatagaaaatgtgaaagcaaaagtgtctcttcacatttgacatacataaatctggattttgtatagcaaagtaaaaattaattttatgtaccaaagggttaactttcaaaagttgtaaaggctaagcggtagcttttagtctgtggttggcctcatgtgaaggctatagaaaaataatttccagagttcaaagctccttgtatgttttatcattaattgattttctcctcaccttcctcctcctcctcttcctgtttctctgtttccttcttcttcctataaaagaaaatactcttcattatttgagtctcagggtgacaaagttgtgcaatcccttttggtgttggggaggtgggtgaggagcagcggtgtatccaataacagggcttgtgatgtttctaaactttgttttactgaaatcctacttgagacgtcccatttttaggttcctcccaaactactgaccacatcaggtgttgatatctttggttggatattctaaatagatctcctaaatcatgtgcttttacatagatgcttctatacctgtcactttatttactaaacagaatgtgatttgggattagagcaaactcacataaatgactattaaattcaataacacctatagacaggtattatattaactcaataatagctgtagacaactagttccagtcatttggaatcagataagtccttattctaaagtccctccattgagaaatagaaattgttggagaagaaatgcaagggacatatatatgttcattgaagataattcttaaaacacagaaaaacaaaagaaagaaggatagtaaaaattatccataattgcatagttcagagacaaatcattcaacatttttgtttatacccttctgatttttctttgttttccaagtttatatgttttctttacagaatcagaaacattctgtatgcactgtgcaacatgtctttatctttgctcaatatataacaaccacctttttgtcataaaattttcttttatgtcccttttaatgcctctgaaatgttctgttttatgaattagcttcatctaattaacgtacttcctgtcattgaatattatttgccttagttttttatactatagttaattttgccttaatgaacatcctgtcattaattttttgtgtacacatcgaattttctttattagaataaattcacaaaagaaaaaatgctaaattaaaataaaaatttaaattactgttttaagacaggagtgggggctgatgcctatagcctcagctactcaggaagctgaggtgggaggattgcttgagcccaggagcttgaggctgcagtgagctatgatcacaccacggcacttcagcccgggcgatagagccagatcctgtctcaaaaataaataaataaaattaaataagtgaagaaaaataaataaaatataggttttacatttaaagatttttaatagacatggtcaaattttgattcttaaaattggtatcaatttaaactcctaccagcaatacataagaaagtccactttactcttagcagcagcagttattgttacaaaaaaaatacattttaactttctggtctcactcactgtttacttacttatacaaaatatctatgtctttttaacatttatgtttaaaactaactccaggcataaatttatgaatagtttttttgttattttgattttgggggatttaatcagaactaatacctcagggaagacacttaacaatttttgtgtttctggttcgggttttaaaaacattattaatttaaatgtttggtattaaatctttttatgaagaggtccctgttgatatgaatttctgtcacattttatgttacctcctataaacaaaagaagtcaaattctagatttatttttaaataaattgaaaaatagactgtcaacacccaagaatttgaaggtatgatatagattatatttccaaacctgcacagtttgatatcttgtgttcaagaagattctgcgacttgcccacacaaccacttgtgtggcaagggcagggtttgaaccctggatttcctgtactaaatttaatatgtttctccattgttttctagtaaagccattaacatcccctcctgttcagtgtcacatttgcgtaattcaaagtgctcccgaaatgttacattagattaggtattagacaaaagagtctaagttggaggcggaaacagcctttttaaaaatacaggcaaatagacaatgtaaagattggattcttgctttttggggacagaaactcaggagtgttgtgtgttgagtctaatttccctatttgggaagacgtttcattgactttgttttggtaatcctctgggagtgaaggagggtttagaagtaaaggcatgcaggtgaatgtagcaggtgagttgaagtccagggtacatgtgcctgtgatccaaaggaggcagatagagaatgtggagagaggacccttcttgcccagagctgagcttcaggagcatgagagagccggaggtgggaaggagtgtaggaggaaaagcaccaggcggggctggccagtgatggctggtgctgctgggtacacataggctgctgcccagacactgtggcatctataggtccagctccctggataattgctcttctgtctttctctctctttttaattaattaaactccacactttccttggatttcaccagtttttccatccagggtaccacattgcattgactatgacatctccaacagcgacttccggtctatgacagtttctcagtctttatttttcactatctcatccatcttgaaaagtactgttcaggcaaatatcctgtagtgcttactaatctgaaggtatagctttcatagtttttcttatgattagacttgtgattacactgaggtcgtaggttttgaaacaatataccagaggtgagatacccttttgtcacatgatatccacatgccatcgctggtgatgttaactttcatctctcggttaaggtagtgtttgccaggtttctctcctgtagaaattgctgtttttttttctgtccgttctccatttattgaaatgaatattcattgactctattcattggatgccagtcactaaatctagccacctgcatgggagggcagaagttaagccccatctcccacagtgggcactaactacacattaaaatgtggatttttttctttaagaaagatttattctttcttactcatttatttatatagtcattgatttgaaaacagacaagcagaagggaggagaacgcagcctgccccagggagaaagcaactcttcatttggacaggtggtttgagcctctcttcttacagattctctgggatgcttccatctcccttcctgtctcccaccatatcaggggactgcgggcagcattggggagactgatgtgaaatgcgaggggcaggaggccccaatgtggacaggcactcataatttgatgtccccactacgtacatcattcatcattaccctcagcgtcaaacactgtcatggaggaatgatgactgttttctttcttttgtacccatgtgatggcatttcacaacccgagcccttagaagatgggaagcagctggccaggtctggttgctcatgcctgtaatcccagcactttgggaggcagaggcgggtggatcacctgaggtcaggagttcgagaccagcctggccaacatagtgaaaccccatctttactaaagatacaaaaattagccaggcatggtggtgggcgcctgttgtcccagctactctggaggctgaggcaggagaatcgcttgaacccaggaggcggaggttgcagtgagccgagattgtgccactgcagtccagcctgggcaacgagagcaaaactccatctcaaaaaaaaaaaaaaaaaaaaaagaaaacaagaagttgggaagcagcagcagctcttcctcatctttggtgagaaatcatgggcaagacagggcctcggccagggggctggggcagaggaagggaagagggtgcttcagagggttggaaggactctggatggaagggaaatgggggaaggtgaaagccaggaaatagggatcagcagtgcaactatgtttgttggagaacctttttttgttttaatgaagtctcatttcattcatgacaacaaattctgagtccaaggcaccgttccagggaacagagattccacttctgaaattcctagtgattagtaaagttggcatgttccttaaatcatttccattcattcattcatttattcgttctctcatttgctcatttacttaatcaacaggattaaatacatagttgttggatgcattaccccagtgagtgggttttcaaacaccttgctccaaaaactgacttaactagccatttttttattagccatcatcactgtcactacagttgccatttaaggagaacctgctatgtgctgcaaactaggttaagaatattacacaaagcatcttatttaatccagccaacaactttaaaaggtgagtatcattattcttatttatcagatgagaaaatgatggccaagtcaaaatttgaactcagattttattgttgaatacaaactctgttctcttttccctatgtcaggctgcctctctaaaaataggcattgtctcctgcagctccgtctctcccaagtattcagattttatttattatatctgttaccactaataacaatatttttaaaaataagccaatatgtgatgatagtgtgaaaagtaaacatggtaattaggcaacatcaaaatgaagttaattattgccttgatgactagggtggtttgtgtacagtcgttgagacagggaaaggcgtcacatcagaaagtggtactcccacatccctgccgtatcacaaggctgtgctcagcctatcaggggattgctggaaagggagcaaacctgaattcgctggtgccacacaaagactttttacccagggctgctatttccccaaggctttctctttattttgtgatatccctgtagcttccctttgaggcacagacatgaacccccaagttgtagatgtttggttttgtaacccagagtcccttgcctgctatgtcagcagccagatcctgattcacaggccagtttctaggctgtatttgtgcacactttttggtcaagaactttcagaccaaatcaggaatcagaggtcaagacaaccattccagctggatactagccctcaagagccccccaactttttttttttttccaaattcttaatcattgggtatctgttcaaatttattccaattatcctgctcacagcatcttctccagggttaaattttaaatgactccaattcaccttataatcatgagtggctaggttggatcttatttattcctatcttgcattataattagaggtagaaaagtaggcttcatcaaggtagtaggcagcctcacctgattttgttgctatttgatctgaacacttagcctaagtaagaaggcgcctgagtgcggagcttgttctacttcacagctttattctttttgttctggtggtttataaaaacgtgtatctggttccagtcaaggctagttctcccaattgtgatttgagtgtgtaacctcagcagctggcccagcaggttgtgaacatccctatgcctttcccccgaccttaaagagtcagccgatgcagagaaacagtagctaggtaggaagtgggtggatttgcataatttggttttctaagtgtagagtgttcatttttaacttacattggcttcactttgttgccaaaactcttttcagaaaagaatgcctcccacaattttctttccctcttcttggtccctaacagccgatccttcagatgtacatgtttgtttgtccaaacagatgagaaatcatctcagctatctctcatcaaaataaaactttctgtattaggcagtttctctcgttttccaatttgagttctatatagaactatagctgtggatggtaatgagtttgccatggcaatttcaggctatctgtactataaaatcctattctatccttgcataataatcagggttattaatgaggaattgaattagtagaaaaacagtagactgagccactgtgatttgttcgatataagttaataatcatacattatatagcatttgcagcttccttgggctccgaaagtgaagctatggtggcaaagagcattgtgatcaaatccacactaatgaagtaacatttggagctctgcaggggatgaaaaggaatgcattgttattgtgagtgctggagcattgtcctttaccattttagggtgtattgaaatgcataactaataattgtatttgcattaataaaagaaagctccaaccaagtcccaagcccctttgaaaaggcaaggctgagggtggggtgtgaaaatcataaagccgggtgtcttgaaacaacagttcattagggagggggactgtccttttctctgtgcagcaggttcaaatccataataaaacagattagaatctaagcaacttgagattgataggttaaattgtttacacaaagctgctttgagggaaaggatctacttttcaaggcaaggcctctgaattcctgttgggacattcttagaatttcacccacagctgacaaggaactggatgggtttttttcaaaggtggtggatttgcctcagatatctttggatttacattcgtttgcttttttgtagttactgcttgaaaagggaagcacatagacctagatgagcgaaaaaattctcaccaaatgttaccagctgaagacagccttggccagaccaagggatgtggagactaaagcaggctgaggaggtctctatgacctttcaggaaattacaagtgtcttagacagcttgggccgccataataaaatttcgtatactaggtggcttaaacaatagacatttattttctcagtgttgaaggctggaaagtcaagatcaaaattctggctaattcaattcctgttgagggctctctttctgacttccatcttggcttgctcacttgacttttttgtgtctttgtgcatgtgtgcggagagagagggagaacgcaagagagcacacacacacgtgcatgctgtctgggtcccttataagggtactgatccatcaggtgggactcatctaacatcacatggcctcttctaacatcccaaaggccccgtttccaaataccatcacatcaagggttggagcttcaacatacgaattctgaaggacacaattcagttcatagcaataagtgaacccatatttcggaataagtttgtacaaagtgggaagttggctgtctgttttaatttcaatccaatccaatccatttcattccagtccagtccattccagcccatttcattccattccattccagttctaacaactacctccctgagttctacctgtgcagccagcacaccattgtcatcgactccttctttctcctatgtacatcctttccctaggtctgattctttttggtggtcaagagcagttcgtttatttgttttcttcctgctttttctgtctccagtggtaagtcccttgaggaaagtgtgggaaagctttgtcctaactctgtttttcccttgccataatgcctgggggaagtaacttgaactctaagtagcaatattcttgacagtcaagggggataagaataatatttaatggaacaggattgttgtatgtgttaggcagaatgtctcagaagtagggtataggagcttggtaaatggcaccaggtgtcatgacaatgaataggtcttattctgatggtcttggcccagtgtgggaagcagctatgagagaagatgaaactattgggtcagcccttgtgttcctaactcagcacaagtctgtgagcttatgacctgattccgtcccatgctttcctaactgggcaagtgactttagctctctaagcctccatttctcatggataaaatagaatggagacactagttgccaccttatagagattgggggaggaataaatgagatgatgtatgggaagtgcttggtttgtagcatatactctgcaaattttaggtaatattattttttaaaaatctgtaatctggtaagcaatatagtttttgagtctttatcatgcctaattgactcactgagctgcacatggaagattcagagattaagaacaagatctgccctgtggaatttagagtgtacaggtgagacaggcattaatcaaagaccagacaatacaaagtcgtaactatgataatgaccgtgaagcaaaattcctggtgctatgggattgtgtaaaagtgacactcatatttgggctggcagctggctgaacagaactacaaaagggatggactctgggaatctcaagatccccctattatgccagaaatcacgagaaaagctaagacaaaagggctaagaaggatgtattactttctgacgttgcaggccagaatctagaatttattacaaacaacagaaatgaaaacagaatagaatagaacagacctgaagtatctggataatgcagagcctgttgtttttagcatgagaaaaatgtgtttcctagggaaaaactgtatggtgagagcaaataataggagggggtcttggttatgccctaatattaaacagttacacgacaacgactcatacccaaggtgttaaaaatcaatgctaatgatggaacacttcatgcggtcgttattttagaaaacccctaatcaaaacaaatgcaaggggtgaagtgtgctcagtgccagagttttgtgtgctccttagaaagacgatctattccctggagagaaaggaaaggatcagaaatgataaccacttttaaaatacatcagcttgctcatgtgtcggtgtattttttctttatcagcttttcagccaaagcttcatttgatttgtgcagggaggtgtataataggaagaggccagtgagctgatttttatagagtctgtttgtagcttaaacaaagatgggggatttggaggataaaagcggcctgaaatatagcagattatgcagctttatttttcaaagatttgttaattcccctcctccctctcctgctctctggctgagccggtgtgttttgtacttttttttcttttcagttgccattcaaagagaaaaatctaagttttaaatgtgaatttccgactgaatttcacgtggcccagctgttactgtggccgatcccctgtaagcaaatgtgcgttacccttaaatagtgtagccttatgataaataataggatgaataaaggctgagcttataaaggcttttttaaaatgacaagcgtcattcacagcatgaggagaaagggctggagggtttgtgtttttgttcttaaagtgaaaaatgatgaagtttgttttgaagtctgaaataatctgcaatacaattaagaaagagggaagcactcaagttttctgcgaggcaaagacttgcctttttctgtgtaattcaggagcttgtcatccatattttcaggatctggctggtaatgacatgaaccgtctttcatgcattagcagaccatagatctatacccaagtccttccaataaaaaagggatctcatttgatttttaaatgtggctttaatttcttgacagggtttagcactttatttgcatgcaagctgcctgggcaaaaagtcttgtggagcctcattttagaaacttttactgctctattttatttttagtgagattattactgtctgttatttagccttttaaccaacatttattgtgccatcatctcacacaagtcctttgctgtgctccttgaaggatagaaagatatacgtgatatgatcctgccctcagaaagaggatgctctagatcatctatcaagcctgatgtaccagaatattttcatattgcagttggctagaaaaattacaccaatataaagaatagatgcattgtgtgagttactgtgtgagtttctgtgccatgtgataatgaagcttaaattgtaaatacaatcactatttctgtaattaatatgtttatataagcaaaaaataatcctttttgcctccctaggtttgaagtacttaaaaaaatttggagttaatgttaatgctctgcctgatacttgatactatactgtactgtttaattatctatccatccatctagctagctaatctagctatctcatctctctatttctatttctttcactttactctgatatattaaaatgcacagtttctgggcaagctgacatctttgagcctcttgagggacagctcctcatttaagagatcttcttgttgcatgaaggatttactcttccctccccaagcttttctacagcttttcttttcaaataaattttattgtttatcccttttttaactgtctgataccatgcttcttatccttctttccacaccctgccctgtgccacctccttactttttctttaagcatcctcacttttatatgcaaaattaagtaacaaatgcaacttctagaaattcctccagttcccccatagtaaatctttgttcagatctccagcaaattgtagtaagatgagtcggaaaaccttggctccatttttaaatggctgctcccatggagccttgagaatggttagactgtaaaccttcctgagcttccttcagtttatttatctgtaaaacttgggctagataatgacccatgctccttcccacattaacatttcattattatatgtcaattcatttaactgaatagaacttgcctccatcttaaaaaagcaaaacaaagaaatgaaaaatgaagacttaatcaaacttcagaaattagaggttttaatggtaggacagaaagagtgggatgctagataaaaattagctttcgggagatataagaaaataaacactggctattgataaggcaaaacgaatatttcagaagtagctataaagtacctctcttcaaagcaaaatgtcatctcttgtgcttgaagaatcattcaggagacagaaggggaaaagccaggtaagaaatacctcaaaaaggggttcagagatgcgtttcaactgcattccccatgctcgagtcttcccagttcctggagcggggttcagagatgcgtttcaactgcattccccatgctcgagtcttcccagttcctggagcagggtgcagagtgcacctagacctgcatgtgggcttgacagacacacaacctctgctttttatcatccctgggacaccagccttttcgtttggaaattgctgaggttgtttcttcctttctgcagaaaagaacctcccctgctcttctcctaggagaaaaacctaagaacactacactttctgatccatcttctaatgtcctgggattttgcatgctctttgagttgatgaatcaggaatcgtgcccctggcagcctctaccgaacttactagttctacttctaagccaccctgagaggaaactgatctctctcacccatcttttaaatgcatttcatcaatttcttaatccgtgcagttatttaggaactaacttaccatcaagccaccttaattataccatttttctaaagcaaaccgacccatgttaatgtgaacattgttaagaaataattatacacacacacacataatgtacatatgtaattttttgcgtttcagatttcttactgttagtgtctatttaaagcttttgaaagagacccagtcttttctggaaaatgtgtgaaaatagatttgggactgttttgtcatctgctgaatatttttctctttctgagctttaattctaaccaacgttcaaaaaccccctatgcagccattgaaaacatgttattggtaatgattctgtttgattggaaatggccacaggctggtcctccctcccctttaaagtcttccttataaataatatattgtgattcggctaaggtggcttaaacagcttttcgttgtcagcattttacttaacgcacatgaacgttttctggctgttgtgtagttggccaatggtgaactccacatactcatttgggtttgaacaaattcaaggaacctgattctggcgctgcagttttcttctcatattccttgcctcctgttattttgcatgtactaaaatataaatgtatttattgaggatagagcacctgcctggatctggtgcatgcataaataccattgaatttcatctgcactgtaattctacaagtttggatttatcattggtattcagaggtaagaacccaagactcagaaacgttagatcatttgtcttatgccacacagcaggtgaggggatgaagctgaattcaggaacaggtttttactgtaaactgagcatttgccttaactaagctacatgcattgttagtagcatgtgacatgtttttaggtggcaattgagtaaatagatttaataggtacttactttagtacttattaggaaattactatttttctgtttaagataaaagtattataattaatgttaaaataaaaattttatatgaaatgtatatttaaagaaaacgttaaacaattcagtggttacatgcacataaaaattatatataagtatataatggatattttatgtactaatatcataaatatatgatatatacatataatgtatatttatacattatgtatacatatatatacataatatatatatatatacacataaatatatatatacatgcacataaatgaagaccaaccaaatgagaacaagcaatggctatttatttagagcttgctgtagcaagggagtcagccactgtcacttgcttttggtagagactcaaaggcaggcagaggagtgggaaaacttcatagtgggaaaaagggaaggcttcaggtgtgtccctgagagaggtctttgatctggggactctttagaggggctaagtaggagcaggcatgcaatgtgattggttagtggtacgtatttggcatcctctggtcggttctaagtagaaagtgggaacaaagattgaggaagctgtcagttattaattaaagtctggccaatttgggctgattgttacagaagctattgtttagcttcctggattgttactagagatagcgggatccggcttcctgcaagtctgatttatggcaggttgtcttcctgggttgtttattgcagataaggggttggtttcctggacaggtggctgcatgctgtaggtcagagttctacttttatgtatggtctggccattgtctattggcatattcaatctctctctctctctgtctttctctctctccagatgtatatatgtgcgtgtgtgtgcgtgtgtgtgtgtgtgtgtgaacttgtgtatgcacacaagaggtagacagctatttagatattttatatactaatggcttagcatgattaataactcagtttcatgtcagtgaataggtggggctagctttaatatatttatccaagagaactgttctgctgcttctatatgtggacaagcagttgcaaaagagagaagtggataagtccttattaaaattggagttactagtttcggacacagagtaaatagatctcagacttttcctgtttctaccaatgacatggtatctccatctgcaaatcattttttatgtctggacttaaccttcctatgcttctaaaataaaaattctaatgcctatcagttaactaaatgactagaataatgtgtatgtgcactggggagtacctcctaagcactcttcctcctcttgtgaaaacttctttcggaattgtttaattactcatttatttaacatttattgagtcttgagtaaatgccaaagtttgcatagggtttggattcagatttggatacaatatctgctcactgtaatttgggcttgctaatcaatgagatgagggtacctgaaaagtattgacatggctcagaaggtacaatctgtgaacatggttctggaaggagaatctcacagggcatctgaacttgatactatagatttaccatagcccagttaagggtaacttgaactggggctagagagaagcctgagtttagtgctgacttcattcactcaacaagcatgtttctgccttccaggtcccagccctggaggcacaggtgaacgagacaggattcatgactttgataagtgcagagagaagcaaatgtttaataacacaactatctagttgccaaactaaggtgattttccctgtacccaggtgcccacaaatctccctgcatccaacacactccagttacccattctccctcttagtaatagaacacagatacccagatagtacagcaaagacatgaacttcacattatcttggtagtttcaaatataacagaccttgggacagaaagctgaccagagatggactttgggttgttaaactaatgtgtcacatttaaatttattgttgtcataacaaaccccttaaaaagcattttctatatttgtatgacaataagttttttcctttattcattcatttgcctacacagtttttgattggctgcactgcactaggcactgctgtaggcagtgaggagatggcaggagatgaattgatgaaagattctaactttatggcactgtcgtttgaatggatgaaaaattggctctattcaaacgtatttgtcctattccaggtggtagcaagtgtcattgacaagaagaggtggtagcaggaggaggaatctgggagtggagggtgttgattcttactgtaggtcagtgaagggctctctcattcacaggcattttagcagggatctaaagcaagtgtgaaaatgagtcatgtggatctgaaggacatttcaggcaagagggcagaaaactcaggtttctgaaagtggggtctgcttggcatgacaagaaacatccagaaggtccacgtggctccaggggactgtggcaggagataataaggttaaaatcaagagaagacagtttggaggtataagatggggtgagttcatgtgtggcagggcaaggaagtgatatggtttaaatatattccccaatgttcatgtattggaaatttaatcaattcccagtgtagccatgttgacagggtgagacctttaagaggtaattaggtcacaggggctgtaccctcaccaatggattaatgctgttatcatgagagtgggtctcttatcctgggagtggctttgttctaaaagcgagctctctcacacttgctctcctgtccctcttgcccttccatcttccgccatgggatgactctcaccaggtgctggcaccatgtccttggacttcccaacctccagaattgtgagctgaataaaagtcttttctttattaattacccagtctgtggattctgttacagcaacaaaaaccaaagtcagacagggagctaggttatcctaataccttattcttaaacattctttctcaaaaactttgtcatcattaggaagtgtcttaccttctgtgcagcttacatgctatattaaacacagtacagatgctccttaacttactgtggagttacatccggaaaacccatcataagttgagtacactgtaagccaaaaatacactttcaatttataatattttcaacttatgagagtttatctgtatataaccctatcagaaattgaggagcatgctaaatatgtattgctttcacaccattgtaaagtcaaaaaatcataagtggaaccatcataaggtgaggactgtctgggccttcttgctgtttctcatcatgccaaacagaccctaccctcagaaccttgagttttctgtcctcttataaacaaatacagtatttattgattacctatcatgttacagcttcttgggtcacacagagatgaacaaaccatggtcctgacgtaggaaagttggcaatcaactagataagaaagattggataaagacagtatggtgagtgccgagagaagaatttaaaccatactcacctcatttaggatacgatggcatctttgcctagggcacaaaagagatgacagttgatacacatcttaaaggatgaatgtattcaaatggaatttccttctgaggctagccctttaaaaatatctgcttaatagatattttgctatattgtagaatcacagaaaaaaaggagctaaagggtcctgagaggtgtcctgagagggcacccagttcatctctcatgttttccagctgagaggcagtgtagcaggtggttaaatgtgggttggaattccatttgatcccattaacatgacccctgctgggcaagctactttctgtgcctcacttttgtcctctgtaaagtgggtttactaatggtacttagtttataaggttgttggaaggattctctgaactaaaatgcaaagtgcttttagaaaaacaaccaaaatacatggaagaaagctttcatgaagtagtagctgctactatgttaagaacactgaggcccagagaagttccataatttgcctgccgtctcttaggtaattattgacagacctgaatctagaacccagattgttctactttctaatccagcagcctctcatggacacagcatttcattctgtcttaaattagtttatggtattttaattttttatttaaacaaaatgaaaatgaatttgaaacttttatttactttgccgagccatggactgtggcttagaaagtgaatgattcataccttatctctagttctcttaaattcttggaagcatttgacaaacatcactgtactttcaccctctttcggctttagattatctagactaactggcctgtgcccaaccctatcgacagagtaactgggtagttttagtgtcaagatgagacaaggagacttcctctgtggttaggatcagatcagtgtgagtttcctttaagaagcaaagtacttttcatctgctgacacttcacaatttaggtttgttgctccatgtcctatggatacatttgtgtgcaataagtttgccattttccccctcagtttttttgttggatgatctgaattttagagagcccaggggaaatttttgttaaaaaaatgatgctaattttaatggactcagtttaattaataattctaaaaaattaacatagatattaaaagtgaaagggagaaccggaattctatctaggaagtgaatactttttaagccaagagctacttcttcctgatcatagaaaggtggggacacagaatttaaagaccagaggcaaaacatgctgtcccttatattttggattatctatccgtttgcttcagttatcaatgtggataattaagaactgaccctgatttaacttgcatgtattgtgtgcctgtttatagatctttataccctcatgggaggctataaaaggaaagataaggttcattgatttatttccaattttacaaacagtccaagcatacacttactcagtcatttaaggacagttttatcaacagtttaaaaatatgatggagattaaatatgtaaattgccagaggacatagttttggaataagggagtttatggtttgtcaacttcagctaacatccaatgctgaattttttctctaacttccctgtcaagtgacttgaacttgggcttgcattccatgacagatggagagctttccatctcttggatcagcctagtctatctttagactgctcttgtgcttagaaaatcttccttgtattgagaaggatcctaccgctttatagcttctatccatgaaataagataacgattttaaagatcttggtcctttgctgcaacatggtaattccttagtaaatgttaatgactattaatattactattattgtcttagaaatagtagaagtagtgttacataaatatacgaacatccatattgcttatttatggtgcatatggttaaagcttcctaattaagttaatggggacctgacaaagtcaattgaaccaattgaccttgatgagttgaacattgatggttgccatgatgccagaagatcagagctggcctctgtctctggacatggagatttgtgtttgaactcaggtgtgtcagtcaaggttcaaccagagaaacaaaaccggtaggagacatatattaggagaattattgcaaggaattggtttatgtgattgttggggatggcttagcaatctgaaaattatttggcaggccaatggagatgagcgagctggaactttcaggtgtgagctgacattgcagtccacaggtggaatttcctgttcctcaggaaagcctcagctctgctcttaaggcctttcaactgatttaatactacccgcccccaccacccctccacctctcattatctaggataatctttcttaaagtcaactgattaggaactgaatcacatctacaaaatacttttgaacatatacctggattagggtttgattgaattactagacattagaaactagccaattcgcacataaaatcaaccatcacatcaggctccaccatggactttatatgaccatgaatgagttattgagtctctcttggcttaagagagattataatagttgaagtttaataaattaaaggaagataaatatttaaattagctttgattttacttaaaataatctctagaatctgtatctggttggtttttgcttcaagttgtttagtgtcattagatttcagtttcctcatctgtaaaatgagcagaataataatatctagccaatagtgttattgtgagaagtgaaggagagattgaatttaaaattactggcaagtcatataatatatgataacaaataatgcataattatgggataaaaaacaacacttaggaacacttactctgggtcagacacttataaatgcattacctgggttaccttgtttaagagctgcaccctctcaacactgctgcattagggattggttaaatttccaacacatgaactttcggggacatatttcaaccatattacttcctaaaatttagctaaaattaccgtggtccaggaacaagaaagataggattctaagacactttagcatcttcaaaaggatgaatgggaagaacaatggaccatgacgaatattttcaagtgatttttgatgctacagaaggccttctcaaagaacaagcgtcaaagggatggtcatcctctgtggaacggacatagtaaaaataaaattattttgactgactacattgatcttatgaatatattctgtcaagctaatgagcttatcatggctctatgtacacactttctttaaaacaaaaaaaatctctctatagttggttatgttttctgctaaattattttagcctttactgaaggagtaatctaccagttgaagctaacaaagtggtcacataagagttgattcaaacacttgaatcatatttatgtcaagaagaaaaaatatggaaaatcaagcaatttataaaagttgtttaacagcagtttgtccactgagtagaaaataggtttttttttttcttcttttgcatttggtcatgacttttcatgttacaggttgtttcttcttatatgcctatttattttgagtttcaatttgtacaatttgctacaacgtgtaaacattagattctggaaatatgtagaacagggcaacaaagtttaatctctgtaaaatgtcactggggaaaatagtacaagtagtctacagatattcttttaagaacaattgatacctgtttgtcatttattactgcagcatttccaaaagaacattctgtgagtattatttccatgggatgtcaatagataaaaatgccatccatgatcaagtaagattgggaaagactgatttctctaagttaaactgggttatttgatacaatatttcgtacagctcttatgcgagggtttgtcatgaatctctagggtaggaagtactccgtgattctcaaattgttgaccatgacactctcctctgatttttggagaaatatctcaaggaatgatgatcttcagggcaaactttgagaaatgacagagcaatccttaggtcaatgactacacatatacaggttggctgactcaatttgtagctctcatttttgcccatgtgggttaaagatagcagcaagagtaaaagtcatcagaaatttttaaagccatgaaaaactcaaactcagtctcatcttgaaaaattctttaaattgttttcatttttctctttcattgcattagactcgacatattcaatggattgaaaaatatatacacatacatacatatctgtgaagttatgtaggttacatatataattatatattataatattttcccttttaggctggcaattcctttaggacagaactcaagtcttatttgtctctatttccccagtaccttgtacaatacccagcacccattagaagctgaatagaccattctttggtgggttgagtgagtaaagatgtaacactatcaatactctaccccccaccaataaaattcacttttatatgcatttttaatgtacatggatatcttttattaatttcaccctgggatccgcattttgaaagatttttgtctatcatactgtatttattacatagcaattaacttgtatttccattatttgctattgaaaaatagagcttctgattacaagagataagtattgctgtcatactgagtttctaaaattcctgcctaaagcaaagaaacttgctatttcacttgacattggcagccatattttgaggaaaactgatgtgtttaagaagatttgagcctgggaagcccccattaccactttcaggaagacttaaagggcataaatgcgtgggagaaatttgggcgaaataccaagcgatacaatcagtccagccaaggggaggtgtttatcagatttgtgtataaggaaacataataattgcatataaagttatcatatggattcattgttcacttgctggtctgtgtggcagctaaatgctgatgctttgagacatacagaaaactttttatatgattattaagattcttaaagtataagttttaatcatagtttgagatcatttttttctcctctgggaaaacttctcagctagtggaagcaagtcagtgaataatgactcaatagcagctattttcattacccacgacttttctggaatgcatctaaaatgcaggagggggtatgattggggttggaggcagaatatgttttgtattcaaagtaacaatccagttttctccagctactacccaattaaccaggcctgctttttctgacctgcagaataacgagagttattgtttcccctgcggagtcatcttctgttcaactatttctagttccattaaaaaggaaacaggaaaagagagtgaaataaatgtagtcctcctcatcatcattattattattattattattattattatttgctattagctttggcaaaaagtgaagaaactaaagctactatggatggattttatcttcagactcccctttttctgtgctaacctaaccatctattactttgaataactgagaaacagctaatatattaaagtcttttaaaaactttatctgcaccattacttattagcattttttcaaattaattttaaattaaatccccttttatgtttaacttcattttaaaccaccatatccactaaatcatggccttgatagattagtacacattaaaataaatacatgaatattaaaatttagtataaatatttatctgtacctgtactaaattactgcatatactataatgggacaagtgccatgtttgtaaagctctgttccatggggcaaaggtgaaaggattcaatccatgttctgagaaattctagggtacggtatgggatgggacagggagaaatgctttaagaagaggccaaggggctttggttagtcttcaagccagttttcatattttgtaatttggagtttatatggataaaatttcatttgaggaaaagagttcaaatgctaacccccaaattctagatttaaaaaccactgatcattggtgacgaaagtttattttattccctaaggcctcatatactaaagcattgctacttcaggtgtcgcaaatcccacattttgtaaatagctcccacatcagagcctggctttcagagccttctacaaacctccttctccaggcttaaaatacacagttccctaaacaaattctccacttcatcccaaatattctatgtattattccgtgaatgcgggctttgagcctgacctttgctcactgtataattccctccagctctttgaagctcccactcctgggtttgctgaaggcccactatactgagaagcaagaagcattgttgcaggacagcctgagccatattcctctttgaaagcttaaagctccagaaatttgctgtacatcagaagggtttgttccttctttcctttaagaaaaagatagaaacatttctttatgattgttactctcaagaaagtcacaccaagatctgcatgagccttacttagaaatataaactttgcatattccagtaaatgggacatataagcctaagaagttactgggagaaatctgtgtttagaaattatgttagcttgcttttaaatgctactactaaagaacaagagggacccagctataaactctgccttaagtgaactaaggatatcatagttgccactcagtctgcctcgaagagattataaaaaaggtctacagcagcagcaccaccacttccatgcacacgtattccttgtggttgactccttcttgtgggttgaatactagtgacttccccatacaccaaaaaaattaagttgaggagatcctcttagtatgagaaagagagagcaaaagagagtgtatgaaaatgaaagagagatttcacaagcagatggctggaatccatgtggcaatatgtgaaagtcatgtaatgttttcacttatttgtgtttctgatgttgttttattaacagaggaaaaatggataaggaataactctcagtcttgtttcatatctctgatccttagtgtcttgaatttctctgccttattgctagttttaatcaaagcccaaattaggtctaatatagagaagagtcattgctaattttagcaagaaaagcatagtagaatcatgttgacatctatagtccagtgaccagtatggaacctgagacatttcaagcatttattcattcaaaaagctgtgttgagtgcctactgtgctgtttgttaatgaattaatgattgaaatatgatagtacctataatctgcataaggttggcactttgtatggttgtatttgtatgggaggcagcatggaatccttgtttgagtgtgtactagaggccttctgcctcctggtttaatacctgggtaatgtgggccagttagtcaacctctcactttcctcattggtaaaatgcatacaatacaagcttctatcacatcgggctgttgtgtgggttaagcatgataaggcacatgaagcacttagaaacaagctggtcacatatgacatctcactaaatattagctatttgttaataagttgactgtgcccccaaaaaaagatataccccagtcctaacccatagtatttgaaaatagggtctttgcaggtgtaaagttcttgatgagatcatcctggatttaaggcggtcctaaatccaatgaccgatgtccccagaagagaaaggagaggatattgtgtggcatgaaggggaagaccacgagaaagccaagtgaagacagagacagggattagggtgatgtgtctataagcccaggaactccaagggttaccagcagccaccagaagttaggagaacggtatggaacagatgctctctcagaacttccagatgaaatcaatccagccaaaatttttatttctgtcctctacaactgtaagagaatatatttctgttaagtcaccccatttgtaatatgtgatagcagacaggaaactaccaggctgggctgtttcatagactcaagtagaagagaaggactttaaagatagaagagaccttggaagccacctgttctagtgttctcatttttttcccagaggggtgatagagcttgcccaaagctacacagagagtagtcctggcagcaaaagcacctcaagtgcaaaaaagtcctccagggaacaatgccaggccactgtccccaagaaagctgtggctgcccaggccagctgaagccagtggagtgggattcctcacatccagctagctgagttgagcatgtatgtactgctcacctgtgcttttcttgaacaagtaaaattcttgctgaagaagcacagcaaacacatgctactttccaatgtcatcttccaagcaaaacagtaccctcattcgaatgaagatttaaaaaacccctccagtttcttaggataaacttcttagcatggaactgctattagacacctttttggttcctgctcagaggaggccagtttccacccaatgacttttttgtggctatttctggctacttgtcagaaggaagctgttaatgctttttaaatatcttctcgccggtgaatgagctctacctgctcttaatatctctctggctagtgtccttgacctaacatttgtcatttctgatgatctcagacagaaataatctatcaatggacatccacacagaatgcaatggcaaagctggaatcaactcgccctagccagagtctattgctagaaaagaagcaatgtgaacattttctctcaggcagatcaagatgggctatgagaatgtcagggagtagaggattgtctaacattagaaagaatttccagggcagcctatgaaatccatccctcctcttgtcccactagctctagaaatggcttctactgtgtgcccttcagaaaatttcttaacctctctgtgcccccattagggttttctactacataaaacatagaaaataattatcccaacctaataaagcttttaaaatgaagactacacaatgattcacagtaggcacataatagcatctggcacataattgttactcagttgaggttagcaatctccattgttcttacttgtaagcctagaatccttttggccacccaccctcaaatcctttaggttcccaagttctgctgatgctgcttcctattgttagttcccctcatcacttcctttcatttctgatctgttctttaaaaaaaaaaaagctttactatttattttatgcatattgtaaaattcaccaattgccattaagtgtacaattaaataaattttgttagcatatttacagagttgtgcaactagcaccacaattcggttttagaatacttccatcactccagtaagacccagactgcacatttgcattcctactttctacttctagcccaagtcaactattagtgtaatttctatgtctatagattttctttattttggacattttcaatgaatgaaatcatattgtgtttctggcttcttttacttgactaatatatttgaggttcgtccatgttgtagcatgtatcattacttcgttcctttctattgccaaatagtattccattgcatggttataccacaatttatttatttgttcagcaattatgaacatttgagttatgtccactttttggcaattataaacaattgctataaacatcagtgtataagtctttatagaagtatgtttttattgttcttgaagaaatatctaagagtagaattattggatcatatgatagtttgatgcataacattttgaggagcttccaaaatgttttccaaagcagctgcaccattttacattcccactagcaatgtatgagggttccactttctccacattcactccagtagttgtgattgtatgattatagccatcctagtgtgtatgaagtagtatctcattgaagttttgatttgcagttccctagtgactaatgatgttgagcattttttcaggtgctttttggccgtttgtagaaatttcttttcttttctttttgttttttttgagacagagtctcaccgtgtcacccaggctggagtgcagtggtgcaatcttggctcactacaacctccgactcctgggctcaagctattctcctgcctcagcctcccaagtagccgggactacaggcgcttgccaccatgcccagctaattttcaaatttttagtagagacggggtttcaccatgttggccaggcaggtcttgaactcctgacctcgtgatccacccgcctcagcctctcaaagtgctgggattacaggcttgagccttgtatagctttcttcattggagaaatgtatagtgaatcctttgcccatttgtaaattgagttgccttttattgttgagttagagttctttatatattctggatacaattcccttactggatatatgattctaaaatattttctccaagcgtgtgtactgtcttttcatttccttcaggatctctcttgaagcacaattttttaaaattttgatgaggtccaaattgttaatttttttcttttatggactgtgcttctgtgatcatatctatgaaatctttgcataacctaaggcctatgttatcttctaaaagttctattattttaggtttctgatccactttaaatttattattacatttgatgtaagatagggattcaaatttgttcttttgcatgtggacagccagttatctcagcaccatttgttaaaaagactattcttttcctattgacttgtcttgacacctttgtctaaaatcagttggttgtaaatgaaagggtttgtttctgtactttgaattctattccattgatctatatgtctatccttatgttggaaccatactgtctttattactgttgctttgtagtaatttttgaaatcaggtccttaactggtctcctggattactagcccatcatcctaactggtcccctgcctccactctttgccctttgcagttcattctatgcacagcatccagggagaccttgttaaaacccagatcagacttgtcacccctgtgtaaagcctttcatttgccccagccttaataaaaagtctaattttaccttagcaatcttgtccctgccaacacaatcatcctcactttttcccatcttcacttctttcttcattcatcccagcatgactgagctacccaagttgcccaatggtgcacatgctttaccttctttgagcacgcgagagagcccagcacagtgtcctggggccaagctcagtgcctggcacaaagtagatctccaccacctaaggctgaacaaaccataatgccgtgattcttccctaaacaccattttgctcttctttttaaactggttaactccttctgttttctctgaccaaatccttccctgttgtaatgcactttaggtgccctagaagtacttttgctgtattacatcagagttataggtttacatgattatccatccccctagattgtaagagtgtcagcattggccattatgatgcctgatactcaatagcattgttgaatgaatggacagattaatgtatgttttgaaatttcataaaaagctaagaataccttagatttgtggggtgtagatcattgctgattgcagtaaaattgtttcccagccacaggcaataagggcagagccaattgcctttcggtactttagcccatcatctccacccacagctttgcatctttccctgttgactcaatgtattattgggagatggttcagggcagtaaacagtgggctggaattgagaagagtggaaaagttaaaaaaggatgacccttggcctaacaataaagctcagtctaaatattgtttagggatatgtttctgagttggatgcccctgtgaaaatcaaattcatatccttagagacacacttttttttgtattttcttaaataaaaccttcctgttgactacacaggggtggctttctcaagttgctttctactttgggagtctattttattccatctcaatagctattatttgtcttttattccaccttctggggtcctgcccacaaataaatagcttcagattcctcgggaagcctggatcctccacaaactctcagtaattttcacatcattatgttactgacaaggccaactccaggaagaatgatttgactgtcagatgccagaatctgaatgaaaacactccacgttttaaagctgtcggttgatttgactgtcaaacaaggcatttttctagtatttttcagactgtatgtattcatggccatcccttcttttcctcacaggccaggagagaacatgtggagaacaaaatatctaatcccatcctgctgttttcagctgatatggcaagtgtgggagtgtcttgagttttatttatgaaggcagaaatatttttaaaaactattcttcttcccatcccatcagtctccactttaaactctctgtttatatgtatgaatatatcccaaaggatttaagctatatatgacacattatctatggcaaacttggtagtgtatgtgccaaaggatttaagctataaattattaagaatttaaaagaggcttagggctcctaatctcaaatggcctctcttacttcttccttaatatgcttgtatagatcaaggtcacatggccaaatatctctaggggtgtatggatgcgtaaaattggccaggtagagaacctggtgaactggagagttcatgccccatttaaatgagtcattcccaaaaagctgcaggtgacattccctctgggattattctcacttatagtatttcaagatcctctgatatttcagaagaaattgaaaattcttctgaattctccaattcagtagaagttgaaatcttttaatgtaaaatggtattatcttaaaatgttttacgttggcaaaaaattcaatatttagaaagacaatgtgcaaatcaaacaaaacacttttgcaagccatcctttgataaattcttgtacagaaggttcttaccctacaaatatcttgtgagttaaaagtttatcttagctaattcattgagtgtgttcaatgaatattaattgagtacctttgtgtgctgtgtgccaaatcatatggactcagtgctagacaagacagaccccatgtgttcatgtgaatgatattctaagtcaggtctttgggaagtgaggcccttaggtcatagtcacttggtttataaataaaagatggagtttcccattgggtcttgaggcagactcacaatagttttgaacctctctctgcatattatactataacctgcagaataatttttgtgttatcaccatttctactcaaatatcatctaccatatttgaatatatcattatcttaaaactgctcattaattaaatacatttttaaaatttaacttattcaagaaatatttattgagcagctattctgagctaggcactgggcaaagaaatgagaattcggtgatagaatagacagcttctctagcatagagagacttctacccaagcctgatgctgagcagatggttcaaggatgagctgtcattgatttcaaaccccagcttgggagtaaagaagggagtggacaccttctgcatccaaagtgttagaggccccagggcaggatgaggtggcttgcagggtagagacctgcagagtgaggagaagattattgtcattttccctttcaataaaagccaatgtgttgcatactccaaactcccactgaggagaaaagcaggtgttgggggaaagatagctcccacagagagcacaggaagcttgaagagggagaagagaggcttctgttcttataggtctttgtacttccctaatataattatgtctatccactatatcataattgtctttccttttgactctaagttgtgtgatgaaggaatcatgtctacctggtcccaagaatgtatcctcagctccatattaacagtctagtttgtaatagatgcaccatgattgttgttggctgaagaagaagtttctctcaggccgtatttgcagaggaaggtggtaggtggtaagtagtgggtaaattcccacaaaagtgaagtaatgaggaggagaggggaagaggacatgtccaggggcaatatgggtagacaggaggagttaagtgtcctggatggtaatgaagtagatgagaagcaggtcttggaatgggctgaccattgggggttctctgtgtgtgtgtgtgttttaattttcaaaatttatttattaattttttttaagacagggtctcgctctgttgcccatactggcctcaaactgctgggctcaaacaattctcccacttcatctccctgagtagctgagtttataggtgtgtgtgccaccacaccctgctgggctgaccattttgtataagtgacttttttttcccccaaagttgggtgtaagtcaaggattcctgtggtgagcttctcagtgaaagatgaattaccaccagtgagccactgttaaaagaatggagtttccaaattagataaaactcactttgttaagaacaaatgttaccggagccatccaaggtcactgtgtgtcagtttgaacacgggaaatggctcatttgaggcacacacgcaagtctttcccattctgtattatctaagtttgcatgtagagctccttgcttcccagctgtgagtcgcatgggcctctgtaaaaggtcagtgtataatgatacaacatctttcgtgatgacattttttcacgatgtatttttctacccaagatttctgaaaatcaatcacccagattttaagcatttcttttttgagctgaggctgagcagctggatgttggaatttgccatcaaaccattcacccatctctaacctttaaatgtttggggaggaaaagaaaaaaaaaaagacaggtgtaaaataatttagtaacccacagaattgacttagtttaatttatgctaatcatggtatattggtgtactggcaaataaaaatgaagccggtagagaagattgcattgaataaactgcaacaattaaccctcgaaattatcacgtgaaatgattttagtttgctattgacaataacagtcccaaccaattgtcttaactagtgatgattaaaaagctgattaaattccaggatttattttacattactcccatgtccatttggccattttctgtagtattttaattataggggtttttcttcctttaattttgtgctctaaaggttagagcacagtattagaattgtatttcattattatgctcagttatttgccaaaatgtgtataatagaaagatagtagtcctattatttgtcacaagtgttcaggtaaagttctcagtggcataaaatgacccaaaacattgtcttttgggttctgagataatcacatgaattagcagattttatttcatcaattttttttaaggctttcatgtgtagcttctgttcccaaattaagtaaatgggattattattaattttactgagaagggcaaaggaattaaaatgatgaatattttgtttaaaagttttgcagactttgcctcaccctggattgtttgccaaagtgaaattaatcatttgcctggagagatcgggatgttgagggtacagaattgtggtcagtaaaggtagatggaacaaaggctatgctcgtacactacttagcaataatgagctacttcctaaatgactgatccctgtcaccctatctgccttgaggtatctgagagctgcagtacttgctattttatttttctgaatgttttcttcacacagctggctcctacacgtaatttaaaatacagccagctatcacctgctcaaagtctccccagatttcttctacgtttgagttaaatactccttctcttatgtccccctaggaagaactctgtttctatcaatgcaaacacttaacacactaaacttctgatgtctatggaattgtgtttgctactatcgcataaataacttaacacccagaatcatgatcttgctctttatgtcttagtccatttgggctgctatcacaaaataccatagactgggtggcttataaacaacagacatttatttctcgcagttctagaattgggaagtcccagactgagtcactggcagattaaatatccgaggagggctctcttcctggcttgcaaatggccactttcttgatgtgtccttaggtcgcagaaggggcaagggacctctctcgggcttcttttataatggcactaatcttattcgtgggggctccaccttcatgacctaatcacctatcaagggccccatctcctaataccattaccttgaaggttaggacttcctcatatgaatttgggggtggaagtagtgaaataaacattaaatccattgcaccatatctcaaggacttaacatggggcttagcacgaaatgccatcaaaaggcctgctgagtaaataaaggaacacaagaattcagaattatttttactagcaattttggccccttcactatacaaagaaatagtaaatattgtctctaatagtttgaaaactagcctctgggctattatccacaagatttgcctgtttattttgttcacttaaaaaaaaagattatatagtgactgagaaaagtgaaaggtaatctcatatgtattttgtggatatcattcttaagtaggattgtttctttatcttaaatttatatctgattggagagaggggactagactaacaaaaggaactcatgatagaccattaaatattactcactataaactctcctaggaagtggggaaaataacaatggaccaaacagacccagaccctaactttacagagtttaaaatcatgcagaggacaatgaaatttgtaaaaaggactagcacgttgctcagctgttgtcccaatattgctgcataacattaaaacagagtggcttagaacaaaaagcctctatatttttcttcatgggactgtggtaggctagggcagccctgtactaagcgcaggcaggctgggcttgccctcaggccacagattgaatttcctgcctctcattctccttgggatagcagctttaggtcatgttgttctcacagcaaattactagaggggacagagagagtggaacctcgctatgcctcctgagacatcagctcagaacaggcacctgctcacttctatccactttcccttagccaaaaaatgtcacatggtcacacccaacttcaataggtgaaaaaatagaccctgcctatttttacaggagctaaactaagtcagaagccatagggcatggatgtgaactctattccaaagaggggctgaagaagtgtggtcactgattggagtgagcacacttcttctatgaagtgaagtaggaagggcacacgactgttttcagtctttacaacaactttgtaaattatatatgacatatttatgtaaactatgaaaggattatgtataattattatttcataattaataacagaaatcattttattcttattagagacatggggaacttgagcaagttaaagattgtagtgaaggcaggtgaaatttcctcttaagccaaagatcctcatgcatcaaaaaaattaataacttcttagacagaatcatgtaatcatagacctagaggaagcagacaggacctcactaggttttcaggtatgttaccttattcatctttattttctacctgcctccttcactgctgcattagaatcaattgtaagtgagcaagcagtctgtggcttccacgtggagggaagttaagtatcatctatgagttttgaatctatgtccttgtcctcaccatagagaacacacatagcatgcatcattgtctattaataatttatcagaggcttttttatgtgactacgtcataggccttgaaaacagacattaaaccaacagcccagtctatcatttgtaaattttttcttgctttgagctgtagccaggatttagtcttgaactacaaaccatacaagctatgggaatagatacatatacagagcaggtgtgggtgtgaatgggaaaacaagagagatttatgtggcttgcttttgattttattatctactcccaattaaggcagaaaatttgtgggcagtttatactccccataccatcaaaaaataataattaacaataatgttagtagttaaaccttccttcttaataacagtagaagtaacaataatatagctatctggattggttacaatttttggttgcaagagaaataaaataaccctggttaatttaaacaaaagggaatctagtggaaggctatcaggaacttctagaattggtagaaaaaggagaccaggtcttagaaagggacaggggtttttgtagttctggaggccaaaggaaacagaaatcacaataatggtcttgtacaggaagagactttctcaggcatcagtgctagaatgaatgagtgcctttttttcagtcttgttgactctactcaagatgcagattccagggaggaagtatctgcttggcttagcatgggtcacccagttggggaaaagaggggcacccgataacagtcccatcaggtatatacaattgaaagaaatctttccctaaaggaaataagttgctgttagatagagaaatggttgctaagtaaatgcaaaacaagaaacatccactatactaatgttgtaaacttactaaatttggaatactgcacataaattatatctaattttcaaacagtctgcaattggtggtattattacttgcacacaaatgagtaacaataacattgataatgcacccaaaatattggccatacactaaatgctaggctttctatatgtgacccacttggcatgtaggaaaaattagcttcagaaaaggtaaatatattgccacccaattagcaaaagagaagttgtctgaataactctaaggtctgcttttaagcattatcatatgttgaaaaagataatgatcagagtggttaaaaaatcttgctcagggccgtacagccaatcggcagtagacacagctgtcttattctaaagcctttgtcatatgtccaactgctctctacccatgagattacccttggataaaaactggccatgacaatgaccttattggcatgtccataaaccacatcattctcccccaggaagctctctgtctaccttacacactacatccattcctgccttcgcatctttgcataatttcttctacctggaacattctgccccaactccttccacgactggcttcttctctgccttcatgactctgcttaaatattagttcctttttcagaaaaaatacctggtttcccaatttcatatagctgcctccccttactttttaccaggtcatcctgtttcatctattatggcccatatcactttctggaatattgtttatgttgccatttctctctccatgttgacttgttcgacatttattttctccatttcttagagcgaggattggcacacagaagacgctggataaatgagggttggttgtgtatagacatacacaggaaggacaattaacccagtctgtgtggtcagaaacagcttcctagaggatccacatttaaacttagatattcagcgtaagtacaggtgaggagggtgcatggggcatggatgagggtagagagagtacataggcattcaagggctataagcaattcaatatggcagagtgggaaggatagggctggaggtccgtcatgggaaggtcatgagtggcccataagttatggtgaggaatgacgccccagccgtgtgggcagtcttcctgcttgggcttgtgtctgcaaaggctggtgggactgagcttcactcatgcatccccatgcagaccaacaggatgcatggaccttgacagccattgtgttcaccttccctgaatgaagtaaataagaggaagatgacccacatcacagggtctgcaagggagaggcacttggacaaggaaaataaagtccatcaaagcctgaaacacagaagcagcttctttcaccttcatttctccttacctacttcttgaaactggccttggaggagcacattgagtgagagggacggggagatgcttcagggctgaggcctaaaatgatacatgttcaggtgattcaggctggtgtccctgttaggggagtgggaggggaacgggagcatgcagggcatgcagttcagacttttcatttcatgggtccttcttaggaaatacgttgacaaccataagagaactttccaagttcatgggaagtgttggaacttgaatattgcaaaccgaatggaaataaagtatctgaaactcaaagcattggatatttcagatgttttttccttctgatctctttccagcagcccttcaaggacttcttttctcctcaaggaactttggtctttgtttcattttctttttttctcctcctctcatttatagatttctagagttgcaagaattatggaactcttgagctataaattctttcttttttaagacaagaacattgtgctgaaataggaaaggcattcatagtaatagaaaaagcagtggcaataatgatagcaatagtagtagccacagtaaagtaatagcaataacaatagtaatagtgatgataacagctagcttgtgtaggtgtttactctctgccaggcaatgttctggtcattatatatctggtcttcttgaattctaaagtagacactactagtactatatcccgaacttacagaagaggaaaacatgacatggaaagtttaagtaatgtgaacaatattactcagtgttagaacaggactagatcccagccagcctgaacgccacaagccgtgcacctagctcacaggctgcagctgcccccagaagttaactagaactggtagaaccccttgctttgcttctttttacctgtgtgactttccaaaggttacttaactcctctgcattttaatttcctcatttataaagtggaggcaagaatgcgggttacgatcacagtgttcttggtgctatatatgctaaatgcttagccttgtgcctaatgaagagtagaagctcactctaggatggctaccattatcatttcatcattacttgttctgataaggaaacaactatgatgttgaggcccatgacctatccaaagttgcgtggtgccaggcaggtcttggacactcaatctactctactcttttgtgatccacctttcttcacttctgggagcaaaatgggtgttgaggttggtcagtagactaagaacatgattgtctactcaagggttatctattgagcactgatatctttgttatgaaggctgaggctgccttctaaggaatcaggtagaattagaatcacaatcgagaaaaaagttattttgccctttgcttgccagataatctgaagggcaggtgacatcttaagaagaaggtttgaattctatttcaatcacttccttgcagtgtagccttgggtcattatttaacccttctgtgcttcagggttcttcagcagtaaaatggagataagtaaagttcctctctcacaggactgctttgagtaacaaatgagttcatatatgtaaaacacacactcaatgcaaaatgagagctatttatattagtattgttcaatataagctgtgatttgctcactcatttgtatatttacttgccttagctgatgagaacatttattctgatctattcaatagggggctttaacttttttatgaagtcattacctaaattgtttttgtattcaaactggcccaggaggtgtcagcggtgatcactttcactcacaattcagtgagattttgttctcacctcaagtcctcccactttgtatatttacaaggggacactggtcagagaatcccatggctttctcaccacagggtctggcttctgcccagcgtatcttgtcttgattcaattcaagcccagctttgcaggtgtaatgtgattgaatatgaagtgccaggcaaaacagaataaatataacataaaataaaataaacacaccggatgtttttagcaagaaaacaagtgataattgtgaatgtgtttacgtgtaagtgaaatggggggctgggttttttactaagatatttgaaacctctcaggataagaatatcttcttacatagcaaccaaatatatctaacatataatattttaaaacatttatatttttgggttgcttcaagagtcagtttcatggagtttggaaattccaaatgaaaaaatgagaagttgaccatttattagaattgccaaatagaatacagggcacttgagtaatgctggaaacatatttacactactaattattacaggttgagtagccctaatctgaaaatctgaaatgtgaaatgcttcaaaatttgaaatgttttgagtgctgatgtgagggtcgaaggaaatgttcattggagcattctggattttggattttttaattagggatgctgaactacagttcagtgtacaacacaaaccttccaaaatccgaaaaaaaatctgacatcctaaacacatctggccccaaacatttcagataagggatacttgacctgtattcattgtttatctgaaattcaaatttagctgagtgttctggatttttatttgctaaatctggcccccctactgtacatgcgttctaagtggatgcagcgttcgccatattgggaatggagtgcattatgggaattctcgtccctctgaggcacatgtctgtgttccctactcagagaggagagaactgagcaatgaaaatctgaagtttttctttgagctataaatgatcatttagagctataaatctatctttggcattttcttccttcttccttttctctacagtttttatttttgaaagttgcaattattgccttattcctctcacaattctcagtgtagtttctttatatttctaaatactctatatacttctccacctcacatattctccatgtgaatatatatctatttgcataatggatatggatacaaggccatcatatacctaattacacaataaaagtcagtggaaaatggtattggtatacagaactagttttatagacaaactcacagaagtaacatcctatctccatgaaccggaaagaaatacttattacttgacaatatcatcagggaatgaagtctgtagcaggatttactacgcaattagttagtgatgatccttatcacatagcgttggttggatttttccaacatggatcaaaaaggaatggcagaatcttttatttccaatgtgtttgctttatcagaacgtcatgagaaaacactaggagacaattttggctctgtattagaaggagttatcttacgattaaagatgaagaatgtgcagtcccctgaagatgccatcatctcctgctcttgacctctctttattttgctctctgcttaaaccacaattcctctaccgcttatttgaacaaatgggtaaaaaagctgtgtaacaatataaagagctgcctcttaaaataagatgcccaattcctgacaggctgaaggaaaaatgctagctgagctaccatcagagataatatggaagagatctggtcattaattcaaaacttttccttattttcttcaaaagacctttgattgctgagactttaggaattttgtattctatataactttgctcatgagaagatcactaagatgcttgttacataaacatacataaacaataaaccattgcgtaggaaccatgaagaaaaataataagtttgcatttacttaaattacaaacttctctgtatggcaaataaaatacactaataagtatgtcataaatacatgaaaagaatgacaaatcaggaagaaatatctgtaatgtgaattataaaacaaattttcttaatttacaaagaacctacagaaagaaataaaaaaattaacaaatccagtagaataaagggcaaaggatattaaaaaaattcagaaagaaatgcaaataataaacatatgaaaagatgctcaacctcattcataatgaaagaaatacaaatcaaatacagcaaggagaaaactttcaaactgacaaatcagaagtttgatcataatggggacctgtgaggtgtgtggaaagagtattatcatacactactgctgggtgtgcaaatggtgacatcgtttttgatgataatttggcaatatctatcattcttctgatacaataattgctgatattcttttgatacaataattctacccccatgaatattctttactaatgcagtattgagtgtatcaagacacatgttcaagaatgttcggtgaagtgtttgtaattaaataaaaaacaaaactggaaaatgatttgtcaacaagaaactgggtaaataaaaataaactgtacaaggcaaagggacaaaaacagtaatggggtagttctgcaaatgcttatgtgtaaaactttccaagacatattattaactgaaaaaagtagaacgttgaacagggcacaaattatcattttgtttatataacgaatacacacacaaaatggaattcattttttaaaaaatataacttatccaatgcctacaacgttccaagcatttttatagttgctagcactgccatggtgaacaaatttctaccacttcatcttgttctaatttgctttaacttactactacgtaaatcaatctgacttacatatatatatttcttgttttccatcagtctttccctactggagtgtcaacttgatcagagcaggaactttgtctgtcttgcccaccacttttcctccaacactagggaagggaattgaggagcctccctgtagagcagagagaaccagtgatggaaatgcaacaccatctggattagaagaagagggctgaggcaaagagaaggcaagagcaaaggaaggcaggaagcagttgcaggaaacaggggtgaactgaagagctggggtccaggaaaggtggagtagagaaggccaaggagacacagagaggtggcagacaggtaggaagaagccgtggtggggaatttcacagggagccttaggagagttgtttttttttttgggacggagtcttgctctgtcgcccaggctggagtgcagtggtgcgatctcagctcactgctcactgcaagctctgcctcccagattcacgccattctcctgcctcagcctccctagtagctgggactacaggcgcccaccaccacgcctggctaatttgtgtgtgtgtgtgtgtgtgtgtgtgtgtgtgtgtgtatttttagtagagacggggtttcaccgtgttagccaggatggtctcgatctcctgatctcgtgatccgcccgcctcagcctcctgaagtgctgggattacaggtgtaagccaccgttcctaggccaaagacaggatttttgaagaacttgtaatttattcttactaaagatggaaatatagtgcttggcagttcttgaggctccttttgtgcttaaggccactctgatgtctgtggagactccaagttaccatttccatattctgtcccctccccaaatagcttatcctgtttactggagaagtgagcattggatctggctgatattagaatcacctgggtgactttttccccaaaatatatatcttccggcaccactccagacctactaaattgaagcaatctgggtagagcctggaaatctgtattttacaaacctctgcaagggagtctaatgcagattctgggcttgcagaaacagcccattggcagcacagtgacagcatttagacccatcatggaatgagtatgaccactgctctaagaaaaactcttgctcacaaccataatttgcacaaaataacaccctaatgtgcagaaaccggtaataaatatatcttctgctgtgaccagtttacaatagagagagtacaggccctttgctgacagggttctgttgtcatgatggtgggttcaaatgtctccatcccactcctcacagaaatcatagctctgcttcctaaaagacccaaattaggctgtggagagacaactaattttgattcttagagctgaccttttcttttatatatactaactcctttgaaaaaaatgttctgaatgtaaatggcaacttggattattttttcttcattttggctaatataatcgtcattagtgcattactgaaaaattgtctactcgcagtttgagctgtgctggttaagggacgatgggttagcctgtctctaggctctgcagcacctgatccagctggaagggcagcccaccacatatagagcccatcattcatcagagatactcactgttccgctacagcccagatgatggtgtgaaaattgctttacattccttctctggagctaaaaagcacagagaagtcctttttccccaagactagtcccattgtcctagcctactttcctctctccccaaggcctttgcagcactttcattgcctactctgtctctgcccacagtcaagtcagggatcccattgctctgcattttcagcttcttcagagcaatgcaatgatgatatgcaaccatgagacacagaagacacagatactgccattttggtgatttaatcctggaagtgggaaactatagcctgaagctaaatcaggcttaacctctgtttgtgtatggtctgcaggctaagaatgatgtttacattttagatgtttcaaaaaaaatcaaaagaagaataattttttatgacatgtaaaagttatgatactccagtttcagtgtctataaataaagttttattggaaacacaaccacacccattcatggatgtgttgtgtcatctagggctgcttttgctttataaggacagatttgaatagtctttgcagaggtcttatggcccacagactctaaaatatttagtatttaatcctttacagaaaaaaattgacaatccctagttcaatccgttctgattagatggtgcttttgctaaaaaatgttgagatatattttaaagcactatgtttttgtataacttctttttacaatgttttataaggctttctttttcttcttctttttttttttttgacagagtcttgctctgtcttgccaaggctggagtgcagcggtgtgatctcagctcactgcagcctcttacctggctaattttgtatttttagtagagacagggtttcaccatgttggccaggctggtctcgaactcctgacctcaggtgatccgcccaccgcccaaagtgctgggattacaggcctgagccactgcgccccgcctagagcaataattatactttttgtggcctgcatctatttggagctctgacaaaaaactgtaggtaccgtacctagaaaaacacacaaacatattcagaaatttgcatgcatttcaaggcactgagtaatggctgaagccccctcttgaggttccttggatctcaagttacaagtccatgctaggggaatctgtgaaatgcaacttgcaaaactaactaacgaaacaataggcaggatgagaaaggaaagacagataagaaggaaaggtaagtacacaaattcctctacaaagagttgttgtttccctggcaaactggggccaagatgccatgaactccttgcattgatagatagaacatcagcattataatcataactctaggattcattagatgttgattacactcctggcactgtcctgtgtttacctgcgtctgcactttaaatcctctccacaactctggaaggtaggtgcttgctacacatgtagccgacgagtacatggtggtagagagaataaagctatgactcttggccatgtgatgctagatccttcatgatgaataacaacgaatggatttcatctccttgccagagcccgcacacaccccatcataagtttcaagccggctgtgtccagctaagatttggaagggctgggagggaagaaggccttgcaggaggtgggcatgagccacctcggtagacattccccagacagggagaattcagatgcctaatttagtctgttgtgctttgtagaaacatcctccattaaaataaacatgaactacaatgatacttccatttaatgcagcgattattccctcagccttatgttctggcaccagctgtgatcggtcaatgttcttaaaacagaggagagagaagtgtggagagaagggggaggaggatgcagagaaagcctctcttctgagtttcttctccaaattggtggaaagtgtgaatgcgcaagtaaatatggcaacgtgtttgtaaagtgctgttttcacaagcaaccatcagggtcaggaatccattaaaatccttccagtaagttatcccgaatgtgcggaccaaatcccaactgaagaagctttctcacagtgtgggcattcagctaagctctgcagctttcaggcagaatgaaataaaaccagccacaaattacactggcagccccagaaggggtccgttgcagccccacttttctgcttctacttgtctcagtgctatcatgagatcaaccaggaggagcgacaacaggtaacctacactgttgaaagtttgaatgatttctgtatataatgaagtggacttaaggttattgccataaatttgcatctcactttccttcgctgagagggagagaaaggatggtgtgtcaggtctcccctggaattcctggaattcttccccattctggctagtgtcagcattggaacatgtgcctcagcagaaagaaaaagatgtgtatttgcagggaagtgctgcattcgcattgcacagtggcatggatgcctcatggcacagtttcttggcctctgcatcactgtgtccctctttaacctctctgctgtgcttcaggtttgtcacagaactagaaacacaccacagaaggtgatcagattcagcaagaaaagaataaacaaggccgggatcacgaggtcaggagttcaagaccagcctggcccaacatggtgaaacccgtctctactaaaaactacaaaaattggccggatgtggtggcacacgcctgtggtcccagctactcgggaggctgaggcagaagaatcgtttgaacccaggaggcggaggttgcggtgagccgcgatggcgtcagtcactgcattccagcctgggcaacagggcaagaattcatctcaaaaaaaaaaaaaaaaaaaaaagaactattgctctagggaacaagtagcccatagttcaagggcataaccctgtcagaagattctgagactatgacagttgcctggctcttctccctatggattcttaggtaccaagattcttgaggctcaaataaaaatcatgattcataaatataaaggcctttgattcacactgtattcttagagactcactccttgtgtatctcaggacatggtgtctccactgccaatatcctgcctgaagccaagccaaggccctcgaaactcattttatttgcttgccttttatgagaattacaggggacctggtccagataattacctaattcccactctaaaaatagctagctctggggggcagggaagaaaatattaggagaaaacacttttgtaataatctctacctcaaggaaactaggagttaatgcacacactcacagcagaggaataaattgccttggatttctatagcagacatcagcttcatgcttttcatgtgtacatataggccagtatatgcatctgtgagaaacacaaaagcgaataagccataatcaccaacttagcacaggtcaactcagcctcatggactgcgaatggtttctgagactcaccaagacaaatcatcatatctgcatttttcttcctggctctgtctctcctgctatgctcctctgaccagcttgagggggtgtggggagtggaaaattccaaacttgaagaggttctttttatttcttccccctgcagtgcagagctttaccaaaaaagaagaggaaaaaaaaagtattttttctttccacagaaaagaaaaaaattaaacttgtatgactgatataaatattacatgttcagggcaccagtacctgtacatcgctactttccaaggtgaagttggaagtaacccttttgctgctgctggcagattttagactagatacatccctaagggcaaggtcatacctaactttttgtttgtgtattttgccgagggacttaagaagacgtcagatatgcttattctgaaggtctcagcaattaatcaaagatcattttctgctttatagcctctgggcatgagtcaatgtatgtatatccaacttgtacttcatccaaattctgatgtataactcataagtttatgtacgcatctgcattttgatgtcctaatactcacatgattctcctttccatgtagaatttgtccctctaagaacacttttttttttgcctcgtgatgaatcaaaggctgctactttcaatctgtgtttatgataattcaatactgtactgtggttctcaggatgtcaccaatgccacagattcagcacaataaagtcactggaatatcaaagaggaaaggtcaggcattcaactttgtgtaatcgcaaatagcatcagtaattagcctgcagagaaaagatgtaaataaaattcaggacaggaagcagcttctcaagggattattaatttaagcagagaaggagtccttaacagaaggaatgaaaacctgtatgtgtcagacacctacactccttttgatgatggtcatcatgagaagaaaatgagttaacttctcccttttattttagagtgagaaaatggtagaatcagaatttagaagatgtggaactgcctctattcccccaaagaaggcctgaaactaaagctgccaaagctaatagtccaagttgagattgatctcacatgtgttggccagagttctcattcttgaaattagatactgaactgttcctccatgcacgaaacaatggtgtttgctcttccatccctgcttccatctccttctctctgtcctgggttcttgccctgtggttaattagtctacactgttctttacctctacttaatgagtagcattatataaatgcctctaatagtgcatagtccttatttacagaatagcctatttctcttcgggcaaagaatattatcgttgcagtgaattttcatatttgcaaagctgttccatgtcatggttattcctgtaacttcagtggctcgtacagttccatgaacatggtaagctctaattaactctttgttgaatgaataatgaaagggtaagtactaccttttcacataaaagaggtagcatagtccagctgaaagagaaaagaccttagagccttagaggcaagcagccctggattagaatgacagccctgccaccaagaagctatttgacgttggtgacctatctaatgtatctcatcatggtttcctcacctctaagatttggataatgaagcacaccttgtagttatgcaacaagtcttagatatcattaaagaacataaattgcctggactataatagatgattaataaatgctgctggtggagtgctcatttttaagagatacaacaggacatcagagatggcttccttgagacataggggaaacggtctatctgactcaagcttatttctagataattgcagagtcattttaactgtattaaaaatacttctagaattcagtcaacaatggagtttaaggtttaagaagtttaccacagtttgacttaaatactgaagcataactttgtctctttcccacctcatacttcagctctcaaggtagaagttctaatcaaacttaactgataggatttacatttttgtttgctctgttgagcctgagggttgtccattggtttagaaagaccaacctcagctcctagatgatcagagcaggtataaaaaaccatacatctttcttccctttcctttccttcgtttcctgtcttcctttccttccttccttccttcctttccccaacctccctccctccctccctcccccctccctccctccctccctccctccctccctccctcccttccttccttccttccttcctgcagggtcttcctccggttgcccaggctggagtgcagtggtgtgatctcagcttactgaaatctcaacctcctgggctcaggtgattctcccacctcaacctcctgagtagctggattataagtgtgcaccaccattcccagctaatttttttgtatttttagtagagatggtgttttctcatgttgcccaggctagtcttaagctcctgaaaaaaccatagacctttcaagtgcctgatggttcttcattggaaaatcttggcaatagctggtgtagcattgtttataccacacacccttgtgataaacttccccatgagttagaaactgaggacagtgtgttccttttctaagatcatggccattaaaaattagcccaaccatctttatttatttgattggctagctgaagttgactaagtgcacacataggtatcacccaatttgggttgaccctttctgaagcctccttctgaggctgctttctactgggattttctcattagaggtagtgttaaggaaggcagagctctgcaaatagattttcacatttacggcttcaaggcctaactattcttagaagtttctaagacacggtcaatgtcattaggttgtataatatttagtaagtgatttacagaaatgagcaaatagaagccattagctcaccagaatgcatcattattcacttgtaatccaagcaagaccacattccaataagaagctactcatttactatgctcaggggcctaggtcccatatttttaaatcttcagactggctctacatggaggaatttatttccctcaaattatagatgaggaaactgaagtagattgaagaatttaacaggagtcagacagcttctaagtggaagagttaggatttgaacccaggcctaccagaattttatctcttttgtgtaaggcctggagataccacaaagactccaccatagagcttatctttgaaaagctcacaggctgttaaatatgcataactgtattggatagccaaatgtaacatcatgaaacgtttacataaagagatttggaagtctaaagggagggttcatggaggaagtagtgtgccagtcagatcttaaggaatcggtaggaattttttagctttgtttccttctggctactaggcaagggtaggaactggcagaaaattggggagcggaggaagggaaaagctagcatattcccccaccctgtgttgtggatttgggtgctgtctccaacatcagctttgtaccctcggtgatccagctctggtaggacagctcttccttccatatcccagctcattaaaggttccacctaccactgagtgaccttgggtctaaattcttgtctttcccttccatcaccagggcatgtagcagcatcctgctgttagtaatttccagagtgttcacagtcccctagcgatggtctcagctcctctgtcatctgtttaattccctgtattatattccctctgtttgaaataaataaagtgtttgttattgttgttgtttatttggatagactttgcctgatgcagaatccacaactataaaactaatattcattttctgttttgaaaaaccacattgaaaataacatacatattaggagagatgaaggactgctaggagcaagaatagaagctagagattttgaatttagtttacaagactttgtatgttcttgacattgagcctgtagatttggtatttggtgtggagaacattacatagtatcagcacctcattgaaattcagcccattctctgttttgaacacagctgaattgaaaaagctccaaactaggtctcctggacaagtcattcaagactctgtgagagaagcaaaactttattataatttattattatcagatcccatattataatctaatgctgtaacagtaattactgccataaaacaaaatgccattttgtgcttttttaagaaaatggaataaaacagaaaggaagaatctatcatttcttatgtgtccagtgcatggacagtggccgaagctggcctctcagtgctgcaagactcaggcagctgccatcaatgcccaagccctgcctcctctgacatgagggcctgggaggctgcttaagcacctgcctgaatttgatgggatgaaggatccccaaaaccatatccactttattcaaaaattttttatttcatgagggtttcctttgtcttattccaagttcctgaatccatttgctgttgaacttctgtattcctactgtggggaggccactcatgtatgcagagtagttgcaaaaacaatgcgaactttaaggtccaacaggtttttcaagttcaaattcccatttgtgcatttctataccttgtaacttggaataattcacgtaagtctttgtatcttattttctttatctgactcataatgtggttcagaagctaacgttcaatgtaaaaaatttagcccaatgcctgccatttgttaggtgctgaacaagtgggatactacttttctgaatcactgtaggcaatgtgtgttgaattggataagagctccttctctaccagttttgcccccatatttttgcttatgatgaataaggttaatttcagttccaaaacgtgctaacttctcttcctgagaatttacaagacagttcctagaatcacatattcttacatgttagcctttttcctgatctcctttttgctccaggcctagcatggtaccttgtacagagaaaaggcagggtgggtgtgggagggtgcagagttccttacattggatgagtatagcacattagttgatatgggtaagtacatctcccagttgggtctgatagtgtttggtttctagagaagtccagacttagtttacttattcctcttctttattattatttccatcattaaaaatatgatccttatcttagtttctgctgctgtgcagactgggtggcttaaacgacagatatttattttctaccattttggaggcaggaagtccaagatcaaggtgccagaagatctggtgtctagtgacagcctgcttcctggttcataggcagcaatttacctgctgtgtcctcaagtggcagagagtagagagcgagagagagagcaagctctcaagtctctttttataagggcactaatcccattcatgagggcttcactctcataaccttattaccttccaaagcccttacttcctaatactattaaattggaggataggatttcaaaataggaatttgcagaaaacataaacatgtcgaccataacaattcataacaagaaactcatggcattacattaatgaactgaagttaatggttttttttttcaagtttatagaggaaagtcaggcaatctaaatgtatatacagtatttttttcaccccatatttcactggtaaaaagaaaaatatatattctcaagcattctttctgaaacattaggatgaagaaaaaggagaggtggaaagcagaaagtagggaagaggaataagagaccaaagagactaagaagtcagactttgaaagagtgaaagctggaggaataaggatccccccaaccccaccaaaattatgatttgtagcaagagcaaggatatgcattaaaaacaaagaaaaaatcagaatgacagttttttgtacccatggacctatatgctactggcaacctgagtttgagcaattcctcattgattgattgattcattcattcattcagaaccaggtggaattcacctgcagtatcctaggctctgtaaccatgtcaagaacaagctagtactcctgacttggattctgacagtctctctgccttattcatcttctgacagctcagtggtttggaagaagcagtctctgatttttaggtttgaagggaaggttgttttcagattctctgcctcagttgtcagcatttctgcccaaagattcttatcatttcttgagagtcacacacaagagcaagagcacaatctgtgaggtcacgtagtctttccttgcatgttttgtctttgggcaagttgcttaagccattggaacctcagcctctgcatcagtaagaatgagagtaataccacccactttggatcatgattatacaagattccaatgtgatgactagcacagtaaaaataataaaacttcttcctaattgtgcattctgcagccatctcttaggatgtaggttattggcttagtatgggataaatagtcacacggaagggagaatttgggctattgctttgtgaggatctagttaagggggtcaagaaatcctcatttatggttactctctgcttcgagtggctctctggccagggaaactgaattcttaatattgtgattagctttgatctgccatgtttacatattttgacttttgcctttttttttagacagagtctctctctgtcacccatgctggagtgcagtggcacgatctcagctcactgaaacctccacctcccaagttcaagtgattctcttgcctcagcctccagagtagctaggactacaggcacacaccaccatgcccaactacttttttttggatttttagtagagacgggatttcgctgtgttggctaggctggttgcgaactcctgacctcaaatgattcacctgactcggcctccaaaagtgctgggattacaggcatgaaccactgcgcctggcctcttttgcctgtgttttggtgaccacttggtagagaatgcttccggattctgagggtgggcagctttgcttgtgatgttaggataatagtgaagaagattcctttaaactagtcatgaaatcacgttatttggattccattcacattgggacatcgaatctgcttccttccccctgctacttaatttcacatacatgactttatttaatcctttcaggtagagaatattaggtccattcaacaggtgaggagatggagccttatagagtttatgtaactcatctcaccgtgtcctctgagtcaagtcaaaggttttttctagagcagttagctttccagcaaaaacaaaacaaaacaaaacaaaaaaacaaaaaacaaaacaaaacaaaaaaaacttgagagatgtaaaaggtatctgaggtaacctcagctaactccctgattttagggaggcagaaacaaagacctattgaagttaaatggagcgagtgaggatcgcatcctccatactggcagagccaaaattagaacctggtctcctgggactcaagctctgctcattagcagctggtaaatatcctttcctttcatcaactgtttatgatagaagtgttatttattttatacagaaagttctaaataaacctgaaagacatagctccaaaatagaagaggaaaactgaggccctttccaagctatacatgacaagattttccattttgggttttctgccatttcatctctaatttaggaatcagtaaattacagcttgtgggtcaaatgcagctcatcgcctgtttttgtaagtaaagttttattggaacacagccatgcccatttatttacatttcatagctataaatacaaagtagagtatctgtaaaagagacaatatggctcataaaacctaaaacatttactatatggtccctcacagagaaagttttccagcccctgctttagttaatacttgttattggcctagagttctgaatttatattctttaataagttttgctttccctcatagatgataatgtgtggtggcgatgttatcaaatccaaaatccaaaggtccaaatgtttctactgggctaaaacctgaatatattagatctagacttttcttcatcttagagagcaaattaaaaacaaggtttcgctatctagataataacacaccaccttttcaaagtgtttttctcccacaaaacaagaaatatactctgtcagcagctcaataagccaaaatatgatgaatgagtaatcagggaatatatacatattttgtagaaaattcttgacgattggaattctacctaaatccagccattcttcatttgttagttcttattatgattggacagaaataactgcagtcatgttttcttctcttagagtcatctggcttgtatttctgcttgcacacattaaaaacaaaaggcacacagagcaaaactcacacgaaatttccgctgagattagcttgcttcgagtcatgactgttgctgtttatttagcagacttttatcacgtcactaaaaacagatagagcagaaattagttgctgatgtaaaagttgctgtagaaaagagaaagtttgtatctgttgaggagcccatcacattaactgtgatagacgtggcattgctcttaatagatcagttcccattttccatggaggaaagtagttgctgccagctggctgcccattcaggaactataatgccaacatcctattttatgttcccttatatctaggcaggtcttctgatccattactgctaatagaaagtgagataaatgatgtgtgttgctttccagctgggtggttaagaagcaggtgagccttcttctctattttcccagattagaaggattagaggctctgcaggtgatggggccacaggaaggaagagctgggtctttgcatccctgcaaggtaagcttcctattgaacctccccgtcagaaagtagatgaacaagaaacaaatttctgttgtgctaagctgctgagccttgaaggttcatctattatggaatctaacattaacgaatatgctaatccatcattctacttttatctatcctggcaccttcgtaaggtgaacaatttctagtggcaatggtcttcactgatagaagtttaccctcttctggaaaaatacttctccacatttctgagcagttttactcctgtgttctttgttaattggtcctgaaaaatgacacaattttagagctgaaagaaactttggagattacagtccaagcaacttcttttacagataagttttataaatggtatcaagtggtcaaggtcctgtttgtaattaatggtagcactagctctaggttgcaagtgttttgattctcctgaagctccattttttaaaaatttcaccatggtatacatttttagactatgtgaatttataattgaaattatgttagctcttgggattgagaaagcataatattagtattaaggcaggaagtacgcctatgtgacatcttccagctgtacagttatctacaaggggaattttccaaacatgaatgtatttagagataaatacagttgttggttttgtaatggattgtttaaagttacactttttgcggggggaggtgcggtactccataaacatttaattaagtttacctctcatttatctctgagatagaaagctcccaagtgggttgagtttgtcaggctgaaaaactgcattagtgcaatttaccagagagatttgtaaataggaaaggcattcattaaaggacatgtcccagagttacatgtctttggtagaaaaatcctgtatgtcaaaatgaaagtgggatgaatcagagtttcttgagaggtattactgggggctcagaagacaagcctcaatagctagcacgctgtttcccatcttggttgtgaacaagtaatgacataaaatacagcattaaagattagtctgaaatgttacctttggttggaggactcaacatgaagtctgtctcagaattctgagcctcagaaccaggtgcaggcaaagctgcactggggtaagtcttttccctccaggagctaagttgacctctggggaacgaagaagggaggtgctaagctgagcataccagggctctgaaattaactgagctgccatcataggaaagaaacatcaggcgtggggaggcagcattcccaaccaactggtggatagttcagaagggtgagaataaacatttactgggtatctaacaatatttgtcattattctaagtgctttatgaaataacattggtcattgtcacagccaccttgtgttgaggctcagtgggctgtgaggaggcagagcgttcagttggtaaatgagggaggagccagctgacgatgcctggtctctccatttcctacaggcattattgtacttatttttctatctctaataatccttgtcctcagagaaataaaataaactgctttttatggctgacagaatctaaattgggattttttaaattttaactagttactttttgacttgtttctaaggctttgctttttccctgacagattaaaattattacagtgtgagaacatgtgctttttacttatttaagactcaaatccatcaactatcttaaacaattatcttctctctgtctatataaaataaacacgatgatgagcaatgttcaaatgatattaatttttaaaggtatgtagtcacctggaaaatcagtcagttctgcattttactgtaaatcttcatttataaataggcacccgtcctctgtctcttgatggtttaacttaatgccattaaaagtagaagagatttctccagctctcaagttgcagaactggaatcaatgtatgttgttaaaatgaagaatagaggccgggcacagtcgctcacgcctgtaatcccagcactttgggaggccaaggcgggcagatcacgaggtcagaagatccagaccatcctggctaacacggtgaaaccccgtctctactaaaaatacaaaaaaatgagccaggcctcgtggcgggagtctgtagtcccagcccagtgcagtcccatcactgcactccagcctgggtgacagagcgagactctgtcgcaaaaaaaaaaaaaaaaaaaaaaaaaagaatagaatacaattcaattatttgccttatcctacaacaaaatgattgaattcattcttattgctatgtaacaaattataacaagcctaatggtttgatgtaacacctatgtattatctttcagttttgtaggtcagaagtccaaatgggctcaactgtgttctcagtttaggttctcacaaggcccaagtcatggtttcagctgggttgggctcttatctgtagggtcttggggctattttacttgcaagctcattcagattgtttgaagaattcaatttcctatggttatagaactaaatccccaatttcttgctggttgttggccagggacacctctcagcttttgggggtcacccacatcccctttatccagtcagggaaaacctatttcaaattgaatcccttgaacaattaaaatctctctgatttcctcttctacaaccagccagagaaaactctgtttttaaagggttcatgtaattggtcactttaaatttcccacttcaaaaatttccatattttgaggactgctgatttgggatttcatttacatctgtaaaatctctttatagcagtacctagatttgtattatattgaataaccaagggccagtagtcctgaggcgcatctttgaattttgcctaccacaatcctattttcttgtgacttttcatcttaatggtaaatttccagatttactacttaattgacttgtgggtgggtgtttctttctttggttgtgtaagtatcacagacaattaattctgaagagttaagagaattcagacatgttgcattgtaggagggttcttgtttgttgtttggttttgctctcatttgcctttttctttcccccagttctatatactgtgcaggttatttaaaaagtagagaaaggctctgaatacaacaatgaatatgagcgtggctttggagttggacagaccaggactgaaacccatgcttctatacttacttgctgcttggcactgggcatgccacttagcttttctgagcctcaatattctcatctttaaactagacggaaagtttttccaggggatctttgtaaggggagtaaatgagataagtaagtcctcagtgcagttccctgcataccataaggaccctgtaaatggtgattattttactattaatagctcacatagtgagttttgagaaggcaagcacttatgctctttgccagaggtggtcttgagatgcagttggtaaaacaaagagcaggctgaagcagatggtgtttccctgcttccatttcactgagtcaggagaaaggtgtcttcgtttgcactgccatgccaagaacaccataaactgggtgatttaaacaactgaaaaatattcttcaaagtcctgaaagcagggaagtccagcattaagatgctgtctcatttggttcctggcaaggattttcagaaggatgccttcttgctgtatcccggcatgacagagagagatcatctctcttgcctgtcttcttatgtgggcactaatcctattcacgagggctctgccttcatgatctaatcacctcccaaaggtcccatctccaaataccattgcactggggattagggcttcaatacaggaatttggggggcttataaagattccatctatagcagacagtgagaggtgaaattagtttcatttaggaaaagggacaagagaaagatgttctgagcagaaagggacaatcattcctgcagaaatgcagagacataagtggctgagctacatccagtctccctgcactgaccctgtgctctggccgggctggcacctggcattcctgatgaaggccccttgcccaccctcacctctggccttactcacatcagctcctcctttacgaacactctcttcccctgcccccaccattttctcctcatggccttccctgaggccatggtgatggccactctcagtgcccatcaccagcagctatggagtgtaatgttaagtgctgaaggcggctcacagacattcaaatcccacatctgctcctgtttcttgtagatcatgccattgtgatcaggtcacttaactttgcctcattttcctgacctttgaaatgagagtaacaacagtagtacccacttcatagggttgttgtgaggattcaatgagttaatataggtaaaggattagtgcctggcccatagtaaatgctagaaaaacgttagcactcatcactatcattgtcatttattattttactgtcaactcagaaaagatttcctcccttccttcctgccttcctgccttccttccttccttcctccctctcctcctcctttcttctctcactttttgttattccctttctttatacactgacatcacatcaaaaattaaaagaatcattcattacagtcactctgataaaattgttttatttttatacactatcctttagttcttgcacatatgaataaaaaggatgaaaactgaagactaaaaagattacatttgcaccgtttatattactagaaggcattaataacaaacaatttcatattttacatagtctcagtaaatttgtgtatatatgatttgtctctataacctaacaatgaggtcagggactttgttttgtatttcttgggttctctattgttgagacttgagaaagcatgataaatatcacccttcatccctatatttgtttgaagataaaaggactcaatcaggtagaaatagaaaattttctttatagaggtgaagtctaggtgggaaaataggttgttagatgagtggattaagtgagatttcccttatggggctgcagagaagaccattttctcaccctgtcatgagctggagtaacacaccttgcatctgcctccaggccctgcccttgtataccacatatcaagatgtatggagaagagaatgaatcctttctgcagacagttctctcccaaagaagagagaataaaaccaagctggattttcttagtaactcctctagaatttatcaaatagctgattccacatttcttggggtaaagtgtggagggggcccaagagtagcccagagtgttactaggaaagctcactccacttagaatcccaaggctctgggcaaggtccccccttcacccctgaaaccacactagtccccaacactgcattttgcctgtcccatgattgggacacacataaatcagacacttgatgaacaactaggagtaagaatactccaaaatcagtatgtccagtctaatgtatgtcaattgtacttcaatatagctgataaaaaagaaaagaatttatcagtgggcctggtacaaaataattgtttaacaactaataactcttgagttgacctttacctttactgtgttactgtgaagaaggtaagtcctacaactatttgtcctaaatgcttcataatcaagaaacagcttgctatgcctcccactgccattcctttttagggttggccagtctgtccttggtgcttctgatttggggttgatctttgaaatcgttgtttgctttctctatctactgatctactgctggtcctaagacaatgggaacttcctttcaaatggaagtcaccaataccgctcataatcaagtttcagatgctgcagagaaagacggtctacacacttaggtgtctctcagacccttcaatgtaaattttgccgaaactgacattctaattcaggcagttccaaatttggcaaaaataggcctagccatttcccagtgtttcttaatagactaacatgcagaaattgaatattatttgtgtgggtggtatgaaatggaaacacatgtcctggcttggctgaacagtttcagtttatctccattttcctggcagcccatctggcttagcatttgtcagaacaaaactctcccagttaagacaataaattacatgagtgccttaattacatggaacaagatatttgatctaaaaacaatatatgttctggagttaaatggaattgactagaatctcagattagtaagctattggatcctttcccaaggaggggtcttgtctaacaggagatcagcagagccaatgctgctaggttgaagctctgaatgtgggggatgtggattgtaatccagttcttctgcctgatgagtgttacctacctctggtcacctttcccgcccaatccagtcatccctcttgccatttatcctttgcaattcttaaccacatacttcagagcttttctcccttctgttttgttgattgtgaatacatttttatttgttaacgtattttatgcacatatgcttatttgttttgcttttgttaggtaagctcagaagacccttggcagcttgggaaagaagctcaactcctttggctggcttcaggccaccctgaactctgttcatccttctgttatccattcatcttcttcctccccagtgccccatgactattttccttcagtgctgattggccatgttaagaacttcacagatattcacactataactccaacacataggcgctattctctccccacttaactgtcctctccccacttaagggaactgaggttcaaagaggttaagggactttctcaaattcactgcttttaagcgaggggccaagaatccaatctcaacttgtttgactcaaataccaaaaagcagggtctctgttctggcctcaccatctggcacctgactgttcccacctctgccctttgccctactctcccatgcttgcaaatcttactcatcttcaatgcctaaactcacactccaccttgtccagaactcttccttgacttggatctcattttcctcctttctttttggtattcctacagtatttatagcttataccatatgttttggtttgttttgtttctgaaagcaagtgtcccattcttacatcacccttgaaacgtgtctcattcctgagttctcatttggactatacttttctcaaaggtagagatgatttcatagagctgtttgtattgtcagaagttagtacattgccctgtttgtagtcagtggtgaatattgcttactggttgatagatttttttcctcttctgtgtaattccccacagcacttgacattgtgccttgcacagagtgggaactcaataatggatgccttaatccaggccagatccccagggtgttccgtgatcttggcgaaggggcttccccttaagatacctcagagccttcacagtcacagctgcattggattagctttccactttctagcaataatggagctggaatagacacagagacagaatactttgctgtcttattctttttccatcaacatcttccagaattttcacatgggtcctgaacactaagttagaaacatactccaggacaaagtgggctagatgtagcaacaaagaagaaattcatttagattcagctatatgtgaagtgctttaacacacaaatgcacacacacacacaacctctcctccacgccctgcggtgggaaattaagtgtgtcaggtgttcagacatgacattagccagttacaaaacattttttctctggcttctcccagtagaggccttcatgtgggtataaaatactgttattattacttataaaagcttaaagggcacctaccaatatgccaaatattccctcttcctctgacaagtacttttgtttaatcaggcacaaacagatatatgtcatttaatggaattccatgtgatcttataataaagaaatggagaaatctatgcatgaataaatcaacactgaagttgatttatttttatgtttcaacacattgaattgaattgttgcaatgggaaaagatacacagacagcatattgatagatcattaaagctaatattttaaaatgttaaacatatgttacatgagtgctattaatatattaagacatagatagtgttaaaggtacgagtgactttgggatcaaggccaacataataagcaccaaaatatataattttatttatctagattatttttgcaaccaattaagggtttttttttttcattttgtacccattttggtcctataattatctatatccctgcctttcccatgagattagaagttctgtgacagcaggggctgtgtattctttctgtttctttctttctttttttaaataaaagtggctggcatagagatgaccctcaatgaatcaattgaagtactgtgtctacattagagatgcattttattactgttttgtattttgatttatattgaagtcacatgaggacatatcatgccataaaataagtgcgcatgtgataaaattgcatagaattaaacacatactcaaacgagtggacagaaaactggtgaaatctgaattaagtcaggtgtgatggatgccaatggcaattccttggttgtcatcttgtactatagtcatgaaagatgttgccattggggaaagctgagtggaaggtgtttgagacccttctgcaccatttcttgcagccacatttaaacctaccattatctcaaaataaaagtttttaaaaaataaatgattgcatttaagatactgcgaaggtacagtgaaaatatttagatttgcatacatgaggtaaaaatttgaatatcccagtgttcacagagcttccatgtatgtaaacatgagcaaacagggaattcgctttcaggttcctagataataaagcagatattttggtataatagttttgaataagaacagaagccaagtatactcccttaacattggtgggaaattcaccgaagaagagagggatgtgtgtgtgtgtgtctgtgtatatgtgtgtgtgtgtgtgtgtgctttcggtagatttttctttctttaattttttctctaaaaatgacattaacaagtttactcagtgccttctgggtgccaggcaccatgtattcatagatcccaactgatgtaatagaaaatgcgtaaattggggagcagacggaccagtgtttgaatcctggcttaccagttgtccttagctgtcttctctgaggcagctgtataacttctcagtttccttagccatcacacacaagtaattaataatcctcacctttcaaaaatatgatgctcagaaatgaacttataataagcatggaggcatccaccctataggccacatagagcccaatacgtggacactcaatgaatgatgggtgctcctgaattatcactgagagagctggggtccctgcttctaacaccgcctccagggcaactgctcttatctttgcatctcagagacaaagagcactgtctttctgcagttgtgcattcagcggcagatgccagaggaaactgcaaccagctcggggattcggaaccagatgcctgtgatggattattacaatttcctatcatgtaattgcttttctgtttgaccaaaggtacctcatttaatctatttctaatttgttttaaggcgtgaattctggaaatgcgtaaaatgggaaatattctcagggaaatctttccaacttccttccccagcacagcttcagttgcgttaacgtataagagagcacttggtaaacactaaggcgatatacaaatgcgagttgttcccattatgattattattgatctttgcttaaatttccccatgggctctctcagtgctctgggcacagatatcccacagaatttaatgggtcttttgatagtggagaagaaatgtaaaagagggagaaatgttctcattttgatatttatatccccaccttttcaacaagcatctcagagcagggtagcccatgctttcccaaccctggcatgtagcattctggactggatagttttttgttggggcaggtgctgtcctgtgccttgtaggatgtttggcagcatccctggcctctacgtactatatgccagtagcaccccatcaattgtggcaaccaaaaatgtctctagacattgccaattgttccctgggaggccaaagaaatgccagaagacacttattataatagcatggagaagggtgctctcctaactttaagccctgttccaaaatttgacagttcctcaaatctgatggaacaattttcagagctagcgaaaatgtgttcttagacagagggcctatatgaagcactgtgagaagacctaagccttttccgcgttgtgacccgtttcaaaagcgacacaaaatcccacctccaagatcaaacacggaagcagcaggagtaaccttgactttggagttctactacttctaataattattcatttagtcaacaattagggattcagttccacagtgttttgaacatagtctcagtttagtgtgtgcatactgataatctggagacctggaaaccctcgaaggtaagatgtctggctgatgttgcagtcagatcaatataaacaacttcctattcccagatttttagcagagatatctcttgtgaagtggattcatgcccctttccctgaaaagaaaaagcacaataattactactctctttcagaattacaatcccattggtcacaaaccagaatcttcagtgagctggtgaaagaaaagaaggatggagggagtaaggggggaagaaagagagaaggaacgagagagaaagaagaaagaaaggaagggaaagaaggaaaggatggagggagggagaaaggaaaaagagagaaggagggagagaagcgagaaggaagagaaaaaagataaggagagggggaaggaaaaaaaaggaaggaaggaagaaagagagggagggaggaaaggaaggaaggaaggaaggaaagaaggcaggcaggcaggcacgcaagcagttcttctcttcccttgaagaaaacattctctcagtgttactgcagggaaagaggattgctattgtttgtgattttcctgacctgagagaggcactgtgtttaattagagatccgcaggccctgtttccattgatgttggcctgcctgtagtttggctcttttttgcccataatatatctatctgcctttgtgctgtagctgctgcctaaacagattttctgtttttaataaggagcaagaaagtcttgtagtctttcccagtagtatagtttaaaaaagaaactagaacacaagaaagtaagggctcagttcccatttaactcttgcctctctgggcaagggttgagctagggcttggtttcctgaacccatccttggctcagatggtgccaatgaactttcagcagctcctctccagcttttttcccatctgttcccttcctgcaacctaggcataagagaatgtgggtattggagacatctgcattctgggaatcagtagagttaggggttagacttgcaggctctgaatccaagctgaattggcttctaatagatttctgccactcacacgctgtgtgaccttcagtgagttggttagtatctctgagacttggttttctcagcaatgaaaatggggatgacagtcatacctccctcacagggtgttgctccaagtaatgaatgaggaaacatctttaaggcacctggtaagtgctcagtaaagggtcatggttgctgttgttattaccaggtgtgttctgtcactggagtctaaatcttctccatgcacctctccagagagccaggaggcagctctggaaattgcgtcccagtggactccaggcagcatttttcctgctgagataaataaattggtgaatcattaaaatgaagccaattcagctgcagcccactttcattctgtgtggaaagcaactattacttcttttgcctggacagtgtaatttcattacagtcccagtcacccagctgcttgtggaggagctctcggtggatggttaatgagatgtggtggcattgtttggctttgtcaggacccccaagctattgcagactttgcaatggcatggacccagcccagagtaagggactccatgatccacctacctggccccttctgactccgaatggtctgagttctgtgtccaagttcccatcaatgttggcatcagaggctcattcatttgcacattctaagcccaggattctaattattggtttgtttcactctctggggaattggctgagctgctggactggaccaggcttgggctctgactgctgagacagtagggacctggagggacaaaggcaggtgagctgaggtttctggggggtgacagtagcctgcacatcaggagctagaggctgcatgaaagttttttacacggagtatcttatttccccctcacaacaaacctgggagactagctttttacacatgaagaaactcataacggactgaaagggaaatgtgattcaaagtaccccagaatagagatttgcaaggattattcttccaggatacacttgacgaacgatgctcacatggttgaagtactctcaagggtacacctagattttaatatccccccacttccaaattttaagagggagttaaacaaattgggtttaagctctaagcacttgttttttttgttttttttttttgtatgtgctattttaaaaagaattttcttccaagcacttgagtaataatatcatccagttaaagatctatttctgaatatggcacagataagacaggctgtgggttctacagttccccacacaccagctgtaactaattccttctttctcatgtagaagcagatcataaatcaggtgacagtggcagggttacaggttcaagataatccatgcaaggctcttagcatacaactgcatattgtaaacactcaataaataacaatagctaattcacataccccttattacatgtcaagccttctcttatgagcgacatatattttaactaattcaaccaccacaaaacctttttcaggcaagtactattattatgcccattttatagatgaggatattaaagcataggatagttaagtaatttgcccaaggccatgcaggcagaataaactgaggcagatttggtttaaccctgtggtccttaactgtttctatgcattatgtcatgttttattgtgaacttgaattgactctgtttttatttatttaataactagttctaaactttggaacttaactattgctattagtgtgttgactgtagatgcttcacagatcactttgtggccaaagtgttagggcatcatccttgagaagtgttgcctagtgcccagcaatgaccccagtggtggggacttaatatttgtttgtgaataaacacagcactcagcctctgaaataggacattcatagaaaggaggaaagagacgtcttcagaagcagaagaaagtgatagatatttggtacctatatctaccaaaggtaggtaccaaatatctaagcgacctacttagattggcttgtaccagtagactgtccttgcatactggttctacatgaggactgactacaaggagtgctgatcactggccacctgacaaaggtttcgagtgttgggcagcagagtagatctctacgtttggttcagctcttcatcaatgatttagatcagaggttggcaaacttttctgtgaaggaccagacagaaaatattttaggtttggagacccttagatttctcttaaaattacccaactctagcattgtagcacgaaagcagccatggattatttctcaataaatgtgcatggctatgttccaataaaactttatttgtaaaaccaggcaagggaccagtccaatgagatggacctccaacgagtttgctgatctctgatttagatcaagacacaggcagagggattacactggcagtgacaaaaatttgggaaagagggctggatgaaatgtgaatgaggaaagtgaaggttcattaagctctccatggaacaggacaagcccaggttttaagtattagaaattgtgtgactagctggattagaattctggctctgtcactaattagtatgtgatcttagacaaattacttaagtaacttcacctttctgactcacatgtgttttccataaaatagagacaattcttaaccttcctctgtggatccatgtaaaggtcaaaatatattactatatttgtcaacgtatatgagatgctttttaagtataaaaggataaaggtagactccctccatttatcttttagaaaataatcaacaagggtataggctggaagaacttgattaaaaatgagggtccagattttagtggactgaatcagccatgtggcctggcttctccagaggcagctgtacctgtctctgtggagctgagatgaagggaactgatagctcatagcccaaaccaatgagcagccaggaggctagtgcaggcagaacagcacagtatagggcaaggaacaagaactgggaattctgggctggagtcccacttctatcacctcttgactatgaggtcatggtcaaattacataatcattctgaccttcagttccacatctaagaataatatcttgcttacaatattgtgaggtccctggtagatgattcttgctttggttgctcaatattcattctccactttctggtaacagctccctgctcttagttttcctctgagcaccacctaagcttatgctcagtctgtgaagctcagggggattgaccccatttcctagtatagagatgagcatgtgacccaagttagacgagtgggaaccatatccacactgtagcaggagcgattggaaaagagaagctctttttccactccaaatagggagccagaatgtaggtcctaagcactgggggagtcacccttagaggaggtcaaaatgaactaaggcagaggtgagacagggaacaaagaagacagagctgtaatgactctctttgcatctaactgcacctaaatctcttgcgttttcagttgcatgagaaaatacatctctgctgaggttgttttgatttatgctgctatcacttgctctaaagaatctggagtcatagaacatgcaatgtaattagtacagtgcctggcatgtagtaagggcttaggataatatagcttttattcttcttatttgtgaaagtatttcattaaaaaaatgctggagggatgttagaaaaccaaagtgtagtggccttcatggcatgtgaacagaaacttggtggtctagaaatgtccctgcacagaggagacaaatgtaaaagaagggaagaggcttagcttgggagacagcaggatttgaagagactgagagctatcacggagagggattcaccttgtgctatgtcgccccagagggcagaactccagccaaatcaggagtttctttaggctgggctcctcaaccaggaggggaacaggcaatttcagagcagtgattgtgtccatccagggtctgggttctcctggaaccaacactttgccaaagtgtttttcaagccattttgaccatgacccacagtaataaacatattttacaagtgacccagtacatgtatatatatatatatatttatcgtatatctgattaaaaatttatgaaactatccttttatcatatgaaatgcattttaactttctattctactctattttaaattgtgcatttcatttttttaaagatgttggtcttgacctagtaatttggattcatgaactctattggatcccagcctgtatttaaagaattctgttatataggatattcttgtctgtgatgagaggttgtggtgatcgtggaaggtgagcagaggaccagagtgagagggaaggtgattggccacacatgccatgccatggccttccataacatacaagtgcacagagcatgccaagcctgaggccagtccagggacagctgtgtgaggtgcaggcacatctggcccctcaaccctattcaggcagaagttgctaattgatcccagcaatccttttctccaggcctgagcatgcctctgaatccttctcaacctgtctgtctatgcggttgctccccatgagtaaacctattgccatccatgagtcagccttgcagatgagcgaaattgagattctgtgagttgcatgcatttggagtttggagctctgcctaattttttgcgtttttctttgactcctgccttctcctgttttgcagtgggtggaaacaacaggtgtagcaggagcatcaaatggagaatcaggagatcccaggtctggtagaaactagccaaattgtcccacctctagatctcagtttcctcagccctaaaatgaaaatgataatggcacattgcccatgggcttgtcaagaggatggtgtagaacattccaggtaaacaatgtcacccagggctccgtgcacggcaaggactctgcacacgctcacttccttccccttctcactgtctgaagcttgggaaacattgagagaccccatggtgtgatgaaaatacctttccttggttctggaagatactagttcaagatcttttgagaaccgtcagcagtgccaggcctagagatggaagagcagtattctctctgtctctgtgtgtcatttggcaaatcacacacactctctgtgcattcctttatcctcttaaataaatatataaggttcaggtggcccttgacagtcccaggtgctctgcagtgatgcacttaatccagcagatagacacagtgttcaggaggttaactaatcaacctctgcataccctcacctttccattcccccaccctgttcaaaagggaattccttgagctgaccaatgtggagggaataaggtctttttctttgttttcctccattttaaaaaaacacaatgaagtgctgtcagaaaacaactgttgcctgttctgtccaaatctagtcaagggggaaaaactgcactgtcacttttggactggcacacgtccaatttgttgtcattcaaataccacgattctcttcattttttagattctgcaaaatattgtgaattttctttccaagggcatgtctccacaaaactgttacctcgcagcaggtaactggtgtgaagccacaaacagcataaaacccaagcttctatggacatccatgcagtagaagcctggtggaaccctggttctctttaacatgaagcaacactcgaagaaccagcaaagaagtaactggtttagatggcaggaagctcatgtttattccacatgcagcagcagcctggttccttccagaggcagaaaatggagcatgaaggaagagtcactaccgttgtgaggctgcagtttggaggacagctgcaggctcacgaggctccctttcttctcagcgtagcctttttttttgccttctgattctgccttgggcagcactctgggacaacagctagcttggcgaggcttcaactcttgattattgctcccgtgtgagccagagaaaggaaaataaaaacacctgtaacctgcacagcagtgcgagcttgtcctgtggattttgataaaacacagccctattgtgctttccatcatctctttaggtttctatggggtagtttctgtttcatgtcgcagctataacaaagtaccacaatccaggctgcttaaaaccgcagaaatgtactctctcacaattctgcagggccagaagactaaaatcaaggtgtcggcagcgttggttgtttctttctgagggctctgagggagattgttccaggcccccatcctggcttcttgtattgtaggcaatcttcaacattccggggcttgtagctccatcacttcaatctctgcctccttcttcacatggcctccttccctgtgtctttatctgttttcccttctcttcacctataaggacttgtcattagatttagggcctgccccagtccgggatgatctcatgttgattctaaattacatcttcagacacccctttttttttccatttaaggtcacatttacacgttccaaatggacatatcttttaggggctactattgaaacctgttataactctttttcttccccctgtcctggagaatgctagccataacttttctgctcatgctcaggtaggattcagccactttaagttaccaacaaggtctcaatttagtaactagaatatctaattctgggcttggcgcggtggctcacgcctgtaatcccagcactttgggaggccgaggtgggcagatcatgaggtcaggagatcgaggccatcctggccaacatggtgaaaccccgtctctaataaaaatacaaaaacttagtcgggtgtggtgggacacacctgtagtcccaattactcaggaggctgaggcaggagaatcatttgaacctgagaggcggaggttgccatgagccaagatcacaccactgcactccagcctgggtgacagagtgagactctgtctcaaaaaaaaaaaaaaagaaatgaaaaaaaaagagaatatctacttctggggaactgatgaagcttgatcttttggagttagatcttccctcctctgtggctcagacccgatccaaactggaggctgcagtggggaaggaaagcactgttctttttactcttttctgctcaccttcttttccccctctcccatacagctgctgtttcactctttgccagagtctaaggtaggtgaggtgcaaatgatggggtagttcatacttggctgagtggctttgtattatctgggcctggcaaatatttaaagtggagaccctagttaggcctagccaatgcagaaagtacatttgtccttccataggagctttggaggttcctgtgtgttttctgttcatctaccctctccctcttgcagttctcttgacccaacattgatgcatctggttcctaagccttggcatccagccgacacccgaaacatgcagagagtacaaatgtgcacctattccacattcattacaatgcaggcacctgaaaggtggggaaagaatggaaggtaattcagattgatccattattttatgccttgtgggaaggcttgtcccccaggaatgtaaacttaaatagggagatttttttagtaatcacatttacaaaagtaatgaagctattggacggtcttttttgatttaaaaacaagcagactcatgataactaattaaatggagaatcaagaaccctttcacagttcagatcaacacgggggtcttagttcccactaacgtcttcattttagtgttcctgactctgtctagtgtcctactacccctgccatcctgccctgagcaaattttgtgttccatattgtcttagtcccttcaggctactataacaaaataccataaactgggtggcttataaacaacagaactttattgcttatagttctggaggctgcgaagtccaagatcgaggcacctgcagattaggtgtctagtgagggccagcttcctggttcagacagtatcttctctctgtgtctctacatggtggaagaggcaatgcagctttgtgaagcttctttaataagggctctagtctcattcctgaagactctagcttcatgacttaatcacatcccaaagacccagcctcctaataccatcatcttgggagttaggatatgaattttgggggacacagaccttcagactatagaagacatctcttcctattccctttttttctctctctcttttattgaaacttaacattgctttgcccctccaccctctagctgtctgccaagtatgctgggaggaaattgagaatgtctgtgttaatgtgtggtcattacttggactgtcttttccagggtgatagctgtcactagaggaaattgtgcaatcttaaaagacagattctactcattggaattgcctgagaatttattcccttcaacttgacagtcttggaaggttagactgtgtatcaggtcaaaatgggataaattagaatctatctatgtagttatgataatgagaaactagcaaggcaagtttcattctaaaagatcttagattacgaatagatattttctttagaagcagctgtttatttactagctaccctgtgctcaacaccaaggacacaaacgtaaacaggctaccatcttgccttcaaggagcttcacggaaacatgcattgtgctttgaaacaaaaccatccaaattatatttgcacatgtcatcaaggtgatgtagaggaggctgagtcaccaaccatttacatctatgaaactgatgaactcttgggttgaaaaagtcaggcagtggtgtgctggagccaactttcatgattgtttatgactgccaattatgagcctctcttcccaactctgtactcagttacgtcccaattaatagcttgaaattagccatggtgggagaatttacaccacagaaattggtaagtgctgtaaatcagggcttctttttgtttctagagaaccaaatgttaaacatttaccagcacaccacaaaagtcagggtagggctttcttcttctgactttcattttgactgccaattcactttagagtgaaccatttagcatcttggtgcccagaaaaattccatatgcttttaggaaagctgtgagaaccaaaggaagtattcaagaggaagtgctttgagctccctagaagaaaagctttattttctttattctttgaccccaggaaacaaatacttggagtggttctatgattctttcaggatcctgaaagagtcagtagcagattttcggggaaggagtgttctcattcatttgttattataatgttccaaatgattctatttttcaaggaaaataaaactatataacatatatgtattagtccattttcatattacaatgaagaagcccccgagacggtaatttgtaaggaaaaagaagtataatggactcacatttccacatggcttgggaggcctcacaatcatggtggaagtcaaacgaggaacaaagacgcgtcttacatggcaacaggcaagagagcatgttcaggggaactgccctttatgaaaccatcagatcacatgagacttattcactatcatgagaacagcacacacccaaaaaaaaaaacttgcctcacgattcaattacatcccactgggtccctcccatgacacatgaggattatgagagctacaattcaaggtgagatttgggtggggacacagccaaaccatatcaatatatgagtttaactttaaaatcttcctcactgtttgttatgattggatgatatatttttaccaaatattaattttgcaaggcactgtgtaggggagggtggactttacaaaaattaggaatgggagaacagggatttcagaagctgatgtccaatatttattttttagctactttctgtactaagctttgtttattttcatctttcaacaaatgattactgagtgtcttctgtgttgggtttggagcaaaagtcaataagataccaattcccagggcaaggtaggatgtgagcaagggccagggtctgatgagtagggactgaaggaatgggcactgtggtgaggaatggcatgagtcgggtagaaaccaagctattcaaaggcaaaatttaaacagaaaggtatttacaaagagaatttgcatagaattaatgctgagttttctggcaatcagttgccctcttttccttcacctgtgccctatagaaagggaaaagacatacttggaatgctagaatgagaccaagtggtcattaaagacttcctttggttcaagactggaatctgtgctgagatcttccaagagcgagtgctacctgccccagtaattaaagttcccagggaacaagattccatgtgctctctcactaattcctggaaagtctgactgctcttactggtaagaaattcctcaggtttaattaaatgcttctggctctcattccttctttactctctttttcctctggatctcttcagttgcatgtgattttcaattcattcagtcattcaaaatactgatgcctgggccctaagtccttgaaactggtagaacacatgtgaacttgggccaaaggcatctgtaatgatattgatgaagaggacaacgttaaaaaaaaatggttatagccatactaatagccacagcaaacacttagtaggtaccaaacactgttctgtattgcataaattacctcatttaattctcacaacagccctaggaagtaggtaattgtatcatccccactgaagatgaggaaactgcagcatggtgggattaagtaacttccccaaggtccatatctagtaagtggctgagatgggatttaaccctctcagtccatttctcaaccagttctatgccctctgtacttctgtaaagtttcccagaaagttctgctgtatttctgaagttgaaagccatgggccaaagtaatagtacttggcatgtgttggtacatagtgcttgactgtctttttgtgccaaaactgtttgcttctttcttttcattccttgatttcactgtctagcagtggggacagatatattaaatatacctacctttgtagacacatacaccatgcacacagtaatgaatcttgtacaatgtactatgaggggacagggtgagtgtagggaggtgggggaaagtaattatttctgtggtattagaaaaacgattggaaagaacagggtataatttggctttataatcaaaagtctattgacaaatcctcagggaattaaatttaaatctttggtagttttgctctcatgtgaacgtattccctattagtccgcataggacaatgcctatattcctggtatttctaggagtgggtgggcctgaggctgaattagactgggccacactccaactgatttatgcaatccttttcctaacactgaccaatatatgtactcagatactcctaatcttacagtgtccttcttcactggggtcactgactatgaaagagactctgaaacaaggattccagggattgttgatgtcatttatccccaaacctgtttctcttgttctgtacagcagtaacagtaagatgatgaaaagtagaaattaatgcagtaaggagataaagtcttgatgtctacctcatctttatgaccccagaacctagcaaggtgcctggcatgtagtaggcgcacagtaaatgctgaagaaatgaataaatgagaaaggaaaccatgctacttccatatggacattttcagttctcctggatggtggtgatggcggtggtggttgtggttatctatatgtaccttgttagtcattaactgatttgattttctcaatatctcctgaggtcagatgagcaggtatcaccatcctctttacccttatttctaagtatggacattgagtttcagtgagcctgtgaaccttgcctaaggccccttgatggccagtacaaaatatgagttttgtgttcagccttcccaaattctgtgccttctctacaattgtgagagacattgccaatatctaactgcaaaataggattctgcatcagagaaccagaagaaatatgtaccctcttttccctctgagatgaaaaatgtaggcactatctctttatctttagggtatctctatgtcattctttctctgtgtgttgtggtatacatctacccctgagatgccagtagcagtccctcagtcatgacaaccaaaaatgtctccagacattgctaactgtaccctgcggagcaaaatagtctcttgctgacatccactggtctaaagattttgtatgaatagtacattttcaaataattgtgttttggtagcactcttctttttctttaaggggaacacaaagctccacagttacaaaagcctttgtaaggatcacaaagcgagagatttatcagaagacaaagccagtcaaatgtgatttccagagtcacatgactcctattgtggtaaaataattctgttttctttgtcttcctgaactttggaaatctgttcactcacttttctcagaaggccgattaccttgttacatatatacatacatacatatatatatatatatatatacacacatagatatactcatatgtgtgtgtgtatatatataaactatgtatgtgtgtgtgtgtaattcatatatattagattttttttcctttaggagtgttcaaaactccctcctgcctacttaaaatcacaattagctgaataagttaatttaaaacaaattaaaagttagaaaactttggtctttgagttatgagcaacatttattttctacccaacgcatgaacactgaacttcaggaaaagtatggaattaaagcctaataaaatgttatataaactcttaagtcatgttgacttcagtggtgaggccatgccaagaaagttaatggagcggctccggggatgccgacccagggatttatccacctctgtgtgtttctaagcaaaaacacatgtctggaaaatgagcctttgcaaaccaaatacagaaagatcaagctgccaagtacatctcaggccttttccacacatgcaatttcatatttaaggacagtcttggtctttatacactccaggaaagtggagcagaaccttcgtatatgtaagaatgtgtctgtctttggagaacattccccaggtggtgctcgtattcatgtttcaaagagaaccccaaccttaaaatcaggctcatttggtgggtctctcagtaaagaaattttgtttgtttgcttatttgtttgattgtttatttcttgcttaagacttggcctagtatctgtaattaaaagacagcacaatatagtaaaaagatctcctgctttgactttcagtccttaggtttcgagaccttgggcaaactacttaacccttctgagccttactgtcctcctctgtaaacggagctaaagatacacccctcagggaggttaggccaatgcaaggacatggaacatggaaaacacctagacagtgtgggctacatgggtggatgcttaaaaagtgtttattcctgctttctttttttaacactgaggtcacaatcggaccaccctgtgggccaaatgtggcctgcatatttgtttgtcctgaaatgtgcttttgaacattctaaattaattgccaatgtttaaaaatcaggagctttcaaataaaaatctaaaatttcaggctttaggaaaaaaaaaatcagatctagaaacattgtgtccctgtagatggagtgtgttctcctgagtcctccaaactccatcactccctgatgtctgcatctggtctacttcacttacttatgttactttcctgataggtttaaggcttaaggttttagccacgatgcacataaactattatggagacactggtataagagaggcctcaaggatgcagagacctaccagtgtagacctgccttcaaggaattcacagtcttattaagggcttattgtaagcgatgatttcaatttagcaggaatttattgaattcttactgtggacttggcactgagaatagaaaacttaataagatacagcccctgcccaagaggaatctgccatactgacctcttccatcctactgattgaattggaatttctgtctttctgtttccaatccaggttgaaactcctaatatcattaactttttatattatgcttacaacatcatcaagttgagccctagtttttgttttgttttgttttcaatatactcgtaacataaaattgcgacagtgacttatttgtagataaatttcatcttcttaaaattttggagaacagaacacacacagaaacatgtctttcttattttctgtagagagaaggtttttaaaatatgtggcttctcaactcccaaatagtggggactaagtaaagcgtgttcactgagataaatggatgaatggatgaatgttggatgacactcaaatgtctaatctaattcaccccttcatctacatccattcattcgtttaatcaacaaatatataaggaactggggaaaggtgttccagacgcagaggacagcaaatccgaaggccctgaggtgggaataagcttgatatggtccaagaaacagaaggaaagccagggcagttgtggggagagagtgaaaaaagtgattagatatgacaacagtggtcagataatgtagggccttgtaggctttgtggcagacttgtgtattttccaagtttgatgaaactaagatctgatttccatttctaaaagatcacgctggctgctgcatagataatggatgacaaggaggcaggatcaaatccaggagaccagttaggtggtgactggtgaattttaaattttagttcatcacgaccaattaggtggtgacagcaaatgagaggtgataggtaatgatcacagggtaataatgatgatgatgggactgattctggacatattcgaagcttgagtattgattggcatcatggcactatccagcagatagataatgccaaccacatgtataattttaaattttttagtaaccacattctaggaaccacatttcccagtaacagcctttttgtgttgagtgttgagaagaaatgtcttttcaaatgtactgtttttgctgaaaatatctctttatattgtccgcttcattacctttaaatgtttcaacccaacaaacagctttgttgtgttcttctgcaggaaattatagttgacattcctactgagttttgtgatattccttcctctaatctgttttaccttaattttctcagttctagaataggcttgtgattctcacctcaatttttcaacagcactaaatttcaaaacatgtctatacttacttgttagaacttaagttaataatttataattaaaacaataattttaatttaattatcaattatgatttacataggtatcctcataaattatgctgtttccatcatatattaaaggaagcacattacaatgttatatagtacaaagaaaaaaaatcacgctgaatcaatctgtttacggggactaaacttacattggcatgatgtgtttatgtctaataatacaaagcatgtgtgtattcaacacactcactgcaaatgacaataacatcttatgtaatgaaatagttaaatggaaatgtcatcttgccgacaccataaagtcatgcttggtggaaaagtattttgagctgcttccgtttttaaatttaactttacaagagttaaaatgaactaaaattttaaattcagttcctcagtggcactagtcacatttcaagtgttcatgaccacgtgtggctggtggctggcgtattggacagcacagctccagtgcaacttagactgagttgtcctgcacttgccagagaaggggctgcgctacaggactcctaaatactgtgctctccttctgactccctgcttttctactctgtggtactcagaacccaaatatcagggcttgcttatggcattcagttaagaaacaaattaaggcaatatgaaacccaacctttaggaacaagattacatttttaaaggacgttttcttgggccaggtgcggtggctcacgcctgtaatcccagcactttgggaggccgaggcgggtggatcacgaggtccggagatcgggaccatcctggctaacacagtaaaaccccgtctctactaaaaaatacaaaaaattagccgggcgtggtggcaggcgcctgtagtcccagctacttgggaggctgaggcaggagaatggcgtgaacccgggaggtggagcttgcagtgagctgagattgcgccaccgcactccggcctgggcgacagagcgagactccatctcaaaaaaaaaaaaaaaaaaaaagttttcttgcagaacaaccaacgttttctttatgagaaggaaataatctatttgacatagaaaaactgacttgcacaaacatgtgacttttttcacctgctatgtttgaaatacacatgtctatcactctggcagtattgagcatgccaagactggctactggccataagctggtgtccactttgtggcatcgaggaggggctaccacaagctggctccatgtgttcatttttgttaaatgccaaatatggggctgtttgatgactgttgcactccatcaaacagataatgccaataaatgtcattgatattcagtagtccataagactttctggagtctgtggagcaaatgacactcattttaaaatttgtgtaacggacgattgtgggttattaatgtgtttgtgatgggtggggtcgtccctggctgtctctcacacacactgctgcactcatctacacccatgagcatttctcttcatcagaaacactcccctgattaaactctgatcctgccacagctcccctggcaggtctccagacctgccatcagcgtgccttgtccttgggtagtgctttgaagcataaacagaccccttcatgtctgtgagaatctggatttcaagaaagatcaaccttgacctcctgctgctgatggaagaccctcttggcctctctgtcccccatggctagtgtcacaaatattaatgcggtgcttccacatgctgggctcagaatggccccttttaattaaaatatggatctattttttcaaatgcattttcagatttctgcatggggagaagtgcttcttcctgccgagtgcaatttcagatcgggcaaaataggtgcagatttcgttcgaatctctttgaagtttcaaaacgtccttaaaccctaggataattttttttttctgcttttgtattctcaatggtttcgtggacattagggaagagctttcatgtattcacatctttgggattctgaaacattattggataaatattaaagagaaccaaattgaagggaagttaacgtgaatcaaatagtgcctaaataaaattttaaaagtaacccttaaaaacgtattgttattaaccaagacttttgaggaagttatagacttaacatgagtctcatactaataagtcaagggtttcttatagggaaaaatgccctattctttcacatatcaatgtgtccacttggaaacagagttctacatttatctcttaagatagcaagggacagatatcaggaaagaaacttaaactttggttggctaaattttcctaacttcctgaatggaccagggcttcctttgagtcccacaacacattttctagaactcctttttggcatgctttgttggcatttatatcaaattttaacttgcttttcttcatgcaccgacctgcttctcctatgggattactcaactccataaggatggggctgatgctgggtgttactatctcatagttgcctctccagtgcccttccacactctttatcatttttcccctgccttactctaaatttcccatgattcggatggggtagcacagcttgcaatgacctattctgcaaaaatcaacagacaaaacagggatttggagggagggaaaaatcaactccaatctccttattttcacaaacatacagagtgtcagggaagttcctgggtgactgtttcctctgtgttcataatttccttatattgttcaaggttctcaccctcaaatatttgtctgcactaaattttcatgcaagtcctttgcaccgatatttggaccttggtaatataacttgtttatagacgtttgagtcttgatatctgtgattaatttggaatcatgaacacctttggaatgcctaaaacagagtggcgaccaagttccacagcttgtccgagctctccagattttttaatgtgaggtttagaaaatgcctctgaatttcatctcttcctaccaaatttgttaccccaatc[450 bp omitted]cttcgtttacaggaaatgatccctagttgttgctttgttgttgttgtcatcgttgtttttaaatcaccaaatgccaattgtcagctcgatattgccacatgtaaaactcatcccagttcacctgctgtccaccctggtgtatacctgcttgtgcagggctggcggtggggagaatggccactcagcaacaattagcagaagccaaaaaatgaaaaagagggtgcaagtcaggaaaggtgagacagcagctgatgcgacttagttctctccagtcagggcagctggaagacccggtggctctatcagctgcagggcccctgcaacaacttgctcaagctgtgtttcacagccactcacaacagttaacttcaagcacattttcacactgtttggctcaagctcctggcagcgttcctaaacactctgaggaaataattccacaaagtggcataaattaatgtgactaattaacatgatgttaattatttgtaaattgtatgtttggatacacattacttgagaggcatatgttatattcagtgtttactgaaacaagtgactgctaatagctcctcctgagtgttcccttcacgacagtcagcaaatggaggcttctctaaaaataaaaatcctgtcctcgggggagctgcgtgaatgactgaatataatcaactgccgtgaagtagccacattcccttaaaaagtggaagtcactgaggcttgcggcttcacacctggtgtattttggagatgactttattaaagtggtctcttcttttccaaagcccacagacagacggcttttgatctcctaaagtggtacccgatgtctagctgggatgatggcagcatctttgcatctccttccagagctgtttctgtgcaggacagccccgcctttaccccacaaatggggtggcagaagtccattaggaccaggacgggctaaatatctatcagcgtggtgaacataaattcagaattgtccagggcttctcactcggcaactaagctttgtctttggactcaaacttcacattccatttcttggtcccaaaataaaccaatctgtttaagtagcttttcagttctgaagagtggattgtattttgtttcatcaagattttttagtttcatgtgctttgcgtatgtatccttaacatgcaaaataaattactcttttttactttaaaaagtaaagtacaggttggcatggtagctcacacctgtaaacataacactttgggagggcaaggtgggaggatcacttgaggccaggatttcaagaccagcctgggcaacataaagagacctcatctctacaaataaaaaattatctgggtgtggtggcgcatctctgtagtcccagcttcttgggaggttgagggggaagaatcatctgagtccaagggttccaggttacagtgcactatgatcatgccactgcactcagcctggacagcagagtgaaatcctgtctgaaataaagaaatgaaaggaaagtcctagttttatagaattcttgggatatagtacctaagtaagagctctctatagtaacatgttctgatgacacctgttttgctatggcacgccacctcccacctggttaaaagcatgtattttgcttatattttttaatcaggattgagtgaccaagtctattggaagggaatatgttgatcccttttccaacaaagaagacagggtcatagttagacctagtcatgggaaggaaagaccgcacaggagtctaggaaagtctagccgaggaaagactgcacatttattgtaaataccatgatttggggtaaaactctatagcttccaaattttattataagcgtagacattaaaaaaaaaagatgaaaatcaccccagggtccaagaaaatcaactgagggagtgaggcatctcagtctagccgttcctgtgttaactccagacatagacacagctcttctccagatatttacttgcaaggggaacattgactggaatgtgtttcctggagggccatgtgaaaatatttatgaaaatatttatggaaaatcaaagtcatttgaatttattcatgggcactaatgaattaagtaaaaccaaataataatgcttaaaatatgcatctgattatcctggactttggagttgcaacaaagccctgctgaacctgatctctgttgctgctgcttctaacactagcctccttttactccctgcaaccactgaaagacaggtatcttggacataatggactctatggagtgaatggatgagtgatcccaggtgagaagttaaaaagaaagtgtgtgttctcctcaaacctagactacatagtcattctcaaaattgcttaacaatacagatagtccctaggcaaaatttcattttgttttaatttcactgacaaaaggaatatgtgacattttgggaaatatagggtgaaagaaggaggaaagttgctgatactgaatttcccccacacatgataacccatagatattagggatagagaaatcaagattctagaagggttttcacatttgggtttgggaagtagacccttgacttgagagagaagtgatacctgtcttaggagaaaggagagtgaccattgatatgacagtcttcagtgactcccactttttaagggaatggggctactttgtgacagttgacatatgaactgaaatggcagcaggagcctcatttgagatggctctggtagtcttgggggtgtctctcaatgtgttcacttgcagagccatgtcgtagtccagtgctacaaggaagataccaactattgctatacactgcaggtttggtatttgaaaacataaacacaaatgtgtttacagttattaaatgttataagtagagttccagaacacagttgtttttaagttgtataaatgactacagaaaaagactggaatcttatataaatgactgtatatcttataaaaattgtcctgaattcagattctttgtaaccccagcacacaacatggaacccaaaacatagtcaactctcaaaaatacttactgggtgaatgaaaaaattacaccaagcaaaccaacaagacctcaagaaggtagataataataataatcaaaaacgtgctattggcaattactgtgctactgacccaatgctaagtatttggcatgtattaactcatggagccttcacacagtcccatcagacaagttttatcattatctccattttacagttgggaaagcccaacacagagaggttagaaaatttgctcaaggtcacagagcttggaagtggtggtgccaggattggaaattaggcatgttgattccagagattcttcttctaacactccttgcttgattaaacagcagaaaagttttatctcaaaaggagaatgttttctcctctgttaaagaacaatgtcagaaagatccaggagccgcccttgggagcagaattgggagcaaagggaggcactctccactcaccagttattgacaggtaggaggaaaatatgaatattacttgcggatattttctcagccagtttcagccaccagctctatcaattccttaaaaccctgtttcgagtagctctgacttcagaggaactttaatagcatggcatcatcagtttagttttcagtgttttgtgctagtctctaagttctgtcaataaggatcataagaagagttcaaatggattcagtgttttctatttgccaggccattctaagccctttatacagatgtatatagtaggcacagtcattggcatccccattttacaaatgagggaactgaggtacagaagttaagggctagtgagtggtagagctggaatctaagcagtctggatctgcggtagctcccaagatttctggtatgtcttaatgcatatgtaatggagaaagagtaaaataatgccctctgtgtactaacttaatctactcaaatgtagaaggtatgtaatggctatgctgctttgtgtaagaaaaatctgttaagcactttagttctctctctctctctcatctctctctctctcatatgccaatatgcctatgtgttcagaaacctaaggaaagtgaaatgtttacaatatagtagagcaattagactttggtcatacattttacaggcaacacttggggcaaacatatgcacatcatcatgagaaatggaagcatttcgttcccagtataaacctagcaagacctgcagttcttacttcagcttaccctgaaagccaaatattgtagttacctcttgacagaaaagaattcagggtaacattcccactagggttctaccaagagcagatataaagaagtgaagttgtaagctgagacatggcttcttgccactgtctagttaaaatagaattaatatttttctttactacataagaaagtagttttctaagggatcatacatttttaaaccagtgactgtctataatttctgacttttaaaaaaaaatcaaattattggcttcagcttccatttttaaactctgccctgctttgtacttacttagaacattcaaatttcagagcccttcatctgtgaattaatcatgtgtggagtatgtgcagttggaatttagctataaatataaatgaaattgctctagccatggctgggttcaaaaaactagagtgacttggagttttcagttaaaaaaaaaatagagaaattttaagggagcaaaaaaaagttaagttgagagaagcaattaaatagagtctttttgcattaaaatgttgggcttgtgttgtatatatacttagtttctaagactctgcaaatcagcttataagctctatgtcaaggtgaaaagaacagagtttgccaaactccagagtatctttctcacttgacctgcagaaattaatcaatgtgaggaatgaccacatgatgtgttatatagttactgcctggtgccagttggcaagaaggttcatcaagctagagagttgagaaaatgagacaggtagggatgaaaatgtatacacaatgcctgcttgaccaagggcacacaccttagactatgttctttccccagaaagtctgtggcagaagtggctagaaaacactttcatctacaatggtgtttcttatcagatctggttgacaccgtcttcctttatgatgacggagtgcaaaggagctggaatttaagtttggagctctgggctaaagttgtaggtagcccagcaagctacctaaccctctccaagactcaacttccttgtgtataaaatgagaagagaacatctgccatttaagagagctgtggagagcaattgaaatcagctgctttatttacagacatgtattgaatacctactgtgtgctatgatgctatgtgatgtgtttgggatacaagaaaagttacacttctcaaggaattcttccactaggggaagacagactagtgagcaatgattagagatgcattgtgggaaagagatgcattatattcagagtgtaggttagcataggagaaagctgaataagcctgtaaggtgtactaactttggttataaatactctaaaaattggggaaatgcattctttctctttcaaggaggacctgagagtcaggtaaggtctcacagagagaacctcataacacaagtattggtatttgaataggaattcacctacatggtgtcggaaagagggagtgacatggcaaagacatggagtcagtgggaataaaatgactggtgttgctgagctgaatgaagcaccaggcaagattgaggggaaacatgatcgtctttctcgggagcttggatttcatcctgagaacttcaggaggggcaaagtagggtcagatcgaatgcagttaccagaggcatcacagcatggaacttgggacccactgccttgcaaaagtgatcattcactaggggctgcatattatgatgatatattcttatgcacactattcagaaataatttttcatttttattcttatatgtcagctttattgagacataattcatgtgctatacaattcacctatttaaagtatacaactcaataatttttgctatattcattgagctgtacaaccatcatcataatcaattttagaacattttcatcactctaagaaggaactccatactcattagcagtcaccttcttattttcttccccaagctttatagatttgcctattctggacatttcatataaacaaaatcatcctgcatggggtattttgtgactggcttctttcactgaacttaatctcttcaggtttcctccaagttgtactatatatcagtacttcattcctttttctgaccaaatagtcctttatatggatgtgacaaatttcgtttaactgttcctcaattgatgaatacatgggttgtttccattttttggctatatgaataatgctgctatgaccactcatgtacaagtttttacatggatatatgtttgcatttctcttgtgtagtggtattgctagtagtggtattgctgaatcatatggtaagtgtgtgttcaacattttgagggaccatcagactgttttccaaagtggctgcatgcttttccccttttctattaatatctgatatattgaccattgtttgtaactatgtgaactttgtggaagagaaccagaggaaggagttacagctcctttttgctgtttgatggtcccgtacaggggttagcatttgttgtgataatactgcataaaaagcaccaaatctcagtacctacaaggacaaatattgatttcttcctcttaaatctgcaagtcagctgtaactccgccggtccctgctaggattggtagggcttgactccaagctgcagatcagattcattcaggggccagtggctccccaggccatattcttcttatggcagatgtgcaagaggccatgttgaaccagtaacattcctttggccaaagcaagtcacacagctaagctcaaagttgaacgcatgggaaagtttgctctacctgtttttctgaaaatgtttgcaatgtcacatggcaaagtgtttttatataagcctattaaaagagtggagtaaagagttgggaagaaggatctaatattccacagttaatatataatttacagtactctgaaactgacttgttctagatcaagataacaagcagagaaatagacaaaaaaagaaagcggaaagagagatttctacattacagcatattttaaaaaactgaactgtgaaaaagtcatggaaacttagaagccagtctttggagatgtgctttaatgaaagggtgaaggaatttgtagatagtctattgattttacacatttcatttcaatgcttaaacagtcctcaaatgcttggttacttcgtagaataacaaaatttgggggtataaagagcgtcaaaggatgtctcattctatctaaagaatcaatgcaaagtgctaaaagagattctagccccagagtgggtgctctccactttctgaggccactcggatgtctgccagccacccggaatggctctcagactaattacttacattctgctgattttcaagacagctcttgaagtagatgctgttatcattccattatacaaccaaaaacattgagacttagaaagatgaaggtaaagacacagctaccaagcaacaggtctgaaatttaaactctgacccaaagctcatgtgatcagctacaatcctggatgtgccaaatagaaaaagatccctgcttctgttgattctgaatatacctatcttaacctgaatttacctcctgttgcttatttctctcgggttttctttgagtgtaagtaggtaaaacattactctgtcagtcttgcttatatttgaatctacctaaccaatcctttttttttttttttttttttgagacggagtctcgctctgtcgcccaggccggactgcggactgcagtggcgcaatctcggctcactgcaggctccgcttcccgggttcacgccattctcctgcctcagcctcccgagtagctgggactacaggcgcccgccaccgcgcccggctaatttttttgcatttttagtagagacggggtttcaccttgttagccaggatggtctcgatctcctgacctcatgatccacccgcctcggcctcccaaagtgctgggattacaggcgtgagccaccgcgcccggccaccaatccttttttaaaattactacagctattgtaaaaggaaacctcagccactgtgtgaattagcttagactctgaattagtggagtcagaatcctcgggacttgatcttttgcctaaaaggtgtcatagctatcaatgcacttatttgcctgtgctcctttttgccaaagcctaaattaaacacaggtaatgtagagagttgggcagggggtgattttattttgtttcaacaatagtaagagtttttctgtttccaacttaagtgtttatgcttatgtctatatatcagttgggccactaagagcaaatgaggttacctaaagatacctagaatagtaacaggatgaggatgagagtggaagagggaaaatataagggtgcctgaaagctacttgacctgaatatctgatatggaagatgatcggaaaagaactagtttaatagaagaggataatggaagctaaaatgtgaaattatgaaagagaaaccttatcagaaagtgtaagacaaaaaattggttcatggccaagtgcagtgactcatgcctataatcccagcactttgggaggccaaggcaggtggatgacttgaggtcagaagctcaagactagcctggccaacatggtgaaaccccgtctctactaaaaacacaaaaaaattagctgggcatggtggcacatgcctgtaatgccagctactcgggaggctgaggcaggaaaatcccttgaacccaggaggcagaggttgcagtgagccaagatcatgccactgcactccagcctaggccataagagtgagactccatctcaaaaaaaaaaaaaaagaaaaaaaaattggttcatgtgaaatacctaatgattaagttggtcatgaaaaacgaaatggacatgttaccggatttagggcctaatggcattagatcagcccttttttaagaaaacacctggagcttgggatgaaatattgaagtgcaagtcccatcatttgtgtctctacactggttggcattctgtattcaaaaatattctgtcaaaaccagaatttaccaaagtggcagcaataaatctcacacacactctcccactcttccaaggtataaacagagcttcttcaaacgggagtaccatacttaatggcattccaaatggatgggtttctctgtcagaccgtagacagctgtgctgtgagagtgttcataaactgtgtgtgagcaattgacaagttgacaaaacattgacaaaaaacaattactcaagaagcagcacttggaagggctgtttgttgtttaggagagaccaaagaaacaatgaaaaagcatggttaggtgctatatttgccattgcacacacacaaaaattatttctcagaatgcatctcaagactctgtaagaaaaaagccagcaaataaaatgatgtattataatatgctaagtttattcgtgacactttatttgtgagatgcatttaattactgggcagggttttttttttatttaaacaacgttaattacgctgtaccaaagaccaaaatgaagaggttgttttaagatgtttctatggcaaataatacttggaatagacaaaatattttgaagtgcttagatacaaaatgtattttattagcttgaaataattactatatttttaggcatgatctgcatactctatttattttgagaataatttgccttcttggtttgcaaaatgcaaagggatcagagttttagtgccatttaacaataataaataataatgataatgatgatagcaaagaacatttaggccttattttgtgccaattagccatgctaaatgtgttacttgcattgtcttaatgacttcttgatacctgtctgtgagaaaagaactattatcaatcctttgatatggataaggaatctgaaaataggaagctcagagcagttatattgctttttgaagaacatacagctagtaacggagtgtggcattaggatttgaacgtaggtatgtcatgctctgggtggtgcagttagcacatatggagcctccattggaattaggaaaaagtgccccccccaccccatcccaccccacaaagatacttttatccctatctgttagagaattgttgtaataaaccgattgtgtggtagacgaagacagcttactgccatctaccgggaaattgttgtaataaatatacatacaagtctatgatatgaaaggtgttctttagaggtggctctgccaggcatcatacatggaggttaaggtgtttaaccaatcctgctattcaggtggaagaacatactcattccctaaaaagaaaaaaattaaaaagactatcttcttgccacccctctacaattttcttttttattcaaacttgagcctgaatgaaatgctatgttgatcttgatgtgaatgatttatttgtccaatgtctattcactgctgagggtggcagttacccgtggtcatctatcaagcaggcagagataatgtctgctttccaggagctcataatctaagaggggcaataattaaacatatccttaagagaaaggtccatgggcttcctttcaagagccacctccaaatgattgatcatggtcacctggagagccactgtcattgaggaggaacagggtcctgaagctgggtccatggaaaggaagcccagtgaattattattagttcagcgataatgttatcttgttccttcatgcttttttgtgagattttctttcttttcattttcaatttatctccttctggtatttgatcatcttgtctctgagctctaagtttactaaattcatgtttctatcaacttctgtatcatgaagtttttatgggtatttcctgttttttcacatttttttccattaggagtgggtttttgtgcgtttacctgctatgttctctccttttcttaacatttccttttcctgtagtatattctcatagttactatacagttctttgtcatattaatcatgctagaaggttcagacttactagttagctcagtaatgtaggcatgatctcattcctctctcccatattatctaggactgctatgaatttccctccaagcacttggctttctgaggcaatttggtttctgggagatgagaccaagttttgaagttgtgctgtgttgcaactctcctttccacttcagaattgtcttatttctatttttggctaccagttcttaatttttttctgttttatttttagttgacaggcaataattctacatacttatggatacttaattttctttatactaagtcatgccccctcccccactttagttacttttagtaattgtttcttgctactattttctttcctttgttaatgttctttcatattaaggcaggtgccctggcccctggtcccagctctctgccttgttttcaatgtgactctgtgtgtcctttttgcttctcaagtacttgctttcccaacacagttactgacatagtttgtatatgtgtccccctcaaatctcaagttgaaatgtgacatccagtgttggagatggggctttgtgggaggtgattgggtcttgggggcgggtccctcatgaatggcttagtgccatccttgtggtaatgagcgacttcttactctgagttcacaggagatctggttgttaaaaagagtctgggacctctcacttctctctcctgcaccccttctcttgccatgtgatgcacctgtttctgcttcaccttctgccatgagtaaaagccccccgaggcccttactggaagcagagaagatacccatgccatgcttcctatacagcctgcagagccatgagccaattaaacctctcaagtctccctttatagcaaagcaaaacagactaacacagttaccgtgcccctgagctctcactctagaaacttcccctttgctttctttctcattgaacatgccttgttttccacataggttcatttcctgttcctcttgtagataataaaaggtaagctcctttatgtgaaataccagtttcctacctgccgtctcctgaaataaagtcagcttctcctaaaatggccttttcatttctttctcttaaaatattgtccatacatcacagagatatcctctccttctcctctactgccaaactccctagtcaaatccaaaatgcttccagtttccatctatgtccatctccttggctttgttctttttttccttatagttttcaacttcccaccatcatttggaactggtgtcctgtttgtcttaaatgggtaatcatcatggggacaaggactccaagcctagagtgaaatttgactcaatttaatgaaaacaaaattgtcttgaaattgttgaatttgaactaaaaatgacaatatttcctaataaggacctatttcaaatagaaatcttagatctaagatatcaaatacatggttcattgacagccttctggcatagaatctactcttttcagaggaaaaggtagagcaagactatctgagtttgatcctgtatctgtcaattaccagctgtgaaacctgggccaagtcacttcacctctttgtaagtaagtttccttatacagagattgaagataaaaataatgcccacttcatagattttgctgtgcggattatattacttaacatataacaagtagttttaatagtgtctggctggtagtaaatggtcacaaaatgctagctgttactattctttcccttcaccccatggatctgagaaataatgatgaagaaggaagactgagcattcatccctaatattgtcctcgtggcatattcctcctcctaaaaagtcaggattgttcctgaagcctctctaatagcccagcaacttagaaggtccttcatatttcagttaacgatctataatccactaactatctaaggaatttccattattgcactgactagcttatattacagttctctattacccacctccttcaccaaaaaactattagttcatctgtttgttcaatcttcaaatattaaatatatcttttttgtacacccacaaggtagaatacttgtcctcttatcccttgtagaatagaagggttataagtcactaaacagatgattgggtaatgcattccaactgacataactactacaaaggagaaagctagggtgcttcaaacatgtagaaagtaaagtggcacagagtagatgtttagcaaataattaacagaaggatggacagatggatagatgaaaatttgggaattagctaacttcactggtgtgagaatattgtaaagttgtttggaaacagatggacaacatatgctatttgtcatctttatctcctgcaggtgttttgcacaagtgtgagcgctgtgaagcagagcacatctgcccattgcctctgggtctcctgcccttagggcagtgctaggtccctggttatgtatttattgaaggaatgaatttaatgcaaaacaggggctacatttcaataattacaaaataactctgggtacggtggctcacgcctgtaatcccaacactttgggaggctgaggtgggcggatcacctgaggtccggagtttgagaccagcctgaccaaacaatgaaatcccgtctctactaaaaatacaaaattagccaagtgtggtggcacatgcctttaatcccagctacttggcaggctgaggcaatagagttgcttgaacctggtaggtggaagttgcagtgagccgagatcgtgccatggcactccagcctgggcaacaagatcaaaactccgtctcaataataataataataattcttttggtttcagattcccctgttttctttcatcaaacttactattcttttcttactaaaagatctgtttttgccagttttgtatttagatgttacacctgtctttgggttttgtttcatagtgctctctgaagccaagtcacgcccatgctaaatttctatagacccaattgttagcacaattagctttttaacctttaaattattttacatggcaacagaaattgggcaaccattgttttctcccagacaacatcagaaacattttacctagagtgaattctacatataatcattcagggggaaaaatgtgaaaccaagtaaggattataatacttagtttattcttctcctttggcaaactttataaaagctctcaaactttgctctgaaacttgattcaaaagttgaaagatccaagcctgagttatttttgcaactactctttttgcaacatcagggaatgtttctctgtttttaatagggaaatgttaaatttccctcttaatatttaattaattttaacagagcattaaaaaaggatcttaccgattccaaattggagattgcatctctgtgctcccacaaaacccgtgttggtttctatcacaggacacattgctcttgtcttagtgtatcaatctgtgcccttgtttgtgccaagtaccagatgataaactcctcgaaagcaggaagagtgaggtgcctacctttatgtcctagtacccagcacagtgcttggcaggtagaagttattcactggatatgtttttgctgaatgaatacatcaatgaaaggagatgcagactttaaatctacggtataaaaagggttgtaaaatacagaagcaatacaaattaattagaaaataaagtgttgacacactggatcccatttaagtgtgcctatctccatttcatttttgaagttctttgggttttgcttgagatattcattcctcctttcccagaggttccctgctctccaagcaatctgagctggatcgggctgcgttggacaaggtgacttctaagctctattcgtacgttcattcagcaaatacttccaaagcgttttctccagacccccttgtgctactgaacggtgaacgctcatttgtaagaaacatgcatcagttacagcacttgaggatgtcactgtgcccattcaacaccacaaagagtaggaagccaggaagtaccaagtgaaagtgtggggctgtctttgcgtagtatcctgctttttatttcctgcaatgctgaacccctttctaatacattttctagcaaaatccatagttcccttctttgcattctcatgactcttcagtcatttgcaatcatggagcccttctcatgtgccagggactactctagtaagcattttatgtttttcattcgtttaatccttaaggccctttaattctacaaggtgagtgcagttaatatcgtgctttaaaaataaataaatgaagcacagagaggtgaagccacttgctcaagctgtcctgctggcaagtggcagagccaggatgtggagcctggcacctggctccagaatgcagtaccctgtgccccctctcttttgacagaggatgtgctttgttcaacttctaatctcaagcatctgccatgcatctgctatgaccctctcttggtggactctaatagaagaatggaagaagaagtcttcataattaagatattaaagaatggtttattctcctgctgttgtccctgccacattatttccattcttctttctgtagtctgtcctgacacccctatcttaattaagtctccccattatgttctctgagcatccagggcttctcttggtagcttttgttacaattaattactatatattaatttgtgcaacatctgcttgttgttgagtccgttttaaaccccaagaggacagatggggagcactggttgaccacgtagccagccctgcacttggctcagagtgggtactccgtaaagacttgtggaattaatgaatgagtcatcattgactttactatgtggccacatcatatcatttaagcacccacataattgcttatgaataacagctctctttcaaccacttagagaaaaagacacctgctctatgaggagaggaaatgcaaaaaaaaaaaaaaaaaaaaaaaaatcagcctaggcaagaacttccatagagcattcaagcctttctcacaaagaattgggattgcttatgttaagtggagaaaaacaatccagttttgtaacttaaacctccttcctttagactccacaaaagtagaatttgtgaatattttccctgggttgggccagactaaagaaagtgtttccaaagccagtgatttacagcaagaagacagtaggagcctttgtttttcctagagcaaaatggctttgaggaatttccgcacctaaattgtttgtgatcagatggggatttctgatttcaatgaaggcagatccaactggagtcctatctggaaaatttttgttatcagggagtacaaattgcagagtaaactttaatacaacacagatagtgcttcttaaaatcttgggcaattgtattgcttttccttctcaatggcttctcagtgcttctttttgcaaatcctatttgaactgctttgacacccagctgcttcagagctttttgttctttttgtttttgctggcagataaattacaaatttaaaaaacatgttatctcttgaattggtttaggtttctcaccaattcagactgcccctcttgtcccccacccccacattcccttagtccaaatgtaagaggatttgctgtaatgaaattattcctattatgaacctcagagaataaagatgcagagttgaaaacaaaatacataaatataagttgtcatacagcctgaaggctctgcaggtaaatgacaatcttattgtctagggatcaacttatctcctaagtaactagagtgccatcagaaccataaggcatttaatctactcgacagactggcattgaggtatgataccgtgggcctactgcctgttaggtgtcatctttgcagctctccatttctggtttctttggtctagtaatttgggagaagaggagaaaatacatcctggctgtggctggagcagcagagaatgataaaggctttttttccacacatttgtgtggttttccttatgcacccaagtggactggaagctcagctctgtcactgacgttgtggtgtggtcctaagcaggccaccgcagctccctgagccttagcagtttcttctgtaaaactgggataacatgacgatgacttttaggatttgccccagtgtaactcaactgggtctttagtaatttgtggtggtgttttatatggcatatgccttcatataaaacaatccttaactctgcaaatgttctacatggcccatcacttatataatcaatctctattggccacttctcagtgagagcctccactcgtctagaagacacctgagaaactaggacattaaaaatgaagaccagagcctccaaaacagaaacaacaaatccagcgaggcaaagctcttacatttcacctatactatagaccgtgagccctgacctggaatcatattgactctttccaaagggcttgattacatggtttgctaactgatagaagattagaaacagcacatataggagggtggagtagctaccaagggcaaacctgcacaaaaagagtcaggtgatggtgtaacaaaaagagaggtatgggatctatttttattatttttttttcttttccttctcccccagcatgagaattcaaaagcataaactctgtaatggtttgctatagacaaaacatccccacacatctttcaacagtccttaagggcatgactgcattatagcacaaaccaagaacagcaaatatagggtttgcatggataactcccttcacctgtgtctaaagcaaacgcccaaagtcaatctttaaactcttttaactgatgataatacaaggtatccttgtcttggctccagaatccttctcaacacgggactcaagctctgactcccaaccatttgaatttaattcatgagctggaatccatttactatcttggtgtaagtgacaactattgaaaggacagggatgtgggtgactcaattttttttttttatactttaagttctgggttacatgtgcagaacatgcagttttgttacataggtatacatgtgccatggtggtttgctacacccatcaactcatcacctacattaggtatttctcctgatgttatccctccccttgctccccaccccctgacaggccgtggtgtgtgatgttcccctccctgtgtccatgtgttctcattgttcaactcccacttatgagtgagaacatgtggtgtttggttttctgatcttgtgatagtttgctgagaatgatggtttccagcttcatccatgtccctgcaaaggacaagaactcatccttttttatggctgcatagtattccatggtgtacatatgccacattttcttaatccagtctatcattgatggacatctgggttagttccaagtctttgctattgtgaataatgctgcaataaacatacgtgtgcatgtgtctttatcatagaatgatttataatcctttgggtatatgccccgtaatgggactgctgggtcaaatggtatttctagttctagatccctgaggaattgccacactgtcttccacgatggttgaactaatttacactcccgccaacagtgtaaaagtgttatttttccacaacctctccagcatctgttgttacctgactttttaatgatcgccattctaactggcatgagatggtatctcatggtggttttgatttgcatttctctaatgaccagttatgatgagcattttttcatgtgtctgttggctgcataaatgtcttcttttgaaaagtgtctgttcatatcctttgcctattttttgatggggttgtttgcttttttcttgtaaatttatttaagttctttgtagactctggatattagccctctgtcagatggatagattgcaaaaattttctccaatgcaaaaagtttctcccattctgcaggttgcctgttcactctgatgatagctttttttttttttttttttggccgtgcaaaagactttagtttaattagatcccatttgtcaattttggcttttgttgccattgcttttggtgttttagacatgaagtctttgcccatgcctatgtcctgaatggtattgcccaggttttcttgtaggattttcatggtcttagatcttacatttaagtctttgatccatcttgagttggtttttatattaggtgtaagaaaggggtccagtttcagttttctacatatggctagccagttttcccaacaccatttattaaatagagcatgttttccccattgcttgtgtgtgtcaagtttgtcaaagatcagatggtggtagatgtgtggtgttatttctggggcctctgttctgttccattggtctatatatctgttttggtaccagcaccatgctgttttggttactgtagccttttagtatagtttgaagtcaggtagcatgatgcctccggctttgttcttcttgaccaggattgtcttggctatgtggactcttttttggttccatatgaagtttaaaatagttttttccagttctgtgaagaaagtcagtggtagtttgatggggatagcattgaacctataacttactttgggcagtgaggccattttcatgatactgattcttcctagccatgagcatggaatgtttttccatttgtttgtgtcctctcttatttccttgagcagtggtttgtagttctccttgaagaggtccttcacatcacttgtaagttgtattcctaggtatttttttctcttagtagcaattatgaattggagttcactcatgatttggctctgtttgtctgttattggtgtataggaatgcttgtgattttttttattatactttaagttctagggtacacgtgcacaatgtgcaagtttgttacatagctatacatgtgccatgttggtgtgctgcacccattaactcgtcatttacattaggtatatctcctaatgctatccctcccccatccctccaccccatgacaggccctggtgtgtgatgttccccttcctgtgtgcaagtgttctcattgttcaattcccacctatgagtgagaacatggagtgtttggttttctgtccttgtgatagtttgctgagaatgatggtttccagcttcatccatgtccctgcaaaggacatgaactcatccttttttatggctgcgtagtattccatggtgtatatgtaccacattttcttaatccagtctatcattgatggacatttgggttggttccaagtctttgctattgtgaatagtgctgcaataaacatacatgtgcatgggcctttatagcagcatgatttataatcctttgggtatatgcccagtaatgggatggctgggtcaaatggtatttctagttctagatccttgaggaattgccacactgtcttccacaatggtcgaactaatttacactcccaccaacagtgtaaaagtgttcctatttctccacatcctctccagcacctgttgtttcctgactttttgaatgcttgatttttgcagattgattttgtatccagagactttgttgaagttgcttatcagcttaaggagattttgggctgagaggatggggttttctaagtatacaatcatgttatctgcaaacagagacaatgacttcctctcttcctatttgaataccctttattgctttctcttaccggattgccctagccagaatttccaatactatgctgaataggagtggtgagagacgacatcctcgtcttgtgctggttttcaaaaggaatgcttccagttttggcccattcagtatgatattggctgtgggcttgacataaatagctcttattattttgagataggttccatcaatacctaatttattgagagtttttagcatgaaaggctgttgaatgttgttgaaggccttttctgcatctattgagataatcgtgttttttgtcattggttctgtttatgtggtggattacatttattgatttgcatatgttgaaccagccttgcatcccaggaatgaagtcaacttgatcatggtggataagctttttgatgtgctgctggattcagtttcccagtattttattgaggatttttgcattgatgttcatcagggatattggcctaaaatgtttttttgttgtgtctctgacaggctttggtatcaggatgatgctggcctcataaaatgagttagggaggattccctctttttctattgattggaatagtttcggaaggaatggtaccagctcctctttgtacctctggtagaatttggctgtgaatcagtctggtcttggactttgcatggttgataggctattaattattgcctcaatttcagaacttgttattggtctattcagagattcaacttcttcctggtttagtcttgggaaggtgtatgtgtctaggaatttatccatttcttctagattttctggttcatttgcgtagaggtgtttgtagcattctctgatggtagtttgtatttctgtgggattggtagtgacatcgcctttatcattttttattgcatctatttgattcttctctcttttcttctttatcagtcttgctagcagtctatctattttgttatcttttcaaaaaaccggctcctggatttattgtttctttttgaagggttttttaagtctttatctccttcagttctactctgatcttagttatttcttgtcttctgctagcttttgaatttgtttgctcttgcttctctggttcttttaattgtgatgttagagtgtcgattttagatctctcctgctttctcttgtgggcatttagtgctataaatttccctctacacactgctttaaatgagtcccagagattccggtgcgttgtatctttgttctcactggtttcaaagaacatctttatttctgccttcatttcattatttacccagtagtcattcaggagcaggttgttcagtttccatgtagttgtgtggtttcgagtgagtttcttaatcctgagttctactttgattgcactgtggtctgagagacagtttgttgtgatttctgttcttttacctttgctgaggagtgttttatttccaattatgtggtcaattttagaataagtgtgatgtggtgctgagaataatgtgtattctgttgatttggggtggagaattctgtagatgtctatcatgtccacttggtccagagctgagttcaagtcctggatatccttgttcattttgtgtcttgttgatctaatattgacagtggggtgttaaagtctcccattattattgtgtgggagtctaagtgtctttgcaggtctctaagaacttgctttatgaatctgggtgctcccgtattgggtgcatatatatttaggatagttagctctttttgttgaattgatccctttaccattatgtaatggccttctttgtctcttttgatctttgttggtttaaagtctgttttatcagagaccaggattgcaatccctgcttttttcggctttccatttgcttggtagatcttcctccatccctttactttgagcctatgtgcatctttgaatgtgagatggatctcctgatacagcacaccgatgggtctcgactctttatccaatttgccagtctgtgtcttttaattggggcatttagcgcatttacatttaaggttaatattgttatgtgtgaattttatcctatccttatgatgctagctggtgttttcacctattaatttatgccgtttctttatacggcgttgatggtctttacaatttggcatgttttgcagtggctggtaccagttgtttctttccatgtttagtgctttcttcaggagctcttataaggtaggcctgctggtgacaaaatctctcagcatttgcttgtctgtaaaggattttatttctctttcacttatgaagcttagtttggctggatatgaaattctgggttgaaaattcttttctttgagaatgttgaatattggcccccactctcttctggcttgtagggtttctgcagagacatcactgttagtctgttgggcttctctttatgggtaactcgacctttatctctggctgcctttaacattttttccttcatttccaccttggtgaatctgacagttatgtgttttggggtttctcttctcagggagtatctttgtggtgttctctgtatttcctgaaattgaatgttggcctgccttgctaggttggagaagttctcctggataatatcctgcagagtgttttccaagttggttccattctccctgtcactttcaggtacaccaatcaaatgtagatttggtcttttcacatagtcccatatttcttggaggttttgtttgtttcttttcactcctttttctctaatcttgtcttctcactcaatttcattaatttgatcttcaatcactgatatcctttcttccgcttgattgaatcggctattgaagcttgtgtatgcttcacgaagttgttgttctgtggttttcagctccaccaggtcattgaagctcttctgtacactggttattctagttagctattcttctaaccttttttcaaggtttttagctcccttgcagtggattagaacatgctccttcagcttggagaaatttgttattaccaatcttctgaagcctacttctgtttttgttgatgttgatgctattcctttctctttgttagttttccttctaacagacaggcccctcagctgcaggtctgctggagtttgctggaggtccactccaggccctgtttgcgtgggtatcaccagcagagggtgcagaacagcaaatattgttgtctgatccttcctctggaagcttcatcccagagaggtacccatctgtattaggtgtctgttggcccctactgggaggtgtctcccaattaggctacacgggggtcagggacccacttgaggaggcagtctgtccatttttggagcttgaactccatgctgggagaaacactgctctcttcatagctgtcaggcagggacgtttaagtctgaagaagctgtctgctgccttttgttctgatatgccctgcccccagaggtggaatctagagaggcagtaggccttgctgatctgtggtgggctctacccagtttgagcttccctgccactttgtttacactgtgagcatagaaccacctactcaagcctcagcaatggcggatgcccctcccccaaccaagcttcagcatcccaggtccatcacggactgctgcactagcagcaagcaaagctccatgggcatgggacccactgagccaggcacagggtgggggatctcctggtctaccggttgtgagaccatgggaaaagtgcagtatttgggcagaagtgtactgcttctccaggtacagtcactcacggcttcccttggataggaaagggagatcccctgaccccttgcacttcctgggtgaggtgacaccccacccttcttcggctcaccctccatgggctgcacccactgtccaaccagtcccagtgagatgaaccaggtacctcagttggaaatgcagaaatcacccatcttctgcgtctatctcgctgggagctgtagaccagagctgttgctatttggccatcttggaagtgaccccgggtgactcaaatttaagagaggctttctcgaatggtacaggacaaaaaaaaaaaagatttaactcaccagaggacgggtagtgttttgtcaggcaaaaaaagttgagaagggtctttcccaaaagttacctttctcatccccaaatcataggaagatggatctgatgcaaatacactatcaatttggaaaatcagtaccttcagtccagggccctctgtaggagctgaatagatggtgagcttctcctggagaagttctaagtcaaatggcaacatcttgggttttgggaatccatcctgttgggagcttttggggcatgagatgaaagaatgctatttttcaaggccttcctggaattcacgtaatccttgcaaaacaacattctgatgaattgagtcagagtaatgcaacccgtatatttctgattcacacagagtttacaagcgtttagaagttaaaagaagaggtactaggcatgatgtgccatccagtttcactgcacccaaaccgtttgaaatgcagcctcgtttctctttccttatgttgaacttggggacatcctggctcactgatgagtggttggaattggccacatggaatcagagtggatttctttaaccgtgcaggcatggtgaaaaggggcagaatttgactcataaaccccatgtgcacgttgatttgactccagcagcttggccctctgtgttagcagtggccaggtgttcaggccagtcctcacaagtcagtttatcccacccctcagtggaatatgtgctaagtcacccatgatggaagccacagtctttctgtaacctaattttggaaatgatatcccatcgcttctctcatgttctattttattgctagaagcaggtcactaaattcagccaacacacaaagagaagcgatttcacaagggtggtgaataccaggaggcaggggtctctggggccatcttggaggctgcctaccacaccaggaatcctgactctttgtcacttagtgtctgtgtacgcttaggaaagtaatctaatctttctgaggcttgggttttctacccataaaatggagatagttgatgtaaaagacctgacacataagagatagcagccaaaaaataatgatgacgatgatgatgataatgataaatgttagttttcccttccttctttccagaaggtagagtgagctccccacaagcacctgggagaatagtcacttgtatagaagagtggactgggggagtctaatgtttttaacatttataacccctttttcactgaactggaaaagaacagaagcacactgctcccagtagtatgggccacatcaataattaccacacacatttatagtatcttcgatgatgatttacttccagatgttttaagcatataacgtgtcaaatcaaaagtggaattgtggtggggtggggatgacactgaagggaataatggtttcgtcactgacctcccagtgtgactcatggtgtgtgtctcactgccaagaagccctgactatgaatatgcagccgttggggaaggaggcgttgagagtgggtacttcatatggccccaccagaaggatttttttttaacacagcagcagtaacctttaagatagctaaggtacagttctctgtgttctgtctccttgcagtttctggagaatcctttgtctatagtccagatctcctttcatggctatctaatggatctgtcttctgcagcgtttccatccaggtgttggcatcctttcacagtaagcagtaggagaggcttgctgccgaggctcatatatgtcacaaacaagactacctgatcttcattgagagtcactctgatgaggacattacatgttaccatatctaatcagtagccacttgaggtagggactattattcctacttattgatgagaaaaccaggacacagcaaggtaaagcaacttgtccaaggtcacagagctagtaaatgaaaaaaaaaaatctgtgatgatttacaataaaatgaagcttagccagagctgggaactggaaataagtgcaagttgtatttgcctgatttctctgtgagaacctggctagatttcaagcactgaagtgaagtgtctagctagtgtgatttgggaataggtattttcaaagttgttgacatatgctggtcattcgtgaccaatttcaaactttaggctttatgatgatgtgtctcccatggcagtacttttttgacatgtgacattctgccactgcaaaacagcgagagaaagaataagataagtgcaaacaagaaccagggacttcaattggtgataaaggtaaaaatctcatgttctccaagtagtctagtaactaacgtgtattctgattaaaatgaggtggtttggatgtctaattaaaatgaggcagatggaaagagaacattagatgtactagccagtgtgtgacactgcacaacttatcatctttaattctcatttccctcatttatacaaaggggttaatgactgccaacctcatagggttgtgctatcaatagaataagataatgcacaaagccatggttcaatcaaatatgcagtgtgctgccctctacctagtggcctttaaggattttggttccctgtcctgtatcaacctatatcacaaatcagtgatataggttgtgtccaacacaaaccagtgttggacaggatggtccagtaagaagaccattcttactggagcattctgcaattctggaacagaacagcggggaccagtggttttatgcagaggctgtgaggagtaggagacattggagacactctttacaatgatgatgaaacagcatgctggaatcaagaagtgcttttccatcactaagagaagccatggaaattagcaggctttgggagtgtgcttaaacttccgtaagttttcagggtgtcttaaactgctttctgtgcaagaacccttcccagtattcagaaaactgtactgcccaaagactttattgcatttgtgtttttcgcagttgagaagctgatatattcaaggaagagtactgactggccatccgggcttttaggtgtaactcatttattcaccaaatatgtatcaaggctactccatccctggtattgtggagatacagcaatgagtcagacagtttgaagtccttgtcttcaaagagcttacagtctcatgaagaacaatcatgtcaatagttcaatccagtgggagaagtgctctgtcactactgaggagaaggaatagcagaagctctgctgagtgatcctttctccaaatttcctggaagaggttattaaagtataaattaatcagagaaaacacttcaagcagatggaactttatgaactaaaactcaaaagcaagggagagatatctgattcaaaggggctataagaagttctgtgctgctggagcaagactgattgtgatgtggggtgggctgcagggacttagagagaggtatgagatgatgcagagaaaatagcatgaggatgcaggggactagcaggtgatggggcaaaagaggtaagcggggatcaggtcatgaaagatccttgcaagtcacattaaggagtcccgacctcatcttgagcacaatggggagccattgaaaggtttcaaagatgagagaacttggccagatacctttagtagatggttagactaggtgattgatctttaagctctgagtattttaaccatcctaaacagatactattgtattttctttgaaattctacccagagaaacaaattcttttactactttaaatacagtaaattgtacttttttagcctttattcataaaatggtgtcaatctagcaaaactttcattgctcatttataatgtggaagagaccatgctggataggtgtggtggtggttcaattgtgaataaagttaaatcagatttcaagagacacataatggtcctacacagtaagagacatggcattagatatattattgagcaatgattgattttggagtcagatattctacatgtgcgatctttagctgtctaagcctcagtcttttttatataaaattgggatagtaatactatcttctgtgtaaagtcattgagattattgaagatagtgtaggcaaaacacttaatccaatgacgagcacataataaaaaatgtagttaccaacattttatatattttttattttttgtttatttatttattttaaaaattttactgtgtaacttggcatggtggctcatgcctgtaatcctagcactttgggagactgaggcaggtgtattgcttgagcccaggagttcgagactagcctgggcaacatagtgagaccctgcctctataaaaaccaaaacaaaacacaaatttcagtgtgcagttttgaggtttaagatggtgttacgggatgctacactgtgtaacaatgattactatagtgaagcagattaatgttcgtctcacatagttacttctttcttgtgtatgacaagtgcagctaaaatctacatagataacaaaaatccctaatgcaataaaattttattaacataatttgtaataacaataatggtactggtacctttgtgaagctagaactggcaaaaaagagtttggagggaggtggcaaggagaggctgttgcgaacagcatattgtagttgtggtaggatctctgctttttgaacacctcaaattcagaattataggaatctgatttagtgtgaaattattttctctatggggctgaaaacagtttgcttacaaatgaataatggaaaatatggtagcagtagagttaagggactgttaagctctttaaatatataaataaaacgtgtgtgtgtgtgtgtgtgtgtatgtatatttcaagcactttaagcagctttcaagccatgcattttacatgaaataagctgagtatcaatgtgaccatattgacttattcaagtatcttcaagtatcacttaattgacagcacattgatagtcatttattttatttttatttatttatttatttatttttgagacagagtcttgctctgtcagccacgctacagtgcagtggcatgatcttggctcactgcaacgtccgcctcccgggctcaagcaattctcctgcctcagcctcctgagtagctgggattaccggtgtgtggcaccacgcctggctaattttgtattttcagtagagatggggtttcaccatgttggccaggctggccttgaactgctgacctcaggtaatccgcccgcctcggtctctcaaagtgctgggattacaggcgtgagccactgcgtccggccgatagtcatttattttaaataatatgtttaaaagcaattaaatggcatttctttgcagaacattttgtcttttttgtttactgtatatgttcttttttctcctctagctttctctacttactctcaatgtgtgttattttactaaatttgcagcagtcatcatttactttttttattcaaagaatatttattgaatgcctgctgcattccaggaaattggctggatactgagacaggaataaataaaaagacaagggcctccctcttgaagcatgcattctagtcataggtttggttttggaatagaatagtgatcatcttttgggggttggctcaaagtgtctagtggtatatatagaaaaataaacgtggtaaaattgaacactgacagaatgataagttaatcagagttgagatcattatacaggatcacaaactttgggacaatagcttttggagacactgtttttgaagacaaagtatctaaaattacaggcaactatttttggcacatagagattggagtgtttcccccataagcaaatgctttcactctacgctagagcgataaaatcccatcttagtttctcagcaattcaacatgaatattaacagggaaaattaagcactactggactattaaaaaatagacatttaaagctgtgaaatatttaaatccagatctgctcctgccttgctcaaaccccttaatagtttctatctgcagaggaaaagctgaactttaaagcttttcattcagaacctccatacaaaaccagccaatagctgttgttcttcttgatatcttgtctttaatccccaaggtatcctgaagtctcaagagaccttggatgaagaaggaaaattttgctatcgctatttcccataactctaaacactgcctcatctttgtgatttgtatctatcctggctttctttttgtaagcaagtatctggttcatttatgtcattcaaccaataattattgaagatcttctgtgtgccagaaatttatagtttttgtttttctctttatttgttccccttgaaatatatcatctaatctgtagtttctctaactaagcactcagtgttgcttttccaactggtatccggcccacttatctagaatatcagagtagctttccctatcaaacagcttcactattccactgattattcactggccgcaaaggcaaaacaaaagatttattgaaggaagtggcagtagcctctttgtatagatttgttttccacctacttagcagacatctgcttttattagattggtgcagaagtaattgcggttactttttaattgcaaaaatcacaattacttttgcaccaacataatatttcaaagcatctttacttctagtgttgaaatatggtttttaatctaagaaaaattcccactatattatttttgacaacctctttcttgatttacataattggtcagggcacagtggtttacacctgtaatcctagcactttgggaggctgaggtggaaagattgcttgaggcctagagttattgactagcctgggcaaaataacaagaccttgtctctacaaaaaataaaaataaaagaaattagctggggtggtggtgcaggtctgttgtcctagctacttgggaagctgagatgggaggattgtttgagcccaggagttcagggttgcagtgaactatgattgcacctctgcattctcgtcagggtaacagagcaagaccctgtctctgaaaaaaagtaaaattaaattaaaataaataagtttatagaattgatttagaagcataatttttgggagaccccaaactctttctaacttgcctttatgatcacgtgaggtggaggcaatttttatcttctcgacacacatcttctatcctgcagaattcagccatccatccctctcttcaaccatccattatcatgctataggctatgccttgctctaccctctgggaccaagacagagtctaaggcagagttcttgcccttacagagctcatgttacaagatgcatctggggctgccaagttcccaggtcaactaaagagtctggatatataaacctgaaactgggcagttggcttttgtttgtgaatcagttgccatgacctcagagatatgctcccccgttatgagtctagaatgttatataggtacccctggcctggcttgaaaatttttcttggttattgctgtaatctctctgaaacacaacacagtgctgtacacgtagtagatgtgtgaaaagagtttgtggagttgaattgggttgatgttcatttgccacctgccaactattagtcagtgaatctagattccaacaaaggacaccgtgataaagcgtttaagttctgaaccaattgagaaataagacaaaggtagatgtaaaagatgccatctataattctggtataaacagttactggagaacatggcttatgtcttcaggcaaataacttttatactatcaagtacaggaacaagtagacttacccacccagtcaccagcacttggtcagcctataggacagaggctccccttggagaagctgagtagaacacacattccctgtagagcttgtattcaagaacaggaagaggaagggaaggggctggctacacatgcccaagtttcaccttctaaatttcaagctctctgataagatttcatcacccttctcacctccccacattccccagatggagtgaatgagaaggcagagagaggcgagaagtatcaccttaatgggaattcgtccacagagaagaaaacttaggaatcaagaaaaacattccctggcaacactcatttctctattgatttggaagatgatccttacctatttcctggctgggttcttcatgtttgtcttagcttgttgttggtttcccacatctaagcatctaagactctaaggagtcatataattctaacaactcagaacttacttatgtctggtttttcttgcctgcaccttacatttaggatcatcctttttcctggatcctatctgcctgacttgatatgagcctatccagtgagctcagtcatccagcaattagagactaactgtgatggatgaacacattaattatttggcaactctgccaggcactgttttggacattaaagatatggaggcgatcaagatagatatggtctcttccttcatggaacttttggacaacaggaggctagagacatgtagcagaaaattttatcccaactctgataataactcagacggagaaagcatgcttctgacatattatacaagatcctcctacactagctgcagataataaaatatgcatttagaatcctttccatagtatttaaagtgccgatgaaatggttattcataatgttttatctgctatctttattttattctttttaattttccttactattaatattaacttctctggtaaaagaagaaaaataaaataaaccccttccaaatttctgtgaagccaggagaaaaaaaaaaaaaaacagagatatccactagcaacttgcaaagacaaaagggagttctaggggtaataaaacatacacttgacaaccgatattatccactggtgagatattgttcataaatccacagcctgaaattgcacgaatgatcaccctggttatcaaggccatgcttacgatggcctggtggctctgggaattacctccttggattgctgcaaatccctcatcttcaacaaattcatcatgcaaagtctccactataatgaaccttgggtaaagctcagtgctccaacgtattttaacatgttaagtggagtgtggcccatctcagaaacataacagtttgggaatgttagaaaagaaacttcatctttccaatttattttccaaaattatcttaccacatggcatcaatgcagtcctggtggtttgaaaactgaaatatttatcctctcagcagaaggaccactaggggaggttctcacctggtgggatggagttctcctgatcagggtctgtagcctggtgtggtctgcagtagggtaagccttgaggagtttctggcaggacaaaggcagccagcgtgttacctagttgtcaatcacagcaaaaaatttttgcttttgtttttgttttctaaggatcccattggttctcctggttattagtccattctcacattgctataaagaactacctgagactgggtaatttataaagaaaagaggtttaattggctcatggttcagcaagctgtacaggaagcatgactgaggaggcctcaggaaacttacaatcatggcgaaagtcgaaggggaagccagcatgtcctacacggctggagcaggaggaagagactgatgggggaggtgctacacactcttaaccagatctctcgtgagaactgaccacactcttaaccagatctctcgtgagaactgactatcatgagaacagcagggagaaatccacccctgtgattcctttacctcccaccaggcccctcttccaacactgaagattacaattcaacatgagatttgggtggggacacagagccacaccatatcacctggaaaccctcacagagaaaatctgtgatggcaactggaggctatggaacactgcacctccttccagtattccatacctgaatcggccgcactgtcctctctgttgaacagagcagagcagattctgtcacctaccaaacacaactccatgtcacgttcagtcaataactgtatatgtgcgtgtggatatgtgtatgtatgtacacatatgtgtatatacacacatacacaaacacacatgcacatatgtacacacatatacattcatacatatatacatatatacaaggcatcactcttattaggtgctgggtgccctgacaagtcctatgagcatgaatgcgaacaaggcagatagggtgtctgtcctcatggaacccacacactaataggccatgaagacaattcaaataaagcagagtgtctctgaatctgatctggggatcacctgcctccaaagcacctgggacacttgttagaagtgtcagacgctaggcttatcccggtccagtgaaaatggaagctgctgggggtgaggcctgggaatcgttatcttaacctgctcctccccaggtgtagtctaagtgtgaggatcactgtagtgtgaaaaatgctgtaatagacaagtgtacgtagttaatggaatttgcaggaggtgcgcctaacagaattggcctgtggaaatcagagaaggcaccctggaggaagtagttcccaagttgggagctcaaaaaaagaaagaattatccagaaaaatacaagacagaagagcagtcagaaagaatgctcagcagaggaaagccagagagactataggaagacttctcaaagcacccacccctaacatctaaaggactccatcaatacaggccaggttagtgttcctccttctctccatttatcatgcttccaatttaatagtagaaaaaatcttcctatgcgtcttggcatcccagtaagctgcatatattagtttcacttcttcttcttctgcatacttctttctgataatgacaataccatagaaacctgaatttgtgtttggacacagtgcaggatctaaacagttacaaaaccttccatgtgtagctcttaggaacactgaatctctgacctcttgcggtgctatggctccttggcagccatccccaagggaatggatgatttcacgttttctatacaaaaccgagtgtgtcccgagagtgaaacttccaacacctacacttgaatggtccatttctccactgggtgttaatcacttcttaattttatatttgttcaggatccagcttactgtggtcaattaaggtcaggaggagatgtcgacttgatttagtaaaattggattgtctgcctcgagtttatctccttgggctgggctgtcatttgaattttatgtttttgttcttatttcttcctaccattttttttttcccggggagggttttcagtattccactcgccctatctgtttgcaaggaaggtgtttgtttctataaagtgcctgtcccatctgatctccatcatctttatggtcttgcattctgtcactgcagctcatgtctggctggggtttgttatgttttgacaggagtttgttataaaactggggatcacgtccggctttgcctttccaacttccttctttacggttgccataaacccatgctgttaaaatgttccctctgaggagagggtgaaattctaataacaaaatccttgggggagaggaaaggggaggagggaaagatagagggataaagagtaggataattgaagagatgttattatgtagcaaggtacatactaacaatcatttgaatgcaaactataaaaataataccaagagtttccaaagatttgagaaaataataacagacaggagaacttgatctagattaccctgacctgcctaggtacataatacatttatattgacatggggtggtgtcaggggacttttactcgaggaggcagccaagctctatgtccctggtctcctagctctgggaaatagcaaaaggagtaggttctgatacagaaagatgtctccagaccccaaatgcagagtcatacagcaccagggcagcctcaagtcactcttaggaaacacagtttctcttggtggccttgtctccccaacctacaattcactcaaaatgggttattggccagagactcaggtggctgtttccatctcctcactctcctgacaccaaccacccctttgccccactgcctacctggacatcaagttgattttattctcagcacctctgcttgggaatgcattgacccttctttccttctttccattcatcctccatctctccctttctcttttgctagcatttattccctatgtattgaacacacactgggaatcaggtgttttctgtgttatttaatctttatggcaagttaataataataaaattataaaataactaacagtagtcaacacattatcttgatatgtgccagtgcaaaattcagtcatccaacagatgtttatttatgaaacgcctactacgcattctgagagaataaccagtaacaaaaagacatggttcttccctttctggagcttgtattcttgtgggggaatggttgatacagtaactagtatataatgtgagtatccatgaatgttaggaagaaaagttaattagggtaagggggtagagttcgcctgaggcaagagcatttcatggatggttttataccatctgtacaacatccccatgaggttgcttctgttctaattcccatttatccaacaagagacctgagaccagagtgattaaggaacttgcccaaggttacacagctaccataaggcagagcacggagtcaagtcctaggcagggctgctccaggtccccactcttgaccccatggcccactcctggcagaggctcaggcctaaggagccttgggaggacgaatcccaggagggttccctagaccttctttttttaaaattttatttattcactttttttaatttcttccaaaaaaatgggatacatgtgcagaatgtgcaggtttgttacataggtatatgtgtgccatggtggtttgctgcacctattgatccatcctctaagttccctccttcaccccccaccccccaacaggccctggtgtgtgttgttcccttctctgtgtccatgtgttctcagtgttcaactctcacttatgagcgagaacatgtggtgtttggttttctgttcctgtgttagtttcctgaggttgatggcttccagcttcatccatgtccctgcaaaggacatgatctcattcttttttatggctgcatagcattccatcgtatatatgtaccgcattttctttatccagtctatcatcgatgagcatttgggttggttccatgtctttgccattgtaaatagtgctgcaataaacatatgtgtacatgtgtctttatagtagaatgatttatattccattaggttatatatccagtaatgagatggctgggtcaaatggtatttctagttctagatccttgaggaattgctaaactgtcttccacaatggttgaactaatttacgctcccactaacagtgtaaaatcgttcctatttctccaaagcctcaccagcatctattgtttcttgactttttttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcatgatccgcccgcctcggcctcccaaagtgctgggattacaggcgtgagccaccgcgcccggccgtttcttgactttttactaatcaccattctgactggcatgagatagtatctcattgtgattttcatttgcatttctctgatgatcagtgatgttgagctttttatcacgtttgttggtacgtaaatatctttttttaagaagtatctgttcatatcctttgcccactttttttgatggggttgcttgtttttttttttttttttttttgttttttcttgtaaatgtgtttaagttccttgtaaattctggatattagacctttgtcagagggatagattgcaaaacttctctcccattttgtaggttgcctgttcagtttgatgatagtttcctttgctgtgcagaagctctttagtttaattagctcccatttgtcaatcttggcttttgttgcaattgcttttggcatttttgtcatgaagtctttgcccatgcttatgtcctgaatggtattgcctaggtgttcttctagagtgtttatggttttgggttttacatttaagtctttaatcaatcttgagttaatttttgtataaggtgttaaggaaggggtctggtttcagttttctatatagggctagccagctttcccagcaccatttactgaataggatatcctttccccattgcttgtttttggcaggcttttcaaagatcagatgattgtatatgtgtggtgttatttctgaggtctctgttctgctccattggtctgtatgtctgttttggtacaagtatcatgctgttttggttactgtagccttgtagtatagtttgaagtcaggtagtgtgttgcctccagtttgttcttttcacttaagattgtcttggctatacaaggtcttctttgattccatatgaaatttaaaatagtttttttctaattctgtgaagaatgtcaatgtagcttgatgggaatagcattgaatctataaattacttcgggcagtatggtcattttctcaatatcgattcttcctatccatgaggatggaaggtttttccatttgtttgtgtcctctcttatttccttgagcagtggtttgtagttctccttgaaaaggtcctttacatcacttgttagctgtattcctaggtatttttttctctttgtagtgattatgactgggagttcattcatgatttggctctctgcatgcctattgttggtgtaaaggaatgcttgtgatgtttgcacattgattttgtatcctgagactttgctgaagttgcttatcagttcaagaaatttgggggctgagatgatggggttttttgaatataaatgcatagtaggcatttcataaataaacatatgttggatgactgaattttgcattggcacatgtcatctgcaaagagagacaacttgactgcatctcttcttatttgaataccctttatttctttctgttgcctgattgccctggccagaacttccaatactatgttgaataagagtggtgagagacagcatccttgtcttgtaccggttttcaaagggaatgcttccagcttttgccattcaatatgatattggctgtaggtttgttataaatagctcttattattttgagatgtgttccatcaatacctaagtttattgagagattttaacatgaagggatgttgaattttaccaaaggccttttctgcatctattgaaataatcatgtggtttttgtctttggttctgtttatgtgatgggttacacttattgatttgcatatgttgcatatgttgaatcagccttgcatctcagggatgaagccgacttgattgtagtggataaggttttcaatgtgctgctggattcagtttaccagtattttattgaggattttcgcatcaatgttcatcagggttattggcctaaagttttcgttttttattctgtctcttcccggtttgggtatcaggatgatgccagcttcataaaatgagttagggagggatccctccttttcagctgtttggaatagtttcagaaggaatggtaacaactcctctttgtatttccggtacaattcagctgtgaatccgtccggtcctgggcttttttgtttggtaggctattaattactgcctaaatttcagagcttgttattggtctattcagggattcaacttcttcctggtttagtcttggtagggtgtatgcatccaggaatttatcaatttcttctagtttatttgtttagaggtgtttgtagtattctctgatggtagtttgtatttctgtggtgtcagtgtttatatcccctttatctttttttaccgtgtctatttgattcttttttctcttcttcttagtctagttagtggtcaatctgttttgttaatttttctcaaaaaacctgctcctggattcgttgattgtttggaggatttttcgtgtctctgtctccttcaattcttctctgatcttagttatttcttgtcttctgctagctgttggattagtttgctcttgcctctctagctcttttaattgtgatgttagggtgtcgatttgagatctttctagttttctgatgtgggcatttagtgttataaatttccctcttaacactgctttagctgtgtcccagagattctggtacattgtctgtttgttctcactggtttcaaagaactttttgatttctgccttaatttcattatttacccaggagtcattcagaagcaggttgttcaatttccatgaaattgtgtggtttttactgagtttcttaatcctgaattcaaatttgattgcactgtggtctgagagactgtttgttattatttccgttcttttgcatttgctgaggagtgttttacttccaattatgtggtcaattttaggataagtgccatgtggtattgagaagaatgtatattctattgatttagggtagagagttctgtagacgcctactaggtctgcttgatacagagccgagtaaaagtcctggatatccttgttaattttctgtcttgttgatctgtctaatactgacagtggggtgttaaagtctcccactattattgtgtgggagcctaagtctcattgtaggtctctaagaacttgttttatgaatctgggtgctcctgtattgggtgcatatatatttaagatagttagctcttcttgttgaattgctccgtttaccactatgtaatgcccttctttgtcttttttgacctttgttggtttaaagtgttttgtgagagactaggattgcaatccctgctttttttttttctttccatttgcttggtaaagtttcctccctcccttcattttgagcctgcgtgtttctttgcatgtaagatgggtctcctgaatacagcgcactaattggtcttgactccatatccaatttgccagtctgtcttttacttgaggcatttagcctgtttacatttaaaattagtgttgttatatgtgaatttgatcctgtcatcatgctgccatttggttattttgcacactagttgacgcagtttctttgtagtgtcattggtctttatatgttggtgtgttttcgcagtggctggtactggtttttcctttccatatttagtgcttctttcaggagctcttgcagggcaggcctggtggtaacgaaatccctcagcatttgcttgtctggaaaggattttagttctccttcacttatgaagtttagtttggctggagatgaaattctgggttggaaattctttactttaatagtgttgaatattggcctccaatctcttctggcttgtagagtttctgctgagacgtcctctgttagtctgatgggcttccctttgtaggtgacctggcctttctctctggctgcccttaacagttttttcttcatttcaaccttggcgaatctgatgattatgtgtcttggggttgatcttcttgtggagtatcttaatggcgttctctgtatttcctgaatttgcacgttggcctatcttgctaggttggggaaattctcctggataatattgtgaagggtgttttccagcttgtttccattctccccatcacattctggtactccagtcaatcgtaggttcggtctttttatgaagtcccgtatttcttggaggctttgttcattcctttcattttttttttttcgctattcttgtctgcatgtcttatttcagtaaggtggtctccaagctgatattctttcttccacttgttcgatttggctgttgatacttgtgtctgcttcacaatgttctcatgctgtgtgtttcagctctatcaggtcatttatgttcctctctaaactggttattctagttagcaattcctctaaccttttatcaaagttcttagcttctttgctttgggttagaagatgctcctttagttcatcatagttttttattacccatcttctgaagcctacttctgtcaattcatccatctgatcctctgccccgttctgcacccttgatggagagatgttgcgatcatttggaggagacgaggcactctggccttttgggttttcagcattttttcactgatactttctcatcttggtgagtttgtctagtttcggtctttgaggctgctgacccttggatggagtttctgtgggggcctttttgttgttgatgctattgttgccactttctgcttgtttgtttttctttcaatagtcaactccctcttctgtaggggtgctgcagtttgctggaggttcacttcaggccatattcatctgattcgctcccatgcctggagatgtcactcaaggaggctggagagcagcaaagatgggtgtctgctccttcttccaggatctctgacccgaagggacaccaacctgatgccattaggatgccagtagggtgtctgacaacccctgttggaggatctcacccagttgggtggcacaggtagcaggacccatttaacgaagtgctttgtcccttggtggggagagtgtgtttcgctgagaggggaaaccctctcatctgtgctatccagattcctcagaactactaggaggagaggctaagtctgctggtcagcagagactgcagccacctctccccctccgcctaggggctcaggcccagggagatctgaattctgcccctgagcctctggctggagttattggagatcctgcagggaagcactgcctgagggaggataggtcagggttgggcctgaagaggcactctggccgcagactgccacagccgatgtgttgggttgtggggacacgtcttgggaccaagctgtccagcctccctggctccagcaggggaaaagcacagcctggagctatagaaatgggtgccactcttcccctacctagggagcttaggcagctgtgagtcccagtgctggctgctgcccctcccccaaggagctcaaatggcttagacagcaggcagctggttgcccttcccctcccccccccgccccctcccctgggagttcagtaggcttaagcagattccagctgagaggctgttaagaatctgctggttccggggttgggacactagaccccggtggcgtgggttcgcaagtgggatcttctgatctgtaggttgcacagtttccttggctgggtagcacgctcatttaccatctcccttggctgggaggaggtggttccccttccctgtgtggccctcaggtaggccactgccccgcgctgttcttccttctctccatgggtcacaccagtcttctagtcaattttgatgagagaacatggataccttgattgctagtgaaggattcactcgcttattacggttttttctatgggagcctccgaattccgctgtttccagtcggccgtcttggccccgccccccagaccttcttattagtttttaataatgacagaagagagagaatgaagccagagagagaagcctgagctgtgacctgcaatggagcagccctgctcctgactcgtgtggtccagcagatgtctggtgttcctctctccctgtcagaagccctcctctcgtcctggaggtgatggagtgcagaccgttcagagatgtcattcatctttaggaatggagccccagtcccccactgaaaggtgatgggacagcttcaaggaagaatgatgggataatggcggaaagtccggtgcgcttgttatgtgtgttttaacctatgagagacattagtgacgtgctgctgtaagcattggcacctaggtccaaggatcaggttgaccagggccatttcagaacccatagaatgcgcagaggccgctttctcttgccgaaaacctgcacacagaatgtcataccccacagctggtgcccaggcaatgtttcagacatgggtgggtataattgggctgttccgtcctgctgcctgagagcctatgcaacattaattctctgttggaacggttgttccttttcttgtagacaatccaagggtcagaagcacagccccctgtggactcccgaggaatgtgaatctgaccctttttttactgcttctcatttccaaggacttttacttcctgtaaaatgcccctggaatgctgacctggcatgcaaatagtcttttttttttttttttttttttgaagaagtgtgattttctgtatggagtcggatgtttgtgaatcacacacatacagtatggtaaggtagaaaccccatcaaaactaagttgtcttagataggagactttattttttactagcagaactcaaaattaactttaaaaatgaatcttttaaagtgattactctaaaccagaaaccatgttctggactagaacattgagatatgaaaattccagatgcagggccctaaaaccttatttccccttttttgtggtcttgattctcttgaacctgaaatgaaagtggccttacctctgtgttagaaacccgtgcgtatgcataacaggtttgagattcgcagactgtccaaataggcgtgccaagtccacatttatccacttgccaaacatctcataagtagctatttacatcacaaatgtgccatgatactgaaatgatcaagaaacgttctctgccttcagggaactacagtcactgaaggaaagacaataaaattgatgattacaatgcagtgtgatgagtcccaaatctgtgcataaacagggtattatgggagtgattaagtagagctaacatgtgtcaggcattgtgctaagcacttcacgtgcatagtgttattaatatttgcaactgcccactgaagcagttattgttgtattgccattttgcagctgaagaaactagggtttagagagcataaatcatttcttcaaggtcacagtatgagtaagtagcacagccagtgtgtgaatcagaaactttcaaggcagtgctcaagtttatgaacactttaagaatacaaaggagagaatgagagacaaaagggcaaggaggatggttctggagcttgagacttgaggatgcctatgagtttggataaaacagaagagatgaagcaaggcccccctgggtggcggatgctgaatgagcaaaggtttcaaagaatgcaagtgcatggcagcactgaggaagtagatgagattgaaatggcattgagaaaagggtgtgggggagagccagtttattattttaattctacaaacctttcttttgacttcaaaatcccctttcaagggtcatgttttattagcttctattttagtaactgcttaacactttagaaggaatgtcttgtataatatccaaccctgaggaaaggaccagttttacccaagtctgccttctctctacagaaaggaaatcacctctctcaccactcttagaattgctaacggttgatgattcctggtttaggttaaactggaaattacacacatatgtctgtttctctggcaacatttctctaacccagatgaatcgtgttgatattaaaacacaaaattcaatgacttagggtgtccccattggtttgagttggagaagtcctgataaaacatattgaaataattttataagaactcttagagtttggcaactttgaaaaataaaggagtagattttcttttctacttctctagtctggagtaatttttccatgcagccaagtgaatggattttgagtagaaaactgcaaaccatctgaaaaggtcaaatgtaaattagtcacttggagcaataaccacatgagctggatgcctgtcattaattatttacctttatcatttacatgcagataaacttttgagtacttgagggctgtcactttgtgagggacatgctttatgatctaaatggcaaaaaattaaaaacttgacaatattaagtgttggtgaaagttgtgggtgaaacaggtactatcagggctgataaggaagcaaattggtaacagcattttgaaggacaatttctggtacctagtaaaataaaatatatatttccctttctaccctgttgagaaaagaatgtaaaacaatctctgatgtccctcaacatgggaatatctagataattttgatagagccatactctagaatacaatgctgcatttaaaatcaacaaatgagtcttcttatgtacactaacatatttaaagctgaaagcgtattattgactaataaaagaaaaatcctaccatatagatacatttaatataactttgtgtaaataaacacaaaatacaatgaaacaaaataatttaaaaatctaaaggctagggaacattgataaaaaggtgagctaggaagtggtgaaggcactgagattggtgggtatagggtggtcagggaacctacacttactggtaactgttttacttaaccctagcagtttaaacaaataaagtttgatattccaatgtcttaacaccatagaaaggtattttttgctccaaagtccaaatgagttctccccaaatgtggcagttccccctcctggtggtaacttaggaaaccagaggctcctccatttcctgactcctccatccttagggcagtgagcagggcggggaggtctctggaatctgcccactgtgtcttcagtgtctggatgtcagagatagggagatagtgcaccagctacacacagaatgattttactggcctgtctggaagtgggatttcccttcttgacatctattctgttgaacaaaatgaaaacaatggaagtgtccattaggcactggccacaactctgtcataagacagcactgagctaaaagggagtttgataattctgtaaggtctaactcaacacctggagaaaagaatcaaatttattgtgacgagctagtgagtacctgtgagagtaatatggtgttttttttgtttttttgttttttgcacatgtattactaatgtgacttaaaaactaattataattaaatcaagacatagaaattaaccaacattggttgatcaaaaacaaaaagtgttccattttattgcaccctaactccaagtaagctatgtagttttacttctctgatcgtggaatttctctcctattaaaaggaaggtgtggaatataatcatggataacctcattacttttattaaataactgtcagcattttatattttattttttcccacatctgttaagtgccattcatgatcactaatcaagagctaatcagtattaccataaccgggatcatcctactcgaatcagagaaacatgttaagtatgttcctttttaatgattttttaaaaaaatatagaactagctaaagttgcatttgaagaccttcaggaatccattgggattaggagatgctgctgggaattactggactaaaccttttgctggccttatctttctaacttagcatccagcaagtggctcaaatagagcgctgctttcactgacatttgtgaaaggaatgaattaattcataagttaaatttatccaaaaatgtggtatatgtgtgcataagagaaagtaaggtttatactaggagtgcaaaaggtgttcgataattgaaaatatattaatgaatcgttttctaaaggaaaattgctttattgctgaaaaggcatacagtcaaattagacatttatcaggattaaaaagaaaaaagtcataaaaccaaggaataggataatagtttgtttttctttccatagcaagtaacaagatctcaaatcaacatttagtacttcccctagtcctagatacattccctaaaactatcaaggagaaaaaagaatgctcgctacttccctcattatttaaaatttttctgaaagttctgttatacatatatatatataaatatatatattttctcatgttattgcaaagttattgctatatatatataagaatatatatattctcatgttattgcaatggttagaacaggactatatataggaaaggagaatctatatataggtaaggagaaagggaacaaaaatatcaatatttgggaatagtggattattttgcctagaaaactttttaaaacattccccaaaagctattaatattaatgaatattcagttaaatgcctgggttacaaatagaaatacaagttttaaaattccattaaccatttagcataactaaaatattcaaggatcttaagaaatgttaagtatccaaatatagaaaactacaaacttcagagggtgcaacatatttgttggccaggcactatggctcatgcctgtaatcccagccttttgggaagccaaggcaggaggatctactgaggccaggagttcaagaccagctggaccccgtctctataaagaagtaaaaaatttagcctgtcatggtggcacctgtgttctcagcccacttgggtgtctgaggcaggaggattctttgagcccaggagtttgaggttacagtgagctatgattgcattactgcgctctagcccaggtgacagagtgagaccctttttctaaaagaaagaacaaagaaaaactatggaatttcttaaagataaaaataaagatttaaacaactggacatacatttcgtattcctttataggaagattggatattttaaagatgccaactttttcttagtacatttaatttaatttgaatcaatttctctccctatttcttttttgaatttaacataattattttaaggttcatatgaagaataaaaaacagagtacagttatgaaaatgctgacataaaagagtaatacagagggcaaaaataaatctgtcagacgtaaactacatcttaaagttttaataactaaaagactattgtatcgtcataaggagagagcaggagctctatgtaatggagtagctcatccagatgagatcctccaaggtataaatatataacatctgaccaaggcagcagcctagatcacgggaatataccaccttctctaactaatgctgttgcttctgccgggaccactctcttgctgcgccctctgtgcctgattaacatctctgcatcccttagctcaggtctttctctgacacctcactctctccacatggactctgtactatctttacaagccattagtaacacagcatggacttattatggaagtcattaaaggatttcaatttcatacttacagggtgtttgattcatgttaagaagtccagttagaaggaggtctccattgctctggacttctcctatacaatgttattgtcagtactttagatcaaagtcgaaagagttttgtcaccatgaaagacacacatctagaagaaatagcccatagtatcactgacagaatcaagatccaaaataacctgaatatgtcgaaataatgggttcaattaaatgagatgaattctatcaggtttacatgtaagcttctatgacttgagacctataaattcacatatttattgcattgacttattcattattgtgtgtcagacaatggggaaacaggagagacaagatggagccatgacacacatcttgcatgcccttaattggtgaattaatgatgctaagaattgcttgatccaaagctctgtaacagcaggagtggggtctgtcttggtcatccttgtttctctagcacttagcatctactgcaaggtagggtgactgaagtcttggtcaagttattaaaaatttggtaggtagaagtggaagaaaaaatgcctatttataagaggatcaaaaattttcatggtgttttgagaccatgttggcagctggaaaatgcatttaggaaaaacagagtaaattatatcattggctaaaatctttcaatgtcttgacattgcactaaggataaaacggaagccatttgccgtggtttagaaagtcccacataatctgaccctgcctctttctgtgacctcatctctatcatcttgttctctttgaccaccctcctaccacaaagccttctttctgataccgtagcacactaaactcgttcaatcaaaattcattcctgtcttagggcttttgcccctgtggttcttgggcctggacctctttaattccagatcttcgcacggctttgttcaattgggactcacctccatcatcactttttcacggcagccttccaggctggccaatctaaactagttggccttcccgagctatcaagtttattctctgtctccttactcgtctatttctagcacctagaacaatatctggcctgtagtagttacctaataagtatatatgaaataaatgaatctttgaaatcacaagacaggtcatcagagagaaaatattcaagtaaattagtttgagaaaataagtaaaaggcatattagaatgaaagtcatgccaatttataaaagtaaaattaattaattaattcgacttgcattcccttcaccaagaacaacaagatctaccttgaactagtatcacccccatcacaggtcaagcatattttacttccattgttttggctatatataatggttatttaccataaataaaatcatcagtcttgtttatctcactcctaggagcatattcatttgtatgtcagcataatgcatttactgatttctgaatacagataagtttaaagtttaatgactcttggtgtttattatgtatctgaataatagaatttccatttggatttttgagatatagcagaattacagaagctctagcagaaccacataaaactacccagatttagccaacgaatttatctattttcatgtttagataaaaattttttaaatcctagtatggtaaataattttaatataattaagtttacctaattaaaaacatgtgcttggttatatagttctctcttttcagagttgcaaaatcatcagctaaatagtgataatatgttaaatggcattaatatattgttagttacaaattttcctcttactccacattttatgaaaatcagactctcaaccccttctgtttcttggaagtgaattgtctttgaaacatagaaattgcaggcatctaaaattgtaattcatgccctgaaattaaaaagtcttacattagatgatggtttctcaaaaggcttgtagaacttcagagcacttaaacataaacttgagaattgcagtttggtaagggtatttaccaagagcttagagtcccacctaacagacttccagagagttagaaattctcaaaataagaaataatcactacgttgatttccttaaaagtatttgtgtatatctgttttaccacagcctcaccaggtttatgttgtaatccttttgttattattttaactttgtacctcaataactagttcgaatattttcatatgtggttattttctacacgcagtttctttcatgtgaattacttataaacatccttaagttttttttaatgcatttcataattactaaaagagataaaatgctctaaaaggcagaccttctgctttggggaggaggcacagtagtttatgtcttctttatgagctcccagcttgtattacaccattttgtttctaaacaaggaaaaaagttaattaacatcaatgaatatcctgtagatatcctaatatctacaagtaatacctacaagaaaagatagaagttagatcctgcctccaccacaccgtcaccctatcaacttccatagcaagaatttctggggagtagggatggatgtaaacaaaatagaacaacaacgaaaatctccctaaggagcttgaaagcagggatccacagctcaattagctatgaattaaatcttagctatttctggactaatcatatttacctataaagtgtaacattctttatacacatttcaacacctgaataatttaatgtgtgattttcttttatctttcatgaatacatagataaataatgtatggtatattttactcacctaacatcacagaaaatcttcctgtgttctctggctctccacacttcccaacttttggacctttgatctaaatgtgtcagaaaaataccatcgcctttataatctactataatcttaatctcactccaacaaaattcagaagacataatccttttcataggagcacaatgtagatttatgtatatcaatatttaaattattttaattccagggattaaagtataaatgtaaagtgtaactttgacatatgattgtaacagtataaaatctaaatagatttggaactggtgtggctgtcgagttaggtgaccgctgaacctaaatctgaaatgttcactgatttagtcatttatatctgactgtgcaatgcagtggcatggttgactgcagtaaaagaacatgctcatctcagagcttcagaaataataaaatcatacactgaattcaggatacaggagatactgataaagagttcaaaatcataaacccatttttatgctttatcagcgatcacatcatgttatagatacttaaatacttgctacctctcctgatagaaatgaatttgaaagacagggacaaaaatctaattcaaattcaaaaatcaatttgaaagagagggacaaaagtttgtgtttgcagcatcgaccgtcaaccatggagctttatacctactccaggttcagtgaatgtttacagaagaaattgatgaatgatcaatagaatgatttcttcaggcacatgggattttgttctggctgtctgtcccattcactgcgcattatttatatattgcacattgcgtgcgtatgtgcatggtgtatgcgtgtgtttcttgtattttttattgctctcccttgtagaacagaagctcttggcaagtatagtctctgtgggaagcagaataatgccccctgcaaggtatccgtgtttgaattcctggtatctgtgaatgtgaccttacatggcaaaaggggctttgcagatctgataagttaaggatcttgagatggcagattatcctgaattctttgggtggattcagggcaatcacaaggatcctgaaagtcaagagggaggcagaagacagagtgagaatgatgcctcgccaggccccaacttcccactatgagttttgaagatggaggaaggggccacatgaaaggtgtgtgaacatcctctagatgatgaaacaaacaagaagatagattctccctgagaacctccagaaaggaattcagccctgctgacaacctgacttcagcccagcaagccctatgtctgattgtcgggactatgaaataataagtttgtggtgttgtaggccactatgttggtggtaattttttacagcaacaacaggaaactaatacaatctctgacacctttttaatctcctgcagcttctaacacagtgtgttgcacagagtcagatatctcttgtagctgatcgctctcatcacttcctctttattctctcagtgtttaccaccctgcccatgctggaacaggactgcagtggtcaggatttctctatttgcaaatgacagaaatctaacacgaactagcttgagccaatttaaaaaaaaaaaaaaaagaaagaaagaaaaggaggcgcgcacctcgcataagtgagactgacctctgagggatggcattggctttattcccagctgagactagggcccaaatcagcccatgaagactctctgtcaatttgctttgcttttcttctgtattcaggctcctatatttccatgacttgcaagtttttcctggcaaaacttccctctttctttcagggaaggattcttatttgactaacttgtggctagcgtggttgaaaggggctgcagttatctattgacacattaaaaaaacacctcaacacatgttgacttaaaatacaaatatttcttttatttacttatgtttctgaaatttgtgcaaggtatgtcagggacagctcatctctgctccacgtgacaccagcttgaggcagctcaattggagctcaaggattcacttcctggacagcttctcccatgcaagttagtgctgtttgttggctggaagctcagctggggttgctggctggaagactcagttctccttcacatgacctctccacatggctaggttgggcttctcatggtatggcagtcttagagtagtaggactttgtacatagcaactgacttcttcctgagaacaaagtgaaagcttcgagttcttttaaaggcgtagcccaaaactgatacaaggatagtcatgccacattcagttgattacagcagatcacagggccaagctcagatttatgaagaggggactacgtacacaagggcgtgaataccattgtcatggtttacttggggcaccgaactgtgggtttagtctgctatggtggataatgaacctttgtgactaatggtctaaacaggaccatgggaaaatgggagggcaggctcacaaaggaaacagggctgaaaacaaacctccagtatccatggcaaccatttcctagagtgctagaaattattcaataaagcaaagctgtgtttctctttaagtgtatttactacataatttgtacattttctggatttggggaagtaatttaaaacttaggtttaaacttaaagactctcaaacctttttcccattcaacttttcttatattatgaatgaaaacgatggtgatacatagcaaacagtgctctaaaggaattaacttgtgcaggattcatgataaataaagtataatgttactaatccaatggtggttatttgccataacctttttaatgtgacaattctttggcctacatctgcatttttatggtttgcatttattctcaacggtatgaatcccaaattgtcaaattacttaggctgatttgtgataattagctttaagttagaatatttgaaatgcattcaattaattttatctgtttagtgaagtacaatatggattttagcattacaaagttttctttataatattagctatgcatttgttaaaggacatggtggactcaaattactctcatttgaattttatatttagaaaatgagcatgcagtattggggattaggcagtattaagaaaatgtatgtagaaagattatctaggatggaatcaccgaaaatcctggaatatttagcagacacttgttgactgattttacctgcagcaaatatgaggcaataacaactgtgtaaattatttagagactagtcatccatatggggattccttaaaatcatttcagaaaacaatttggcagggtattttctttatacttattttttccaagttcatgtacaaaagagatatagatccacacaaagtggattatcactgattcttttaaaatgaaattaaatattttaaaacattcaagtgacgattgggtgatctttcctagctaaagctttctttggtagtttatttatcttaaatattatttttgtctttcaaagggtattatatagtgaatgtaagagatttattaaaaaccttggattgcttgagagtgctttagaactttgccttaaaatctgcacataggcaaaattcctgatattatgagttgggatttccagtgtaagaggatttcaaatcgctgctgaaaaaagggcttgttacagatttctaagcatcctgtatcagaaaggcccagctacttacacaatcgctgaaactaaaatgggacaggaccagacacatggaatgaaagagaccaatttagaccaagtgaaaggtatcaacttctcttaaaattagccttttattctagagagagatcttacacagctccaaaagcagatagaataatcagtatttacatagttatggatctctttgtatatggagatgggaattattttgtaaagatttccattgtttaaagcagttggagacatagtgttgggaagagcagttatttgggtgtttatagacatgcagttagagaccccaaatacttacttacaagtcacgtgaccttgaagcattcaaaataacctttatttcccctccataataacattttcggatctcagtcctgcactctcttgggattgttctgaagatacagtgagagaataccaaaatactttacacactacaaagcattatgttattaaaatttatattatcactagtaacaataaaaataaaacatgactgggtaactggcctatacatacatgatgcattaaaaaaatccaagcagattggaagtgtcttatttttataaacatgttcactccaaaagtatacaaggtccaaagtagttcatgcatttcccccctattatttttaaagtactaacccttattttattgacttgcagtggacacaaaatctagagagatgactggacgcatttttcctgaatagttggggattatattttattaactgcaacccagaagggtcatggctgtttttaaagagaaatttgcctcctggtatggtttcttgagatgatcagtatccggttttaggaggtttggcaatggtgttgggtgtgtggggctggtgggatatttttgttaatggtttgtttctctgtgtttctctcccagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtacaggacaggctctgtcacatgcccggcttttcctactctgagagcattaaagaataataattatggttttcctatggaacctggggccgattgctcatctcccagacactttcaacaccatgagagaatctttcttgtttgtgacatggcttgactcttggggtgaacacggttctaagatgtgtgcatgagattctgagcacatgaaaatcaaagaggagggagcccaaaactaagaggaagagaggttctagtgccttttaaattttagttgctagattagaattgttgttttatacaaaagatctactatagctgaaagaaatatcctattttcgcgtggtcagcactgtatttcagctttgttactgaaataactttttagagctggattcaaatttgaataagggaagaatcctctaaccatgacccaactgtaatctgtaaggaacataaaaactttaaaatgtcaatgaaattagggaattcaacaagcagctgaacaagtatacttacaaaagagtgaatgaggggagggcaagtgtcaggatcggattatcacaatgtttgaggctgaattcaaagccccatgaaggctgtgaaatgaaaaatagaagagatggagatttaacctcatcttctatacattttagatctatgatccttgccctacataggaaattgacatatggaatattccctctcaccaaagacctttctggaacactacagataatctctttatgtccttttgcaggtaggaaaattagtaagaacaaatatttaatcacagaatctgacaaacagaagtttattttaatgaacactagtttactgcattttgactaagactcaacatgaaactaatttgtgatattaatgatagctatctcttttagttcaaaacacaaatgacaacgctctctttatacttaggagaggttgaatcatcagggttaattgcagaagcccaatgtataaaactgaagatgtgtttattacttatgcaattttgctgcaagaataaaaatataatgtttcttatttattcattgatctttttggtatactttcatctctccagtgcccatgctggtgtacgaaaccaaaggcaaaggaaatggttgtaaaatgcaaaaacaaatcatcaaataccattaattctacggcatcttaattttgtccgtagacttttttaaatgtaggaaagggtagggtttttctttcttcctgttctaacaggcagagaggagagttgtcagtcagagacaaagaagcttcacactggatgcagaagtcctggctgacaagagacttttgctacatggaaagtaatgatcacctgaatgatggtttaatctgcccatgtctcacttcattctggagatgcagaacatttacataatcttgtagatcagacggacatgtaagccattcattttgcaagccattcatttctagtgttacaaagtcttagcactgcagagaaagcctttctctgctccttcattattggttttttttttcttttttcctctaggcttaatgttatttttaggtaattcaagagaaacataccaactccttatgctgtaaggggaaaaaaaaaatccatgataattaaattaaaaactttgctgtaattaaggagctgcttccaaagccagtagccattgaaaataaaaatgtattttgtagtagtccttttatatatttactcaatttctttctcaggccaaaactgattcataaatgaacatagctgctctgaaagtttagtgctgaacatttgggacttgttttagatcgaaaagaatcccattcttcagatgaatcgataaagtgttattttcattcaaatccagaaactaaggttttcctgtgttgcattctttcttatcctgaaattttcctctcagatggttgagtgatttgttcaggtatctaaggtggtcaccagaaacacctgagcactcccctgaaccgagctcccttgccccaagcagcaattgtttggaccacccatctgatgcgactccaaggaagtatatttgccgactcttgaaatgaatatttccataccgtgatgaaaaatatcactttctgggaaatggagctcagtttcatggacttagtccagatgctaattatgcacatttatttttaggaaatttgaaaggatccattttttttttctttttttcctctctcaattttttgttttttgtttttttgctccttggtgattattataatactcaaaaaactttccaatgttgtttttcttatattaattaaaaataactcatttacatgtaataaaatatcatggctgtttactacaaaacagtgggctaatgacctttcagacctttttacaaagaaaaagggtccagaagccaatgcttatttttaaagggaagcctgctattagtacttagcatattatgtgcaggcagcatcgcagtgttctaatttaggctatcaataaactctcattccccaaatagcatttgacccagtggttctgagttgcttttatgaaaatttggtcaactggtgaatcaaaaatcagtcgcaatcctaatcaacagaaatattaactattcctcaggagtatcatgagcattattgcaatttcctgataccaggaacattattgattatggataaatgtgtaattagaattttaaaacacacattataaagcctttcttttatgttttcagttttttaatcaaatagaaaacaaggtttaataatcagaagagcagacatcaaggttttcagaattaaagactctgagtaatatttatatttgaggatgtgaacactggtggattctgggaggaacactttctagggtacattcttggggttaattttagattttacacactgaaacaaagttatggccattattggccacccttatcatctctataaagattggtttatgttttctctgttctcaattgtttactatgaatttttttactgctacagagaagtaccatggaaatgcacccaccagttttcctatatgaatactcacttatgtctttgacagttcatccttcttaccttagcctgtatactacattatatttcagaatttcttctcttctcctgactctaaccaaattataatatcaatgatcagatcatgtgtgtgtttgtgtgtgtgtgtgtgtatatatatatatatatatatatatatatatatatatatatgtatgtataatgcatatgaatgcgtttacatatgcagtaccactaaggaaaatacaatgagctttgcacaagtgttaatctaaaagcactactccatgcatgctgttccaagcatacaaactcagaaaattacataaacactcccacttaacaagcacacttgatttcatcgaagctatatgagaatcattgtattatgcagctatatacacagtcaatattgcgttacaattagccaaagaaagaaaagggttaaaaagctactggttagtttgagaaatgttcttttttagttttcttgttcctggcctagtctcaagctagcacgtgatcggctgaatgcctgccagcctctttcttgttgatcctccggagaccatctgtactgggggcattgattagagtgtgtctgctgggattacatcttttctgttgccatgccaactaatcagctgattttggttaccacagaaacaaaatgtcagagctcacagtacggtaacatgaattcagcacaacagaaaatgttttcttaattggggacccttttgattttggattccaagtgaaaggcagctttaaaaaaaaaaaaggccgacttcagataaaagctacattaattgtattgattaagaggaatgcacagaatttttctgaagagagaagatgttaattcccttttataggctatgcctgtttttttaccatttctgaataggaaatacatatatattttttcttatttgcctccattccatttgctggctgttgcatgtaaaacaaatcacaaagcctttggtttcctttaatttctatgctgggtacagggtgtggagtggctgtctagggcctggaagctgtgggtgtaattacttggggaagaccagcagtgaccaaaatcctcctctgtcctttcattcaaataagtcatttatttttccttaaagaaaacatccagcgtagtcaactcagatttgattctaaggattcctgccttgcacatggtataccccagttaaacccttggttttgactgaaactaggaggagcccaaggcctgctgcaattttccatttgtaggcccatgacaatttgactgcaagaaaggtccccaactagctcgctctgttaccgtgaacaaaggacacaatttaagttgaccttacagatgctccaactgagtaatctgtcagaggactacatacatgccttctcattatgaaattctctcccaatagaagtaaaccagacccttcacctgccctgcgtttgtggttcataaatgcaaaacaaatatattagataattttttaaacactgacatttaactaagctaatatttgtttaaatatccaataatctccccctttaaaaaggattatagcatccaaaatccctgtcgtgtttttgtcaagacacttcactgttgatggctccccatagctacctctcttttgtgaaagctgtcaccacaggtggcttctgtcatgccgacaccccagggggaattgtgtggcttaatctccatgcaactctttttaatgtcttcgtaaattaattccaaagttgatgatgctcaaggggagaggtttgggggaactgaagtcttctcccttttctatgcgctcaactctcatggctgagacaccagaaacaaggcactgaagactacacagccaaggggttttgaggcaatgtgcccacatgcctgaaattacccacaggtcctgctaattggatctgaggcaaaggtcttcacccagattatcaataattatcccacagtgtttctgaaatctttgataagacgaagatggcacacgttaacagcatctttctcgagtagtgtcccatcaacacttgttagtaattctcctgtactggcatttgacttgcttaaagaacatgttaccttcagttagagcgcatggaatgcacccaacccagtgctgtggaccaagttgcaattcagtaagtggtggtgttttgtgttacatttccaaagaggaaagtgattattaatatttcgtaaaaggctgatataaattgttcactaacttcgtggactatagttttacaaatacttacattctctcttcagttaattaatttttacttattcatttatttgtttttgagtgtgttttttcaagtgtctggagtgttgtatgtttgtttttagcctaggaaatctttctccaaaaagcttgatcggaagcccaatgcagtaaaaaacagacaaaaatcaaagctgcttagtgaaatccagaaagtcaatgaggatctcaaagccgagatggaggcccagctcctcccagcagagcccctgagaagccgccgctagtgaagccctaggtctcaggtggcacatgatgaccattactggtctagcgctttgtgttttcttgggtagcattctttttatctgtagcgctatcatttactgctatcctactacatgccaggcacaattccaggtagcctacgtacataactttatttaatgaattttcctaacattcttacccaaggatatttctatttccattttacagtgagaaaaactggaatttggggaatttattagattttccccaaatttccagaatgagtaaaaagtagaattgggattcaaatccagtaccctctgatgccaaagtatccgcccgctattttgtactgctttcctaaggcagaaatcgtctgattaatgagttgtaactatttaaattgaaccaatacactaccaccacttcctagctcatagttgaaataggctcagcggttcgtgattgcatagcactttccttcatttcaaagttgttaatagtgaaaggaatggtaaataaaataggaactacatgctaaaaatgctatgaatatcaaaaaaagattaaaatgctactctgtcactgattactctatcaaggaagagaccttcaaaattctattatgtttcattaataatatatattattcttagaaagataaagtgtcccatccccctaagactggccttttatgcaagcagaatttatcattgctgatgtgctgagattcaaggaaaatactctccaccatgcttctattttctacatgtcagtaactgataataactgccttgggttaaacattgccctccggaatttcgttttggaaataaaaacttcctccagtcagatcaagttgtagtaactcacacttaaccatgaatgagtttattgggtactttgtcctagagcaggataaccaagattagaataagagctcaagcctctatggttgaaggatgatgaaagtggaggaaaactttttgacccaatgtcactataagatgggttttatctccatatttacagatgaagaaactgagggtcatagagtttcagtagtaactagtagaattactagcacatcatggccaataagcagctgtacagtcacttgaacccactgattttagagctgacatttgtaccgtgtgcagtggacacatcactcgtgtcacatctttaccaagagctagcactgcccaaggacagaaagggagaccacgctgagtggctatgtgagttacaaaatgtggctttcacaaagtgcgtaatgaatgactgtgtggtttgtcacttccaggtatgtacagaaggcagactgatcttggagttcacctttgatgatctcatgagaatcaaaacatggcactttaccattagacaataccgagagttagtcccgagaagcatcctagccatgcatgtaagtaatttaatttctgttttgctttcttttcttttttttcctccttcatttcactcaaggggaaaaacccagtcctctctctgtgaaagaattccagtagttgtcacgctttaggtaattaactctaaatattgagttttgttctcaacggttttaatccacaggcccttttctcccctttttgtttccaagattggtacattgtgagactattttttatattttattattttgaactccaaattgaggttacttcaataaacagtttgtacttttcttaaattccatccagtcattatcaagtactgctctgcttggggctaataaacctgttatgtataactggggaatgaaataaaacaagaagttagaaaaacagtttccagttttgattagaaccatctgacgagacatgggactcctctatcttcagatttgtgtcagaagttggtcctccctgatcacagtgctaaatctgaagtggaatatttgggcttctcttggttttgtttgaccataaatcacatcaaatttattgagcacaaattaggtgcaagggtgggttctatgccgatctagagatgtattttaaatgtaagtaggagctagtcagctgtaatctcttaagaagtcgtcaaaggcatcaacttaaatttaagtctctcctctataatacatgatgcttccatgaaaatctttggagcaaaatcaaacttcataagcctaattttaaagaccctgaacaatcaaaagaaaatagcataacagtaactaccatttactgatttttttttactctgccaggccttgagctaaacattttgtatatctcatgatattgaatcctcacagtcaggcagagagttgagttagtattgttcctgttttaaaagcaaggaaactgatgttcagagaatcagtaagttgccccatgttttttagcccaaaagtagcaaaatcaagattttgcccgaggtggttctgactttgtctcccagctgtcccactcctggctatttctccacgcattagttgtcagccacctctttctgactagttaacacaagctctgcccttcccattagccttatgctttttgttgcacccccactctcctgctccatgatttctggctgtttatgctccaagcccttggtttttaaagcttagtttacattctccactctctttgaggaagtctggaatattcacttctattattctcaaaatagactaaaaggcagcaaaggataacagttgggaacctgggccctggattgagaccacatagggttggacccttgctcttgtgtgactttgggcaaatgatgtgacatctctgtgcttgtagtccctcatctataagatgggtacagtaataaagcatgtttcagaccatcgaattaagagttaatgactgtaaagcacttagaacaatgcctggcacatagtgtgtcctctacaggttttggcgattggctctcatcatcatcaccggtagccacagcagcaggaacaacatttttgcatttctttattattatctttcctgtcttttgactgaaatgtaagttccttgaggttgaccctggctacttgatagaacaaacgcttcctagcacataagagtggtttaataaatataggctcaatgtcagggaagacctcttttaggaaattgacatgaaactgacatgctctgttttctcctgcattttttatttatatatacaaatccaattggtagtatcactatgagaaaaggcatgtacagaaaagaataagtcacattagtataatctagtctcatgaaggcagacgtggagacaaggggatgtttacatccatctccctctgtttagtgccaatttgcttatatcaattaaggaagaaggaaaggcaaacagaaagaaagaatatcaaccaagagagtcattttaaaatggatcccagaaagaatttccattttcttctagccaaacagaacatttggtgtggcccatggtactttatatcccttcttaaaatgtggctgacattttggaaaatgtgatacttactcttacagtcctgcaggataaaaattgttggggatatctatttccagactcagcttaatggggaggagagtgagaattctgtctctccatatatatgtgtgtgtgtgtgtgtgtgtgttttgtgtgtgtgtgtgtgtgtgtgtgtgtgtgtgtgtgtgtatttcaagacagtggcaaagttttccaatacagccctcaaccccaagctgtaaaaacaccaccgctatcacagcaggaaacaaaggccagtcctgaagcatggatctgcccagtccagggggactggcttctctaatgagggcgttagacctggagctctcctggcagagttctgtgactcaggctggagacccgagtgccaaggcctctccaagaggaagtaacatcatttctcccaaggactgaaagcacatctgagcagtttggtttttccccagtcttgcacaattgatctgaaaatgtccttgagtgttatatgcaagtgtcttcaaaatgtaaattaaattacctccagcagcctgccctccaaataaaatcaacaatgtcgagattgcatttcttagcagctgtagcacagtctgagattttctcaggaccgtcctgtagtgataaaatacatgtggggttttttttccatttaggcacaagatcctcaggtcctggatcagctgtccaaaaacatcaccaggatggggctaacaaacttcaccctcaactacctcagggtaagatcaatcgaatgattttattttttggtgagtttgaaaagtactccagaggtttatatgcatcctgaaccaagaagttaaaatgaggtactggtgatatagcagtgtctatgttctgtaccagatgtatgtgtgtgtgtgtgtgttttcaatggaggacagggtttaattaacaaagcatcaaacctggaatttgtcagggttgagtcctatatctgtatgtctcttggaattaattattcaaaggctagcaatgtcccattgttgcaaaatgctttgtggctgcttcccttgtggttgtctcaagttcaaatgggttattggtgagttcattaccccagtgcctccacccaggcactggtcaccccttaggagaatcaatatactgccccatagagtctcctgaagaaatccaatcccgtgctgaaacacagatatttctaaggcttcataagcactctctgcacaacatgtaacagatttggtggtgggtaaaagaaggagattcttcctctctacagcttagattccccagagccaaatccaggcctgacaagaggcagaatcagctgtgctccccacccgcccatcctaacacccctgccattgtggtggccctgaaccactaaagagcccactggtctctgctcagagggaaaccaaagtcagcccaggagtgtgggtggacggcgggtgctcccagccagggtagctggggctacatcttcacaaacctctggtctccgcagtcagaatggctctcttgcggagcaactgacatagtgcgggtgggtggcctggggcgtgatggtctatgaagttgttctctccacaatccagaaggctgctctgtactgctgggcatatcgtcttgtcagggaacaggagagttttcgcttaaaacagggaagatgctcttcctcctgcagataaagaagtcccacactgtgtgtcctcagctgaccccacataggaagctgggactttgaagtctatcctagacttggtcactcaccctatagcaagatcttggacagattcttagttacatcttttagctgcatttaacacagattaataaacatcaaatttccttcctgcttctccccactcctcttattgtcatctgtaaatggttgactttcaccttgtggtcaaggcccaccaggtaccccacatcctgtggcccatgaagactgaggtcagacctgtaaaagggaaagaaggcactacccgtctcctgacaatgatagcaaggaaatcatgtatgggtttgggcagtagggagtagtgtttcgaggttaccacacgaacaccgtgcttgctgcatgtcaggttctttgccatgtatcttgtgactgaagtagtctcataatggaccctgtgccccattaccatccctgtagcaaagtgaggcaccgagggtttcagtaggtggagtaagttgcccagctttacacacaagtggcagaactgggacttgaactcaggcagcctgacccaagaatccatgcgcttcactgcagaatgctgctctcttgctagtgagcacgggagactgatgatatggataggaattgggtcatatctttcttgcctttgctagacagtcagcatctatcagtaagccttcattcactttgccaaaaataatatcagctccttgtagggtttagttccaggactgggtcagaaaatccatgtaaagggcttagcacagggcctggggacagaaagtgcctcatttgtgttcagtctcatcatgtattgagaccttctgtgtacccatcattgtttgatgtgctggagccacgtagagaaacacagcgccgactctctactctcactctgggggtgtctaatgctactttatttcctgacttgtgcgtcgtgattcagtagctatttaccttccctgccttcgttccattctttttcactcactcattactcctggcagttttccagttgctgggcttcatggtggagcaatggcctctgtcctcagttggtagtcacaggctggtgggatgtggtcagctgtggttccagcgaagcgtgctgaaatagagggagatgcaaagccagagatagcccagggaatgatcctcaggtcttaaggagcagctcagtgtagaagccatgcctcctagtcacaaatccttcgggctgacgtgggccgcttgacaggtcatggctgagcggatctcaaactcattgcccaaaagcagtgaacatgggcttccgtgtggttatccatatggggtaggtcactgagaatgacagacaaaggtcatttcttccatttagaactgggatttaagattcttctagtagccttatcatctaatttttttaagacagcggagcagtcacaaaatacattcatgtataaagttgccttaagatctgaagcctccacgtccatctgaggagcctggcctttgtctcaagccccagaaggtcaactgaagtattgtgcaaataaggtaacaagaagcttcaatgccactcccagtatcagaaaaagaggtcagatggatactttggtaaatatgaatccaaagccttctatgcagttgaagaactttaaaaactgatgcgtcctgttttggaaaggatggatagagattttaaaggctccagccattgaaatttcaatatgcagtgtctaacgtaacaaaattaagcagagcagaaagtaggcaattacagccatctagcttcgtcaaaacaagttcatttattccaatgaaattctaatcattctcacggagacctgcagtcaggaaatacacagagctgaccgaaggcagctctcaccgttggagggaggagcaggcgagaccctgaggatggccgagctgtggacattgtgaatgcagatgatggggctgaacacagacgctggccagcagcactttggagggggctctggtgacctggtgcttttgaagcaacaacaagaacaactattgtcatttgatttgggttatcaaatcacctgctgttccctcttgtcgttccctcctgtcgcatcccagcatgacaaggttagaggtgccccgagctaagaggtacgatgatggctgacttggtggtcccagtggagctgtggctggaagccgctgagcctgcagagatggcgccctgtcacagtgcggtctcacttcctctacaggctgcctctgtgacctctagagggggctgtggcttgctgactgagtgtccctgcagcagttatccaagccagagctgggaagggacctgcaggatggggaagtcattattttgttgctgttgggtattccgataccgggtggtgggtttcacgaagcatgtcctcagtgttctggggaaaactgttccatgacatggggagatggcacctttcagtaagcagcactctctggtgctggaacttgagcactagaatgggagaagcaagccaggaactcggaaatgtgtcctttgccttgtttgttgggaagcagaagtcctgttgtccgcctggcattttatgaagggatccaattcagcaaccatgagaaggcagtgcagtttagtgcgcattgggccatccgggtcaatgagacctggctgtggagccttgtcagttcccaccagatcctgtttgcccatttattcattgttcatttcacaagcatttctgacacactttctttgtgccaggtttatgccctcaaggtgatcactgcctagaatgtaagaaagaaaaacaaatacactcttggagagaaattgctcccaggtgcagtgagaaacatagcactagctaacatttctggggcacttactatgtgccaggcattgctgctatatgctttgcagggacttactttcttttccttccttccttccttccttccttccttccttccttccttccttccttcccttccttcccttccttcccttccttccttccttctttcttttatttccctccctcccttcctttctttctttctttcttctttccttcgtctttcttttttttttctttaaatactcacagcatccatatggggtaagaactatttttagtcctattttgcaggagagaaaactgaggcacagagaagtaacttcccaaggtcacagaactggtaagtggcagttcagggatctggacccatgatctgattccaggcacaaaagacagagaggttgttagaagacaggagaaggaggctgcaaagtcttcatagagaagatggcccttggattgattctaaaagttgagtaggtgatcatcaggcagacaaggcagaggacagtccaaagagagggtcactgtgagaggggtcagagaaggatggagagtgttagtgacttggggagctctaggaagtttcacatagttaaaatataagtttcaagtttgttttaggtaccaacaaaagtaggtgttttgagccaaaacaatacaccctggctgagtgatataattcaaaagattttttttttccagtaacagcatggtcaagacaagcatcctctcactgtgacatgggcttgggagtaagttaaacagtatgtatctgagaacatcatcttcttactagctgtgtgaccctgggcaagttgcttgacctctctgagccttcattttctcatctgtgaaatgggctacgccatctctctcgctaggttctagtaggataaatgcacgcagagctttcattactcattcaccaaagtacctttgtaaatgcttctggtcctcttttctgggtagagcacatcagaatctttcattgaattcccctgtatgcagagctcatgagaaggactccatgggtcaaaacacacgggagttgatccttctcccttaattcttcgctttcatttcatcaaaatgaaagcttcttctaactcagtttgaaattgccatcatttcaaatttctaatatgaaattcttgcatgtgaatgtttactgtatgcaacaaccatgttttctttaaatagctttaaagaataagattttaaaattggagaagtaattgatgtctattttatctccaacaatataaagaaaagaggggtggacaatgcagaaatcatatccttacacatttaaagcaagctgccacaaacttccaggctggcattgagtaaaatgtgccattttcatgttcatttatctcctgtaacaatagagtaggcattccttgcattcactgaacagaatgcaagaaacagtaggaatggcattgctttatacagttgtctacatctctgatgatttggggtagtctgctttcattcataaatttcacatcaattagctaaccaagaatttggtggcatctacttactatattttagtcacaaaaaggatggagtgggatgtttacaagaatgcctaaggcacattctcttttttaaaggaatttaagatactgttacaagtaagtctgcttccagttcatattgtcagtctcatctggggacttcaggtcattccagaatttttatcctctcctaattttcctaaggatatcatgatcctctcagtctcagcagggggcttaaatttgacttgtttacttgtttacttaaatttgacctgaatttttcagtgtattaatcaattgctctgcttcaccacaccttctttcatttgtacacaaagccctctgtgatcctgcctctgctgcctcccagcctcattccatgccccttccccagctagtactccatcctggaccacacgaaccacctacagttaatccaaattggtcatgctctcttgcctccatgcctttgcacagcatgactcactgccactgcctggaacgctgttgctacccttctctcatcatccaattttcccaggctaaatcctcctcatccttcaggattccttcatctatcaactcctgtgagaatatctctctgactctcagctggggtaggagcctctccccagtgctctgggagttctgtgcacagtctcaggattaactcttggcaggtcccatataagaattgtctccccactcgtttgtctcctgaactagactctgagcaatgtgaagacacgtaagtacccagtagatatctcttgagtgtatgcttggcagatggatggtttggtaaatggaaggcaaaatttcaaatgacaacaataagaaccacacaaataaaactcagttgaattcatttgccctacagcatctagaaaaaaacatgtgattcatttctaaaatcactacctagaacttcaccatgaaatctgaggaacaaaagagttgaatgcattgagaaaataaaaggcaacatggtatgaggccctcacatctctctagggtgcagattcccacttaaatactcagagctcccgatgttaaatttttattctaatattatttcttctacttgctctaaatcagtatttaatccttactctaaatgtcattatggtattttcattatactggaaatgcgttcttctaaatattgaaaacagattttttaatgaatgattatctttttctatttcctttggccacattttcttaatgctaggttacaaatgcttcttttgtgttttgttaaaattttaaaattttcagggtacatagtaggtgtatatatttataagttacatgaggtattttgatacaggcatgtaatgcatcataatcacatcaaggtaaatacggtatccatcacctcaagcatttatcttttgtgtttcaaacaatccatattcttttaattattttaaaaagaacaattaaattatttttttactgtagtcaccctgttgtgctagatttttaaaattctttctaactctgtttgggcaccaattaaccatcctccttttccgccaccctgacccttcccaatctgtggtgaccatccccactctctatctccagttcatttgttttaatttttagctcccacagataaatgagaacatgcaatatctgtctttctgtgcctggcttatttcacttaatataatgaccttcagttccatccattttgttgtaaatgacagaatctcatcttttatatgactgaatagtactccattgtgtatatgtgccatattttctttattcatttgtctgttgacagttaagttgctccaaaatcttggctattgttaatagtgctgcaataaacacaggagtgcagctatctctttgacatactgatttcctttcttttgggtacttaggaatggagttggattgctggattatactatatttagttttttgaagaacctccaaactattctccatagtggttgcactaatttacattcctacctatagtgtgcaaaagttccctttctccacatcctcaccagcatttgttattgactgtcttttggctaaaaaccattttgactgggatgagatgatatttcattatagttttgatttgcatttctctgatgatcagtgatgttgagcaccttttcatatacctgtttgccatttgtatgtctctttttgtgaaatgtctattaagatcttttgcctatttttaatcagattatcagatcttttcctgtagagttttttgatcttctcgtgtattatggttattaattccttgtcaaatgggtagcttgcaactattttctcccactctgtggattgtctcttcactttgttgattgtttcctttgctgtgcagaaagtttttaacttgatgtgacctcttttgtccatttttggggtgcctgtggggtattggtcaagaagtctttgctcagtccaaagtcgtggagagtttccccattgttttcttttagtagtttcatagtttgagagcttaaatttaattttataatccatttttatttgatttttgtatatggtgagaaataggggtctaatttcattcttctgcatatggatatccagttttcccagtactatgtattgaataggctgtactttcctgaatgtatgttcttggaactttttttgaaaatgagtttactgtagactatggatttatttgtatgttctctattctgttccactggtttatgtctctgtttttatgacagtaccatgctgttttagttactatatctctgtagtgtaagtcagataatgtgattcctcctgttttgctccttttgttcaggataactttggctattctgggtgttttgtggttccatataaattttaggattgttttctgtgtttttgtgaagaatgtcattggtattttgatagggattgcattaaatctatagattgctttgggtagtatggacattgtaacaatattgattctttcaatcagtgaaaatggaatatctttccatttttgtatatcctcttcaatttctttcgtcaatacattgtagttttcattttagagatctttcacttacttggttaattcctaggtattttatttaatttgtagctattgtaattgggattactttcttggtttccttttcagtttgttcactgttggcatagaaaagtgggactgacttttatattgattttgtattgcgcaactttactgaatttgtttatcagttctaatagttttttggtggagtctttaagtttttccaaatataagatgttattgacaaacaaggataatttgacttttttctttccagtttggatgccctttatttctttctcttgtttgattactctagctaggacttcccgtactatgttgaataacagtgataatagtgggcatccttgtcatgttccatatcttaaagaaaagactaaaacttttccccattcagtatgataccagctgtaggtctgtcatgtatggattttattatgtggaagcatgttcctccatacccagtattttagggtttttgttataaagagatgttgagttttatcaaatgctttttcagcatcaattgaaatgatcgtatggctttcgtccttcattctgttgatatgatgtatcatattgattgatttgcatacgttgaactattcttgcatccctgagataactaccacttggtcatgacaaatgatctttttaatgtgctgttgagtttggcttgatagtattttattgaggatttttgcatcaatatttatcagtgatattggcctgtagttttctctttttatgatgtgtctttgtctggttttgggatcagggtaatactggcctctgagaatgagtttgaaagtagtccctcctcctctatttgttggaatagtttcagtaggattggtattaattctttaaatgtttggtaaaattcagcagtaaagccaccagctcctgggcttttctttgctgaaagcctttttattatagcttcaatcttgttactcattgttgaggtgttcaggttttggatttcttcatgtttcaatcttggtaggttgcctgtgtctgggaatttgtccctttcttctagattttccaatttattggcatacttgctcatagtagctattaaggaccttttaaatttctgtagtattagttgtaatgtctcctttttcaactatgattttatttatttggttctactgtcttttttttttaaaatctggctcaaggtttttctaatttgtttaacttttcaaaaaaaccaaccttcatttccttcatcttttgcattgttttcttcattttaatttcattgattcctgctctgatctttgttatttcttctagaaattttggatttggtttgctctcgtttttctagtactttaagatgcattgttaggttgtttatttgaagttgttcttcgttgatgtgggcactttcaggtataaacttccctcttagtactgcttttgttgtatccataggttttgtatgttatgtttctattatcatttgttttaaaagatgtttctggctcacgcctgtaatctcagcactttgggaggccgaagcaggtggaaatcacgaggtcaagagttcaagaccagcctgtccaagatggtgaaaccccatctctatttaaaaaaatacaaaatatagccaggcgtgatggcaggtgcctgtaatcccagctacttgggagactgaggcagagaattgcttgaacccaggaggcggaggttgcagtgagctgagattgtgccgctgcattccagcctaggcaacagagcgagactccgtctcaaaaaaataaaaagtttcaatttccttcttaattccctcattgatccactggtcattcaggagcatatcgtctcattttcatgtatttgtatagtttccaaaattcctcttgtgattgatttccagttttattccactgtggtcagaaaaggtgcttcatattatttcaatttttttgaatgttttaatacttgttttgtgacctaacgtatggccaatccttgagaatcatccatgtgccaaggaaaagaatgtgcattctacagcctttggatggaatggtctgtaaatatctattaggtccatttggtctctagtgcagattaagttcaatgtttccttactgactctctgtctggaagagtggtccaatgctgaaagtggggtgttattttttttaagcattatgttttacatgactttaaaacatcttatcctgtatctcagccaaaagatattttctttgtgtgttctcttcctctttatccattcagatgcataatttctgcacaaatgcaatcaggttacgtacaatttcttaatgttatttagtaaacacttgcatgtttctgcatagtcatcattaaccataaaatagctacaaatatgcctgtgtggtgctatgatgtgtttaatcatttctctaatgttgagcgaggaagtcatgttcaaattgttggtgtcattaataccactcccctaaacacctttgtcatgtcctgctcttaacaatgttttctgcaagtagaaggctgaatggcagaggcattaataataggaataataataagaagaagacaaataaatgtgttttggagtcagcaaaatgtaggttcaaatcctaatgcttccccttactaccgacaataaccttgaacaagtttcctaagctccccgaatccaatttttttcatctgaaacttggaaagaataatatgtctcaaaagtttggcatgaagattagatggaccacagtttgaaagagcctggcaaacagaagaagcataataaatgccagtctcctcctgtactttctgagtgcagcagatcaggactcaacttgtactgctgccatttattttttacattatattgatcaagttgccttaatttctcagcaccccagttctctcatgtgtgaataattatgtccattctgaatcacagtaactacaggttgagggtgaaaataataatgcatgtgacaagcacttcctaaactgtaaattactactccaggaagccaagtccatacattggttgcggctttgaattctatgctgagattctgatgctgcaggcaagatcagaaagaagagaaggagtgactgattgatgatgtctgccaagaagtgtggcctgagggagctggaacatgtgcctgtatttggcacctctccccagtacaagtgttatcacatatgtataatcattatcattgggatatttttgatactatctataggctatttgttgttgttattgttaagtaagtctaaatcttcaaataagctgtatcatcaactgagtgtgagagcatttagatttcacagtagtggtttttgatcctgtgcctttaatttcccaagtgaatgaagattttcgttgttgttattgttatactttaaagaacattggtccctgcatgtagcctccgctgatagcaacaggagtatagtccagtgcctaaaagaattgggcaattcgctttggaaaatgacctccatcagaatgacataaagtggcctgcagcagaatgagtgtggctgaagtcagcatttggaatccggccgaggttttttgtttcttatttttgtgaggttttgactcccagccagggtacttcccttggttacatgacaggagaaggcattacaattcaacccccttttccacctaaatggcaagccaagcctgaggatgaaacaggaatccctgctcagagactgagatgacccgtagttactggtagtcacagtaggctggaatccaggtataccattcaccattcatgcattctgacagagccgcaagaaaccctcattaagccctgacgttctgaggaggcagaagccacaccagaaaatctcctatgcctcactcaatgcccaggatactataaatcctcaaaagacttaagcataaaagctgctattcaaagtgtggcccatgggtcactgctggcttttaaactgtctggtaccaatctgtcatgagttcagaaaatgagaataagaactttaagactactataactgttcggcattgtcaggtagactgatagtgcatgaccagtggactcatctcattgactgggagtgcatgactcatctcattgactgggatatagaccaattcaaggtttatcgagctcatatggcaagtggccactagtctaaggctggaggagcacgtgtcacaggcagtttggaaaggaccagcattgagctctgtaacatgagtctgattcagaaaccagctccgttgtccccaaggacccaccagaataacaattatcataataccattagttccctctatatatatattaggaactatatgcacctaatggaatgataagtatcattatccccatttttacacatacaaatccatcaatgcctaaggccacaaagccgatcccgcagcaacgttttcctgggctcaggcctggcttgttcttagaagctgctacaccactccaccgtggggttgagaactggaaccctggcatgggcccataaaggagagacagtgctttagagaaggtgaggattcggcctctgaaacaaagctgtcagatctcagtcttacttttcccttcctcctccttcaccttctcctcctcctccttcttttcccctccgcctcctctttcttggagaaaggccccatctgagaggaggcagagaaagccctttggagccatgggaatgcggcacacagagaatgattaaaacttggaacacccgaagggcacttttaattgcatttggagatagaaaagtagtacatatgactacatgataagggaattaatgcagttaactcttaaagaagtgaataaccataagttacagacaggtcagtgtctagaaatcagtgatttctgaagtcaggccaaagaaaatgactatcagcacattaaaaaaaatacacacacacacatatatatacaaaacaacaaatacatatatatacaaaataaacaaaaacagtatttcagcagagcaattctaactgaaaacaatttcagagctacagatgccgccaaaatttttggccttaagtgtacaaatagggcctagattaaagaaagtaatttcccagtctcaggcactagagaaagagaaagaaattgtttaacaagacactgaaagtcaagacagacggtaaggtgggaaattggcagtcagtctaagggaaagccgagggattgcaagttaagtgcagatggagctcagatctgttgctcccaggaaacagtcttcccaattgtctagaatggttaaaaaacaaaaacaaaaaaaacagtatatcaggaaaatggggagggcaaagcatgaagggagttgtttgaatttatttttgatttaaggcataggcagggaagtagcctgaaatcagaaaaggaactggcgggcttcactgcttagtgaactcagtcaacacccttctctgtggctggtctctgatcactcttccactttgcccaggtaccatcttgctgaatacagaaaactcaagttctttaaagacagcaactattactgtagattctatggcctcatcgtctgtccctagcagagtttaaggcacactataggtggtaataaacaaatatgtgaaagagaagaaggcatatgaacctaatgtccctggtcttgatctagataatgaatttgggaacagctataagtgtttaccataattaagagaaaacaaatataatttaaaaagtgtccaccacatacctctcaatggagaagaaagggcagtgaactagtatcttggagtcctaccagggcaaggcacaaagttggcttcatttaatcctaaatagacatttgagagggaggtgttaatggcctagttttacagaaaaagaaactgaggctcagaaaggtcctgggactcatctaacttcatgcagaaggtaaaccgccaggctgggattacatcccatgttgacctagtgccttcctcactatcatgctgcaaaaatgttacctcctaagagatctggatcaaagacctggattgaagtcatttctactgagatgaccaggcttttttttttttgccgaattgcccacagatgcaatggatcgagaacaccaaaaactactcagggcttaagcataatgggatcaaaaaccctcctggactcattccacgataactcccatccctgttgatctgagacttcaaaatcccaggtttcaaggccaccctttatcacccaggctcttatccctatgctaatgtcagcacatatatttaaaaaatgtagatcaagctgtgtcactcctcgaaggagaaccttaaaaccattcatttgctgaaaatcatctggtgacagcccactgcactccaaatgaaatccaaaatacttagcttggcctgcaagaccttacgggatctagcctctccaacttcatctccttgaagctccagtgctccctgcccccaacttctggcctgatttttgcttttccaacataccaagtttcttatcatgccagggactttgtacttgctgcatcaggatccttaactagctgtagagccttgggcagttgcctaccatttctgtgcctcaatttcctcaccaataaaacagggataataatagcctcttatctcaatgagtaattgagagcattaaataaaatagtaccagaaaagtgttcacgataaagctggcacatagtaagcatacaataaatatttgctattttatgattatcatcgtcatcatcatcatcccactgcctggaatactctaaccaaattttttttatgactggctccctattattcagattgcaagacaaatgtgacttcctccaagaagtctctcctgattagcttatcttaggcaacctttctaccttagttattttctctcacacctcatcatttgttttgttttttgtagtatttttcatcagttgaattatcttacataatcatcagtttacccttctgttgtttctctgcctcccgtggctatcactgagatgtaaacttttttttttttttttttttttttttttttttttttttttttgagacagagtcttgctctgtctcccaggctggagtgtggtggcgccatctcggctcactgcaagctccgcctcccaggttcacaccattctcctgcctcagcctccccagtagctggaactacaggtgcccgccaccacacccagctaattttttgtatttttagtagagatggggtttcaccgtgttagccagggtggtctcgatctcctgacctcgtgatccgcccacctcagcctcccaaagtgctgggattacaggcatgagtcactgtgtccagccgatgtaaactttttgaaagcaggcattgtgtttctttttccccaatgcctaaaacaaggacctgatatgcagtgaatagagagggtcaatcattttaattctactcaacttgagatgtgctccttgaaaagtcagagtgttaaaaagcaaacactttgggtgaatacttgagagcacttctgcgaaggctgttaactgtccttgacatcatggactgaatgcctgcagcactcttcctccagagacttgatgttcttatttgcaattcataaacagccctgtatgtgagggtaggtgtggggtgtcattaactttatttgataagccttccttatctgtaaaataagacagctaaacatggcttctaagcccttttccaacttaagcattatgaaaagaaagaatacagaatagaaatattaacaactaccacatataaaataataaataccatgctgcaaatgaggaaactgacgccaagcagctggatggatggatggacggatggatggatggatggagggatggaggctgacccaggtttatctgcctactggtataggatggtttggggtggtcttttcttggtattccatttgaaggactcattcacttccattcagcccgcatttactaagcatctgctgtatgtctgggtctactctggtctccctatttgatactacttatgtctatgctcctcagagtctcatacatattgctctgatctccttaaaatttgttcttggccaatcatagcataagactcaaagtctactcaagaagcagctaattcctctctcttctcttcaagcctaatttctaaactttgtgaaagaaggtagggatggagcaaccccttttccgttcaatcatgccatggatcattatggaaacttttgacttaagagcagaagtcaactctggagaactgacaatgtggattttatttttcgaaagtatttgtagccttaggaattgaagaagttattttttatccttcctcttccaactttcgccttggattctgtctgtgctttacctaaagaaaaaaatatgtggccacctaccaaattcttgaacagttttaccatgagtagaaaccttcagtagaaaaacagaggtctacatgatgttgattaacactgattagcagaatttacacatatacacaaaatggcaggaaccctgttacatgtaacttcataagttttggaattcttggtatctcactaacagaaggcaggaaagataaaaccttgcctgcgaaattcctctgactgttgaagaggggtcaggcttcgacagtgggtcttatcctttgtcaattaattacttcaacattaattgcacagttcacccttgaacaacatcagtttgaactgcgagggtccacctatatgtggattttttaaaactacagactgttcaaaaatacagtaatcacaggatgtgaaagccacgtatatgaagggccaatttttcttatctgtaggttctgcagggaaggctctgagtatgcacagatttgggtgttcgtgggggtcctggaaccaatctcctgagtatgctgagggatgagtacattgcatctaactctggcttgcaattaagaacaggaacagttactcttctgtaaaatgggtttcgggatgggttagtgggctaatacctacctgcacaggttaaagaataaatgacgccacttatattgaaatgctttttaagccataaggttctcttgcaaaaacagacatccctcacttaccctcaatgtccattctctttctatcctatttcaggaatcaatgagttttcagtaatatttcaaataaatcctttgtactcccgtttaagctactcgatatctgaaactaaggaacaaaattgatttatacagcccagtatacccattagtttaattaattctctgattccttactctctaaatctagaagtaggttcagatggtgagaaataattgaactaacggccaccattattgtcaccatcaccttacagtctaatttacacagacaaaaataatattggattgaattatatggaattgctgtttttttcaggtcaaagattgttaaatattcactatttgatatggttcactctaatatttaagggacagggatcctttatccaaaacaggccaccacttggttctatgattttccatttctcaccgtcactttccaattcctaatcagtattataatagtgaatataacagccatttattgccagatgactctgtgccaaacactgcaagccatttaactaaccctcactatctcattttgttaaaaaaaagtatttgtactgtaatttattcatatagcacaaaatccaaagtgtgtaaaaatgcttgaaatgtaaacttttttttgttttgttcttgagacgttgtctcgctctgtcgcccaggctggagtgcagtggcacgatctcggctcactgcaagcttcgcctcccgggttcacgccattctcctgcctcagcctgctgagtagctgggactacaggcgcccgccaccacacccagctaattttttgtatttctagtagagacagggtttcaccacattagccaggatggtttcgatctcctgaccttgtgatccgcccgcctcggcctcccaaacactcagttcccctctctagagagaggcagttaacattgccagtttcttgcattttcttccagagatattccatgaatatacaagcatatattgctttaaacacacacacacgcatgcacacacacgcatgcacacacgcgcacacacacacacacactctatgtctgcagtgctaaccgttgagcagtggcattctttataaaagcaatagaaatatatcctagagaaggttatcactctaaagatataccataattcattttgcctgtattttattgatggacatttaggttgtttctaatatttttctactattcacaatgatgtacaagtatcttttcagatttgattttgcacaggagcaactaaaaaactaaatatgtaggagaaatttctagaagtagaattgccagatgaaaagatatatacattgtaattttgatagatattttcaagttattcaacatagtggttgtaccaagtttcagttacaccagcagcatatgaaaatgactattttcccacttttcaagaactagaagttattaaaattttcttcactattatcagtgaaaaatagcatctcattttcattttaatatgtatgtctcttatgacaggagatatttattatcttctcatatacttaagagccactttattttctttcttgtgaattgtttgttcgtatacttaatccattttttaactgggttgtttttccttacagatatgtaggatgttatattttaaagaaacaactttgctgtgatatactaaaattgcattacaagctcataagttctttttttaagtttgctttccattgaatatttttgtttttgtttgtgtgagatgatgtggtattttccctatgtcatctggtttatgttttgtaattagtaacaggcctctgagctaacaatgatatattcttctatgttttctaatgccacctttaaaatggggtgatttttttctttatgtttaaataattgatccacctgaaattttaggggttacaaaatgagaggaaactgtttagttactcagttgcccaaacactattcattgactgatacgtccttttctcactgatttgaaatattatttttagcatatttctaaattaccttaagtattcgagcccatttctgtattccaattcctgttctctattctttgtattttttggctttgtgttcttaatccaatataacacttgctaaattattatttctttataatatatgttagcatctgttagaatttgtataacctcatcattcttcttttcaggatttgtgaatccttgtgacttttttttcatttgaactttggaatcagattatctaatttgaacataaattagttggtatttattgaaatctggttaaatttacaaatttatgttgggaaaattgctattatgatgatgttttgtctttctgttcaaaatcttggatagcttctccaatgaactcctttttgagatctttcttgtgtctcttggtaacattttgagagtttcttgtgtgtgtgtatatgtgtgtatgtatagatacatgtgtgtgtgtggtcatatgcatatatttagacatatatatgtacatattttccatttcttaataactttcgtgatcacaaattgggccttttcttccattttgtagtttaattgatttggtttgtacttacgaaagttattgacttctatatgttaattttattcccagacacctttaaactattcttaatatttataatttttttagtttaccctcttggatgttctagctaaatttttatatcattttcaaataacaatgattttactaagtcttttaaaatttttatatcttatttctttcttttgtctaattatattggctagtaccatcagaaaaaatgttgaataatagtgaggataattaacatccttctcttgtgtctgactttaataggaatgcttctagattttttcattaagcaaggtgattatctgagatttgagatagacatatttctcatgttaaggtaatatctattcttattctattaagagctatttaaagtaaaaaaaaaatggatgtcgaattttatcaaatgtatctctgatgtccaaggagacggttttactcttctctttttattattatgagtaaatatattaataagaataattgatgcttattcagtgcaactgatgctcaaggcagtattttaatttctttacatgcatcaactcatttaatctttgcccagcttagaactaggtatcattactgttctcactccaaagttaagaaaacccacattcacaggctatgtaacttgggcaagaccagatagccagtaagtggtaggtctgagatttgacttcatgctgattttcctgtctgtaaaactaatttcgtcatgatagatttcttgttaattaatcattatttcatttctaaaaaaaaatccactccttttactgggccacattaattactgctgatatttatttacaatttcttgtaattgtaaaggagaattggattcaaacgagaaattcagttgatattccctcttatatgatgtcattgtcagtgttgagtgttactaatatccgagcctcatgaccatttgggtaatattcttttttttctttctccaaagcaatttggatggcactgaagttatttcacttttaaaagttgtgtagaattctcctatgagaacttacatggccctaattcccctgtgaaaccatctgggcctggggcttttttgtggagagtttctttctggtaattttttttatttgaagatgctgcctttaatatattttaacatacacagtgaataaataaaacataatattccaaagcaatggaagctgttgaaagaaagatcccttagaaaagtgaatgcatttgaaagattttaggaaagaaaaattagcacactttgatgattaagttgaataaggacacctcacaagagatgggggtgacaatgatgccttctgcattttagcttgtagagcaggctggatgctggtccccttcactgaatacggacaggaagaatatttcagttggcttttgcatgggtggttaaatggaaggaggcattgagctgtattttttgattgtttgttattttttcttttttctgagatagaatctcggtctgtcaccctggctggagtgcggtgacgagatctcagctcactgcaacctccacctcccaggttcaagtgattctcctgtctcagcctcctggggactgaggctgggactataggcatgagccacagcgcccagcctgtttatttttttatgtgttggatttcagggcatttgagacactgagggttgtcaaaaaggcagttagatataagctgtgagtcttttgagtatctggtaattaaaatcttgaagaccattaagaagggggaagctcaaaaagaaaggagaatgagggaggggaagagagcctgggacccagctgtaaccctgcaagggtgttaactaacattcagcattggacaatcactgtaattgagtatttattctattttactacccattgagaatctttgatgtcagggcttctgtggagtctgatctggagatctgtggaataatctgtggatcctctaaaagaacagccatgaactggggactgcagagcctccatgtgtgtccatgatcaggtccgccatggtgtgattgccttccagtctttctgctatgctggtttagaatatctgatgagactgggcacggtggctcatgcctgtaatcccagcacattgggaggccgaggcgggcagatcacgaggtcaggagatcaagaccatcccggctaacatggtgaaacccggtctctactaaaaatacaaaaaaaaaaaaaaaattagccaggcgtggtggtgggcacctgtagtcccagctactcgggaggctgaggcaggagaatggcgtgaacccgggaggcggagtttgcagtgagccgagatcgtgccactgcactccagcctgggtgacagagcgagactccatctcaaaaaaaaaaaaaaaaaaaaaaaaaaaaaaaaaaaaatctgatgactgatgagatggttttgaatgtttttgataatactatggtttgtaatttggtccatgaacccaaagagactcttcaaacatgacatggaggtttttaatacaaaaaataaaaaataaaaaaatcacagatagaaacgagatcctggaatcctgagggagatctagcttccttttttttaaataatgtctttttattattattattattatactttaagttttagggtacatgtgcacaatgtgcaggttagttacatatgtatacatgtgccatgctggtgtgctgcacccattaactcgtcatttagcattaggtatatctcctaatgctatccctcccctctccccccaccccacaacagtccccagagtgtgatgttccccttcctgtgtccatgtgttctcgttgttcaattcccacctatgagtgagaacatgcggtgtttggttttttgtccttgcgatagtttactgagaatgatgatttccaatttcatccatgtccctacaaaggacatgaactcatcatttcttatggctgcatagtgttccatggtgtatatgtgccacattttcttaatccagtctatcattgttggacatttgggttggttccaagtctttgctattgtgaatagtgccgcaataaacatacgtgtgcatgtgtctttataacagtatgatttatagtcctttgggtatgtacccagtaatgggatggctgggtcaaatggtatttctagttctagatccctgaggaatggccacactgacttccacaatggttgaactagtttacagtcccaccaacagtgtaaaagtgttcctatttgtccacatcctctccagtacctgttgtttcctgactttttaatgactgccattgtaactggtgtgagatggtatctcattgtggttttgatttgcatttctctgatggccagtgatggtgagcattttttcatgtgtctgttggctggataaatgtcttcttttgagaagtgtctgttcatgtccttcgcccactttttgatggggttgtttttttcttgtaaatttgtttgagtacattgtagattctggatattagccctttgtcagatgagtaggttgtgaaaattttctcccattctgtaggttgcctgttcactctgatggtagtttcttttgctgtgcagaagccctttagtttaattagatcccatttgtcaattttgtcttttgttgccattgcttttggtgttttagacatgaagtccttgcccatgcctatgtcctgaatggtaatgcctaggttttcttctagggtttttatggttttagatctaacgtttaagtctttaatccatcttgaattaatttttgtataagatgtaaggaagggatccagtttcagctttctacatatggctagccagttttcccagcaccatttattaaatagggaatcctttccccattgcttgttttcctcaggtttgtgaaaggtcagatagttgtagatatgtggcgttatttctgagggctctgttctgttccattggtctatatctctgttttggtaccagtaccatgctgttttggttactgtagcctgtagtatagtttgaagtcaggtagcgtgatgcctccagctttgttcttttggcttaggattgacttggcgatgcgggctcttttttggttccatgtgaactttaaagtagtttttttccaattctgtgaagaaagtcattggtggcttgatggggatggcattgaatctataaactaccttgggcagtatggccattttcaggatattgattcttcctacccatgagcatggaatgttcttccatttgtttgtatcctcttttattgccttgagcagtggtttgtagttctccttgaagaggtccttcacgtcccttgtaagttggattcctaggtattttattctctttgaggcaattgtgaatgggagttcactcatgttttggctctctgtttgtgtgttatgggtgtataagaatgcttgtgatttttgtacattgattttgtatcctgagactttgctgaagttgcttatcagcttaaggagattttcagctgagacgatggggttttctagatatacaatcacgtcatctgcaaacagggacaatttgacttcctcttttcctaattgaatgccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaagttattgagagtttttagcatgaagggttgttgaattttgtcaaaggtcttttctgcatcttttgagataatcatgtggtttttgtctttggttctgtttatatgctggattacatttattgatttgtgtatattgaaccagtcttgcatcccagggatgaagcccacttgatcatggtggataagctttttgatgtgctgctggattcggtttgccagtattttattgaggctttttgcattaatgttcgtcaaggatattggtctaaaattctcttttttggttgtgtctctgccgggctttggtatcaggatgatgctggcctcataaaatgagtcagggaggattccctctttttctattgattggaatagtttcagaaggaatgctaccagttcctccttgtacctctggtagaattcggctgtgaatccatctggtcctggactctttttggttggtaagctattgattattgccacaatttcagagactgttattggtctattcagagattcaacttctttctggtttagtctggggagggtgtatgtgtccaggaatttatccatttcttctagattttctagtttatttgcgtagaggtgtttgtactattctctgatggtagtttgtatttctgtgggattggtggtgatatcccctttatcattttttattgtgtctatttgattcttctgtctttttttctttattagtcttgctagcagtcttatccattttgttgatcctttcaaaaaaccagccccgggattcattaattttttaagggtttttggtgtcactatttccttcagttctgctctgattttagttatttcttgccttctgctagcttttgaatgtgtttgctcttgcttttctagttcttttaattgtgactttagggtgtcaattttggatctttcctgctttctcttgtgggcatttagtgctataaatttccctctacacactgctttgaatgtgtcccagagattctggtatgttgtgtctttgttctggttggtttcaaagaacatctttatttctgccttcattttgttatgtacccagtagtcattcaggagcaggttgttcagtttccatgtagttgagcggttttgagtgagtttcttaatcctgagttctagtttgattgcattgtggtctgagagacagtttgttataatttctgttcttttacatttgctgaggagagctttacttccaactatgtggtcaattttggaataggtgtggtgtggtgctgaaaaacatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtcgaagtctctttgtaggtcactaaggacttgctctatgaatctgggtgctcctgtattgggtgcatatatatttaggatagttagctcttcttgttgaattgatccctttaccattatataatggccttctttgtctcttttgatctttgttggtttaaagtctgttttgtcagagactaggattgcaacccctgccttttttttgttttccattggcttggtagatcttcctccatccttttattttgagcccatgtgtgtctctgcatgtgaaatgggtttcctaaatacagcacactgatggatcttgactctttatccaatttgccagtctgtgtcttttaattggagcatttagtccatttacatttaaagttaatattgttatgtgtgaatttgatcctgtcattatgatgttagctggttattttgctagttagttgatgcagtttcttcctagccttgatggtctttacaatttggcatgattttgcagtggctggtaccggttgttcttttccatgtttagtgcttccttcaggagctcttttagggcaggcctggtggtgacaaaatctctcagcatttgcttgtctgtaaagtattttagttctccttcacttacttatgaagcttagtttggctggatatgaaattctgggttgaaaattcttttctttaagaatgttgaatattggcccccactctcttctggcttgtagagtttctgccgagagatctgctgttagtctgatgggcttccctctgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcacagtgttttccaacttggttccattctccccgtcactttcaggtacaccaatcagacgtagatttggtcttttcacatagtgccatatttcttggaggctttgttcatttctttttattcttttttctctaaacttcccttctcgcttcatttcattcatttcgtcttccatcactgataccctttcttccagttgatcgcatcggctcctgaagcttttgcattcttcacgtagttcccgagccttggcttttggctccatcagctcctttaggcacttctgtgtattggttattctagttacacatttgtctaaatttttttcaaagtttttaacttctttgcctttggtttgcatttcctcctgtagctcgtagtagtttgatggtctgaagccttcttctctcagctcgtcaaagtcattctccatccagctttgttccattgctggtgaggagctgggttcctttggagggacgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttgaatttgctagaggtccactccagaccctgtttgcctgggtatcagcagcggtgtctgcagaacagcggagtttcgtgcgccacgaatgctgctgtctgatcgttcctctggaagttttgtctcagaggagtacccggccgtgtgaggtgtcagtctgcccctactggggggtgcctcccagttaggctgctcaggggtcaggggtcagggacccacttgaggaggcagtctgcccattctcagatctccagctgcgtgctgggagaaccactgctctcttcaaagctgtgagacagggacatttaagtctgcagaggttactgctgtctttttgtttgtctgtgccctgcccccagaggtggagcctacagaggcaggcagccctccttgagctgtggtgtgggctccacccagtttgagcttcccggctgctttgtttacctaagcaagcctgggcaatggcaggcgcccctcccccagcctcgctgccgccgccttgcagtttgatctcagactgctgtgctagcaatcagcgagattccgtgggcgtaggaccctccgagccaggtgcgggatataatctcctggtgcgcctttttaagcccgtcggaaaagtgcagtattagggtgggagtgacccgattttccaggtgccatctgtcaccccttactttgactaagaaagggaactccctgaccccttgcgcttcccgagtaaggcaatgcctcaccctgcttcggcttgcgcacggtgctctgcacccactgtccagcactccctagtgagatgaacctggtacctcagatgaaaatgcagaaatcacccgtcttctgcgtcgctcacgctgggagctatagaccggcgctgttcctattcggccatcttggctgtcctcctatatcgagatctatcttcttatgaaaattctgcaaattcttcatggaaggaaagtatggccacagttttaatatgactctctagaataatctgtggatatgataatatcaacacatagatttactatttaaaaatctacttgaaaaaagattaatttaggttttctgaccatagagttttctggaaaattttagaatctgcctcccccaaatttgaaccaaagtaatgttcttatgttatttcttcccttcttaaaaatgtatgatggactgatttcattatgtacaactacaaactggtaacgagactgactcatttaaataaacgtagttaaaaccatgttttctgttgttatatttatttacatggagtcagttcaacttttaacggcataggttcacttaggttttctcttattagaggtctctcacccctctttaaaccattacttccttattaatttcccagtggcttcaggcaatttctagctgcagcaatgactatgtgaataaacagtctttattgtttgtggttttaagatggagaaaaatacctttgacatacttaacatgctgattattagatgaagtccaaggaatatcattagctttgataatgcacaaagcagtctcctactgagtgcccactatattccaaagcctgggggttctaaaaaggaagatgtattgcttgctctcaccaagcttatcaataataactgaaataattgagtacttactatgtgccaggcatttattcattctcatatcaactgtttaaaggatgcctactggatgccagacttggtgctaggtgctagaaatataaacatatgcaaaaacaaatacattcctgctcttatatgcttatggttgggtgaagtgatgtcacaaaaatatgtttataatttcaaatttagagaaaaggaacataataagtctatgagtgaatacaacaaaggaaatttgcctccagtctgggagaaatctcagaaggcttctctgagaaggtgatagttggactgttttaaggatgagttggttttagctagaggagaaacaggggaagaacataatactcctctgccatgctagaggatcaatcctgactcaggaatcaatcccaacagaggttccattgcagaaagaagaagaagaagggccatggctggagcatggggtgatagggagagtaacgcgagattgaattggacaggggtgagtgagggcggagtggttggtggcagatgacacagagcatgtattccatgcttcagaacaatttgacaataaaggaggagacataatctaaacacctgcctatgcatcagttaaggcagtgagagcagatacatctgtcatgtgtgctcagagaggagagcctccaccttagaggatcagagaaagcttccaggcagaggaaaggaacaatttaaggaggtttttgacagtgaatagaagtttcgcattcaagaaaggagagaaagggtattccaggccaggggaacagaatgtgcaaaggcttagaaagatcaaggaacatggtgtattctggaggcatgacacacttcatgtgattagcatgtatttagtatgtgcatgcaagcacatgtttgttggtgtgtgtatgtgtatgtatgtgtacacacatgtgcaggaaggttgaggtaaaaattcttaaaagacacatttagaaaattcaggttgaggcattcgcagggcggtaccatctgccatgctaaggaatttcccatagtaacgcagttctttaaatagatgtgacacctcttataaacttgtatttttggtttagaacaacgtttgtcttaactctactgaatatcagaatcacttggggagcttttaaaactcctggtcctcagaccacatcccagaccaattgaatcagaatctctgtgagggaatccagacatcagtatttttttttctagttgccttgcccatattaacttcaaaaaaaaaaaaaaaaccactccatattttcagagcagttttaggttcacagcaaaattgtgcaggtacagagatttctcatatagcactggctgcatcacatgcatggcctctctccctatcagcatcccccaccaatgtggcacatttgtcacatcaatgaaccaacactgacatgtcataatcacccaaagtccatagtttccattagggctcactcttggtgttgtacattctagaggtttggacaaatttataatgacatgaatccatcattgtggtatcatagagagcaatttcactgccctaaaaatcttgtgtgctctgcctgttcatccgtctctccccatttaacctctggccaccactgatctttttactgtctccatagttttgccttttctagaatgttatatggttgtaatcatgcagttgccttttcaggctttttctcacttagcaatatgcatttacagttcctccgtgtctttccatggcttgatcactcatttcttttcagtgctgaatggtgttctattttttgaatgcatcagtgcattttaaagcttcccaggtgattccaacatgtagccaagcttgagagctaatggtttaaaaaacactccggcttcatgggaaagtttagggaccaggaaggagatcaggagtcttcctgacctccacagtagattaaaagtcttaaaatggcggcacccagtggcaatgggaaacaaaagatgagtttcaaaaaccatttcggctggccgggcgcagtggctcacacctgtaatcccagcactttggggggccgaggcgggtggatcacctgaggctgggagttcgagaccagcctgaccaacatggagaaaccccatctctactaagaatacaaaattagccgggcatggtggcgcatgcctgtaatcccagctactcgtgaggctgaggcaagagaattgcttgaacctgggaggtggaagttgtggtgagccgagattgcaccattgcactccagcctgagccagaagagcgaaactccatctcaaaaaaaaaaaaaaaaattcaggccattgaatgaatacgtccaatgggatgtcagggggaagagagagagatctagaggatggattcttagtttctagtggtggtgtcatatccagacagagtggtggctaagagtttgagggtgtgggcatgaattcctacttggccagtcactagctatgtgggtgaccttaggcaaatcacttaatcccacaggcctcagtgtgctcaggtataaaatggggatactagtggtacctatcttgttatgaggaatatttaagctacttcacacaaagggcttagaacaaaactctttataaaaggtttgttcttcactgttaagaactgctgaggcagggacagggcaggacatttcctaagaaagaacttaagcctaaggtaactgataggaaaagaagctttcttacctggtcaggttcaagagtaccaattccattagtacctacgggttaaggattcttggttgaggtacaaaaacagaaaacaaacaaacaaacaacaaacaacaacaacaaaaaaaacctctccatgcctcagttttctcacctgtaaaatggagacaataaaaatatcctattttcaggccaggtgcagtggcccatgcctgtaatcccagtgctttggaaggccgaggtgggaggagtgcttgaggccaggagttcaagacaagcctgggcaacatagcaagatcctatctatctctacaaaaaattcaaaaaaaaaattaactgggcatggtggcatgtacctgtagttccagctactaaggaggctgaagtgggaagatcacttgggcctaggagttcaaggctgcaatgagctatgattgctactgcactccagcctaggcgacagagcaaggtaccctgtctcaaaaaataataataataaaatcctgtttccaggttactgaggatactaaatctgccaaagaaaatccttctttgcctacctagcatggagaagggctatttctttctttgacatggctcctcagaatgcatggagatttggagctgtgttgtctacactggatgtgtgagagtgattggtaatctggaggctgactacacttcaggcctgccctgtggtggagtcactgacttccaccttctggctgcaacctgcccaagcccatcctgagtcctaggctgtgtttacttagataggtcccttctctgactgacgaacatcagtccttgtgattgttcatttttttcactttagcttgtttgttttcagtcatccaagtcagaaagtgtcaaaaagaaacctttgaagaaatctttatggatctgtggtagaaaggtatttgttgacagtagcctacaactttgctttccttgagaaaggagctattgcttggatttgatattaaagcagtcagcttccgggaactttgtgcttcagaaatcatcatcttaaaaacagaaaattatgatatttaggcaagaggggatgggattaaaaaagagaagagtaataagcgtcattttagaactatctctgagggagtctgtgttcagtcctatggtagcctttgttttacaggtatgccacgttacaaacaagaaaaaaggtggaatcctaggtagttgcaatggttgaatgcttagaaagagaaaaacctggatatttttagttttttaagagcaaacttttattataattcagagcattagtttaaaaatgggaacattctcaataagataaaattcaaaaaaattggaataataaaaagtggattttttaatgctttgtacacactcctgggtcaccgccatctgaaatatattcattaattcattgatatgttcaactaatatttgtgtgtaagcatttaggatgtatcaggcacaaacaacagtaaaatgttcttcttccttgccttcagggaactaaaacaggtacacaaaatataatacaaaccaacaaggataaaggccaaatcaaatggaagatttatttttccacaatctacccccgggacctagaagacagcctacaaatagtagaggctcagcaaatatttgttggatagttggaagaatgaatgaattatacacctaagacttacaaagtcggaaggaaaaaaaattatgtaaaaagaatgaagagaggatatttgcataccacatactttgtaatatctttaagaaactcagatgtactgtgttccctcaaaatatttccattgcaaaaacatgaaaaaataaaataaatagttggtcgggtgcggcggctcacacctgtaatcccagcactttgggaggccaaggcaggcgtatcacctgaggtcaggagtttgagaccagtctggccaacatggtggaactcctctctattaaaaatacaaaaattatttgggcgtggtggcaggcgcctataatcccagctacttgggaggctgaggcaggagaattgtttgaacccagaaggtggaggttgcagtgagccgagatcgcgccattgaactaaagcctgggcaacagagtgagactccgtctcaaaaataaataaataaaaaataaaaataaaaataaatagatagttgaagtaagggaacaaatacttacagaggactttttcatggagttggtccatttggttacatactaaagaaatttatgaaatctgtctcaaacacacaggtgccttgaaaatagagttagcttacatgcagtttccacagttaagatacagttttccttaacttttaaaaaattgtatgaaatgttttaagatgaatagaatgaacaataatgtatccataatacaactttaaaaaatctcagcattttggaatacttgagtctttttatttgtgaaataaccacattacaacctcaatcgaccctcctaaattccattttactcttctcattccccagagtaaccaccattcagaatcttataattaccattacttgcatcatttgatgcataattatgcatgtatacattcagaaataatatatgaatttctatttattatctgatttttaacttaatgtaaatggtgtacaaaaaagttcaagtcttttccaactttcgtcttttcttcagcagtatgattttaaggtgtatttacataaatccctgttgcttttattcatttaagtacagcaaggagttgtattataggaatatgcaaacatttatgtatttgttttcccactggtggacatacaggtagtttccaattttattgctattataaactgtgctactataaacacccttgtacaagtctccttgtttatgtgtgccaaattcctcaaaggcacagatccaggagtagaattatttgccaaaatgccacgtgcatctgaagctttgttttccaaaaggcttgtgccaatttgcactcccaccaaaagcacatgtgggtcctcatcatgcccattcttgtcaacacttggtattggaattttcaccaatcttaatatcaaatggtttctcattattggtttccttctttactctttttcttctagtttactgatgtaacgtaccaatgtaataagggaaaatgtcttggaaatacaaaattatgactttcacacaggaaatatactctccatttgcttctgagagctcattctttcatttatctaacaaatgtcatcattttaggtactgggaatacagagatgaataagacctactcttggctacccaggaacccagggtcttgagaaggcagacatgcaaaacagataagatgggctagaaaacacaatgatttattgggtatagggaaggaaactgcagagatggggagattaattctagtaggacctaagaaggcttcctacagaaagtgatatgccaacagaattcagaatgaagagggttgaataaatacaatccttcaaagtagatattactatcccatcttacagataaggagaatgaggcctaacatgtttatttaacttacttaggtaagatctttgattccaaagccagtatacaccccaggacatcacattgtttaagaattcctgaagactcaattggtaccaaagtcctgtaaatacagattgggcaagctcagaaggacacatctaacactggtgatcacccacgtgtctaggtgacttgcacaccacttgaatttttggttgccttcagacctcctactagagccattaacatttttattaatttttgtattctttattttttgctgccctttagcaaaatattttgtaactcttacagagaagaactggtatgttcatgggagtctattatattcgtacttctgatctgagcttaatggcaccaatttcatgaggaagtaacttctctaatcctttccaggggcagatagtatacactgagagtacttgggtttttaatctgggtaacattgcaggtctttcaacagaggtgcgccttggtctgtcctagtttgagcaggaaggccccactgctgtgttgagaatagacagaagctggataaggggagaaataggaaggccagtcaggagactattgcaaaaatccagacagaagatgatgagggcttagaccagcataattgcagtggagatggttctcctggatgtattttaaagattgaatcaatagtatttgctgatagactgaatgtggggcttgaaaggagagattgagtctcttcctattttcctactcattcctcagaaaattgctaaccagagcagtgaagttggtcttgttaagagtagacccctaatgcagttataacttcccatgttaactgtctcctatatggaagacacttggttttctctgtcaacctgtcatcaacactaaaccactgagtgctcctaaaagctgtgtgctgggcattcagatgaaaccaggaaaaactttgaaacagcactaaggttgcaagagtctcttagaaattgtgtacttgttagctctatgatatctagaaaaagctctgaacaggagaatggcctacaccagattccttcaataattctaggtcataactgacctacaggtttcagaacgcataaaatctttctttgtactccaatacctcctaatcatataagacgccatgcttctatattttcatttgcttccaggcataggtcttggggtcttgttctatgctcttaatcttctagaaatcctattccttctcctttacctccctaagatcacatctctgccactagcacactttgctgttttccttgtgaaatgtgttctgcatataatcagtcagcagactgtagggtgttgtgctttgttggaatataaatagtgagtgactattacatttcccaaaaggctttcagctaattgttaaaatggagaactttaggactataatttggtagccagattctttttccggcttaccctgtcattcatcacccagagggatgcagaaactggtaaacaaatggttatttatttcacaaagattccctgcacccctactttatgcaggctgcattccaagtcttcaaggtacatataggaataaaacataatttctgctttggaagagctgacaatctaatagaagaggcagataataaacagatcattacccttcagcttgcagggcagtggagagtgtctggaagaggctgtatcaaagctaagtccaacttgaggagaaaggtgggaggaggagaaagaatgagtggaaagaggaagagcattgcagatgaaggaaagatttgggatcagaagccttgggcgaatcttattatgggactacctggaggaaagcagcctcatcagagtcaaagggtgaactatggaacatgggctcctaaggtactgcacagatgggcacagagatactcttcagagccacctgctccatgcctgtgtctttatccccagatgaggacaaggactcgctaaccttgagttgggggtcaagaaccaggaaagttgaggccaggcacagtggctcacacctgtaatcccagcactttgggaggccgaggcaggagaatcccttgaacctgggaggcagaggttgcagtgagccaagatgacgccactgcactccagcctgagtgacagagcaagactctgtctggaaaaaaaaacaaaaaacaaacaaaaaaaaagaaccaggagagttccaaatgaatgtttgtaaatttttaaatttatttaaaaataaagaaaacacactttctatgtgccaagcagtattctcagccctttgtgagtattattattggcctgtattacagatgagaaaactgaggtaacaagacagaaaactggcccaagttcaaataataagttaagcctaaatgaagattcaagtccaaacatctaggcttcagagtctgggtgctgggcccctccctcccactgctgcctctataattagggtctaggttggttgtgtaagtagttcttgagtagtggtatgaatccccagtctgcagcattggcagctgaatcaataaggagcaggcaggagccctaggctggatgtgtgtcttgagaaggagctgtctgtaagacatcccagtcaagataccaagcatctgaaactcaggagcaagatactggctgaagctctaaaattgggagtctttgggcttaaaggtaggagtggaggtctcatttgggtgaatatatccatttcctacagccactgtaacaaattaccacacctcatggtttaaatcaacagaaacgtatccttgcaaagttctggaggccaaaagtcccaagtcaaggtgtcacaatggctgcgctccctctgaaggtctaagaaatcctcttaacttgctgttttccagtcattccagaatgactgagggcactcctgaacttgtgcgagcctaactccaatttctgcctcgggtctcttcacacggctgtctctcctctgtgtctctctttgtcctctccccttcttataagagcatctgtcattggattgaaggtccatcctaaatccagtattatatcatctagagatccctaccttaattatatctgcaaaggccttattttcaaatagtgttcactcacagtttccagagttaggacttgggtgtatcttttgggaggacattattcaacccaccacaatggacaagtttgtcctgagaaggtcttgagtgaagaggcaagtcgacctagagcagaagagtggggcaagaccaacactgggggagagacagctaaagaaccctgggaggaggccaataagcagctatcagaagctgaaggaggtcgccaggagaagagagagctagaaacccaagaaggagttttatatatgaaaaggatgacatggacagcaaggttaaataccactgagaagtgtggaacatacacagtggtgggcaaagagagggcttttagtgactttggcaagaaccattttttcaccttggcagtgtggatgggaagggggtggcaaggagctgaagaccctggtggccagtgctgtcataccatgtgcaagctgtaagtggcagtatgcacaatagcagcctcgaaaaacccaaatgaagaccgctgtcatacttttatgtttccagattctctgatgcttacataaaagtgcacttcacattaatttcttacatacaatatgttgaagtggcaggtaagtgagggactatatctatctatatatggtaattattttaaatgacaacattttgactttccatttcctttaaattagttttacgtggtagggggccaattcacattttagaattcgtccagaagttgttttaattgcgccttcaaacgtagatacctgtgcttcttaaatgcaaaatggctatcttttgataggattaaatggcctttcttttttatttcactagtatgtttgcactaatatcaatggtgaaatagcagtgcatcaaactgatcccaaggagagtatggtgcttaaaaaatgctagcctgaaataagaatgtaacttttcttacagttaccagagttcatttcaattaaatcttaatgaggaaaaatgagacaaatgggttcatgagcattacctctcagaccttttaatttttataaatccactggcagagttagacttaccctgttgcaattatttcatttggctcttggaaatttcacctcgaattgcatacggcgggtgccagaggcaatcatctgcttcggggcctaactcttgtggtcatgttatccatctacatctataatcggagaaggggcatgttagaaatgtgaaaagtaccatttgtcacagcattcttgcgtaaagatggctggggctttgggaataagccggtaggggcagtttttcttctcattagctattttatttgtaactgcaggggctgtcagaagcatggacttaataatcttcaagttttcctgcattaatataaaaaaagttgcatgaatttttggcaaatcattgtccccatgagggtatcaaaaatactttgctggtgaatacagaataacccttctttggggagctctcagctgagttaaatatataattgaagcggatttatccagaatgagacatttatgctgatggtgtacacgttttgaagattctgaaccttcactccaagtgtcttttcaattctccacgggtaaaagttagaaggaaagtaccagcagcgctgttaatataataacagagtgcaagggatgcattttgcggttagattatgattatctctttatctgctatgtctttgcatgcatcgtggggtatcaggaggaaacccaaggcccttcattctgtgaagagcaccagaaatatctatcctgcaggatctcagactaacgggaaactgaaagacagaaggaagggagggaggggggaaaaaacagaaggaagggagggaagaaaagagggagggagggaagtaaggaggaaggaagcagggagggagagagggagaaaaggagcgggagggagggaggaaggagagcaggcagatccaaacttccttttctttgctacagctggtgtttctccatgaaatacttcttcccttcgtgtatgggcatcatgctgtcttggttctcctccctatcctcactcgctgttctctctccatctcttgcctcaggattcggcgcacacatttcttcttatctcttttcatacctgtttcctagaatatctcattgagtcctatgcattttaatacaatctctaagctgacaactccttcatttattaatatattcccagcctccacttctcctgtaaagtcaagcctgatacaaccaactgcctcttcaatgttttcacttggaagtctaacagacatgtcaaattcatcttggtcagaactaaactggttcctccaaggtttcccaaactggcttttcctgcacactctcaggccaatgtcgctggtgttttccctcactccctcttatctcccagccccatctaccctgttgggaaatcctgctggttcatcttcacaccatgctccggatccaaaacctctccccttctcccaggaacatggctcctccagctgtttccactcagttgttctccaccactgggtgaagcaggcagattgagccttttatgcttaaatggaataatgttctagcacctctgccaacaactccagggttttgtcatctcacagtgaaatccaaactcctcccctaaacccatgaagcccacttggcctggtcaccgtcagccacccccatgtctccatcactcccccaagccagctgctctttctcagacacaccaagcatgctccctgccgctggcttcggacttgcagtccccacatcctcggctgcttttcccctggttgttcacagggttcatagggttctctcctctcccgtcttttctccaattgctcctcaaagaccttctaccaaaaatagccagactgtgcctacacacatgcatgacactgcttatgatcctctgtttttccttcataaagtgtaacatttccaaacacattctacatgtgtttgtttattgtttgtctccacataaaagcaggaatttaatttttgtgtgttgccatgtctccaaagtctagcacagtacctgcaatagactgggtatggagtaattattaggaaagaaaaaaagagagagggagaaaaaaacaattatttgatttttttcttgtaaatttgtttaagttctttgtagattctggatattagccctttgtcaggtgggtagattgtaaaaattttctcccattctgtaggttgcctgttcactctgatggtagtttcttttgctgtgcagaagctctttagtttaattatatccatttgtcaattttggcttttgttgccattgcttttggtgttttactcatgaagtccttgcccatgcctgtgtcctgaatggtattgcctaggttttcttctagggtttttatggttttaggtctaacatttaagtctttaatccatcttgaattaatttttctacaaggatatgaacagacacttctcaaaagaagacatttatgcagccaaaaaacacatgaaaaaatgctcatcatcactggccatcagagaaatgcaaatcaaaaccacaatgagataccatctcacatcagttagaatggcgatcgttaaaaagtcaggaaacaacaggtgctggagaggatgtggagaaataggaacacttttacactgttggtgggactgtaaactagttcaaccattgtggaagacagtgtggcaattcctcaaggatctagaactagaaataccatttgacccaaccatcccattactgggtatatacccaaaggattataaatcatgctgctataaagacacatgcacaagtatgtttattgcggcactattcacaatagcaaagactgggaaccaacccaaatgtccatcaatgatagactggattaaggaaatgtggcacatatacaccatggaatactatgcagccataaaaaggatgaattcatgtcctttgtagggacatggatgaagctggaaaccatcattctgagcaaactatcacaagggcagaaaaccaaataccgcatgttctcactcacaggtgggaagtgaaaataagaacacttggacacagggtggggaacatcacatactggggcctatggtggggtggggggaggggggagggatagcattaggagatatacctaatataaatcatgagttaatgggtgcagcacaccaacatggcacatgtatacgtatgtaacaaacctgcacattgtacgctagaagtataacaacaaaacaaaacaaaaaacaaaaacaaaacgaaggcacaagtaaaaaaaccatttgtaaattggttaaaaaaaaattattgagcattatttagagtttaggaaataagggtaggtcaatgaatagactattgtttttggacttcaacattgtattgcaatgtccacaagggcccctctgatggcctccttttgcacttacttggaatgtctttgaatcgattataaggctcaccatcatctagcctctgcttctcttcccttagttctctctgctacagccacttagcctttgtcacataaaccaagcccatccctccctccggcctatgggaaggttcttcccacacatcattgcatgattgggtcctgattgcatgtcctcttgaaaagacctccatcaaacctgctatcctcatttctggccattttctatcacataaccctgttttattatcttcatggcatttatcgccatccaggatgtcttgtttatttctttacttttctctcatctctgtcccagcttttgaatatgaggctttgcgggctggggccttcatcagtcttgctcactgccttttcccaagtgcctggaacctggtaggtgttcagtcattattttcttagtggatgagtaaatgaggctgccttctagggtactgaccttcttatgccctcctgctcgcgcccccccccccaccacctgatgtaattggaaggaggattgttatagatttgctgttatgtgcacgtcagtgaggagccgggcatctgggaaacaggagactgccagaagttcttgccagaaatttctctaggaagtaaaaaaagaaggaggcataaaatagttgggaaaaaaccatgtacagcaaacctaactaggtgcattttcattcctctagaaaaaaaaccttttcaatagagactccccacacattccccagagcagcaattctcaactcctatgcatcaccccatcagttgtgagtgctgtcatgcatggtagccaaattaccaaactttgtcatttatgttttatgtgatagatgaggtgagatttaaggtcatccttgtggcatccttctcttgcattggttctattatgtgttcttgtgagtctgaggggtgaagtgataagtggtatgttatgagttgcaaatgttgcacagattttcttgatgctgctcagcccttacctgggatgccccaggcagggagacacagacttgactgtcatccacagattcaggaaccccaatcatggtttattaggccattcttgcatcgctattaagaaatacctgacactgggtaatttacgaagaaaagaggtccaatcagctcatggttctgcaggctgtagagaaaacatagtgttggcatctgcttggcttctgaggaggcctcagggagctcttactcgtggcaaaaggtgaagctagaacaggaacatcacatggagaatgcaggagcaaggaggcagggagggtgccacactttacactttacaacaaccagatctcataaaaactcactatggacagcaccaagtggatggcactaaaccattcataagaaacccacccccatgattcagtcacctcccaccacaccccacctccagtactggggattataattaaacatgagatttggtggggacatatatccaaaccatttcacatggtgatcacctggatttcacctgctccatgcccccacataactctgaaaacactcaagttctattatacaataagcacaatgttaaagtttaacaggtaatcattatgtaatcaatccttatactactaatttggtagacatcactatttttcattctatagcttatccagcatttcacagaaagtgaagaactcttgttgaacacagataagatgcttctctgtaaattttgcattttcttaatttgggataaagataaaaaagttgtcaaagactgaaagcccaagtcagagaatcatctgacatgaaatgatatcatttctaaaattaataaacctgacttggggtcctcaaagtatcccaagcaaaatggtcattttttatagatttttaaaaaataaaatccagttatgcatatttcttttgtgccagactcttcctgaaaataatttttcaaaatgattgtcacagctctgccctagaggaacttgcaatcaagtaggagaggaagagatgttcaataaatgattctcaaaggacatagccagcgactctaagtggtccaatgaggcttacaaatgaattggaaagggacagttgttgggaaataaaatacaaagacaggtagaaaaaatgccaaccttttgagaactatagtagttaggatgctggagtaaagataagaccgcaaatttccattggcttaatttaataaacacatttttgctttgtaaagtcaggcttaggttggccaccctctttcatcttgaaactacaccgtatggcaaaatgatgtccaaggttgcagtatcagggtaaagcagttaggcttcaccctaacctggcacttcatgtccactcccaagcccactgatatggtttggatttgtgtccccacccaaatctcatgttgatttggaggaggggcctggtggaaggtgactggatcatggaggcatatttcccccttgctgttctcctggcagtgagtgagttctcatgagatctgattgtttaaaagtgtatggcaccatctcccccaccactcctgctctgccatcataagatatgcttgcttccccttcgccttctgccatgattataagtttcctgaggcctcctagtcatgcttcctgttaagcctgaagaactgttaatcaattaaacctcttttcttcataaattacccagtctcaggtagtcctttatagcaatgtgagaatggactaatacaccccttgtccagaattagtcacatgaccccaactttattgcaaggatggcttggaaatgtaggggaacacatggatatttggtgaacaccacttctgccacagtagtggtggactttcagtgaatttgattaattttgtcttactagataagagaaatagcagtggagttttggactctagatgaaaagaccattgtttgacctcttttgggggagtaactgaataaatttggcacaagtttatgtaatcacttggaagctaaactatttttgtgtgccttgcctgcttcatgggatcaagcaatttgccctggtgtatgcggatgtgtttcataagctgctaggtgtggtgaaaatctattctagtatcattatcaccactatcatcaccatggtcacctaagtgaaaggggcagaaactgcccttgtctgtgtatgtgaccagagggaagtaaagtccctgcttatccttctagttccatgtctctcctttttccttgaagtaccatgaactccaaacttgctgaatttttgatgatttcccaaacatgcctgatctttcctgtacctttttacatccttctccctctgcttataatgccttttctctccttttctcctctctttacccagataatacccacctgtctcccaaagcttaatcccagaaagtacctatgtgtctcccaaagtctaacccaagattactcaatctgtaaaggttttccttgatccccaattgtaggacagcttgggtacctccctacatacatatctcttgtgtgaaactttgcctacatatcacttaaccattcacacatctgtctccctgattagcttacaagcatcttaagattggggactgagtcttacttttggttcagtagtacaggatcaggacttgaggatgcattaattccaaacccaaatcaaacacttactggttgtatggcttcagatgacttatttcatctgtttttgccacggtttcctcatctgtaacatgaggaaagcaaaaggtacttacttggggttgtcatgatgattaaattaaaaatacatgcagactacttaataatagtgccaaacacatagtagaggctcaacaaatatttggtgaatgaaggaataaatgaatgaatgagtgactgatcaattgactcagtcttatgatggtattacttaacaaataagctaactaactaagactttgggggaagattatctgctcaagttcacacagctagtttatactgactgactctaaaacttgtcctctagctgctgtaggtggcctctagcaggtgctcagcaagcaagtgaaataaacatcagaactgatgaaccaagacaagcatggtgggaaggggaaaagctgtagaaacgtcttaagaacacttcctagcttctgctgaatcttggtcattgtgttttgttttgttttgtttttgtttttgtttttttgcttgttggacttttctgattcctttccagcaggtataaaaagaaaacagcctgggcagcaggattggaagcctctgggcacagagcagggatttttcatttcacaggtcacacaccacactcagcagcacagcgcacaaagtcagtcttgattcttaatgccaggaggaagcaaaacagggcttgttgttctgctctgggcctttggtccaggctcactggagagtgattacacttttgtcttttgctgctttaagaggggaggcaagaagtcccaggacatgagccaaacagtccatgggttgggtgtgactcaaacactgggcactctgagagccactttgacaagccagcctcctcaggcacctgaatgccagatcagccatgcccaagtaccttggcttaagctctgatgccaaaagggataaagcagtacaatataaatgtaaaacacccttgacagtttggctcactttctttccctgggaggcaactcctgtaagtaataagcagaccttcttgccagtgccctgtcttatacctataccttagataccttaggcatctaagcggaaccggagcttgagaaaccagtggcagttaaggacagacagcagaggaaccagatctagtgctgctccagtattgaccagctggggagcaggggtattgcacataagttctacacctcagtttcaatgcctctaaaaggaagtagaggatccctcattgaccctcctctcaggattgtcagcaggacattaggagcactaaattgccctccatgaagttctttgtaagctgttgtaatttgtgcccacagataactgtagaagataggcaagcattgacttcagacatcgtgctgtacctagttcccaatgccccactgggttctctttccaaaacaaaggtctcctctgtaaagaagagaagaatggagagaactcatgagactgttaaggattttacaagtgcttttgttttaaatatgtttcacacatactttgttttttcctgaattattctttccaagagagcagtagatctgtacttgggttttcacccagaaggaagaaactaaggaaaccttcacatttccttctagaagaagggagaataaaggaaatcattggtttcttagtaaaaactacattgtgttttccttctccctgtcaaactctcccatagtttgcttgctttgtcacaaagaataaaagggttttagaagtcttggtgtttctaagagccttagttcttgcaacagtctcaccacatgagtaaggaaaactctaaaaagaaaggaagtccctctttcacaaaagaaacctagacactcagccacacacacaggcttataccaatcataaaaacgtaaactgtaaaaacctcaaaaaggcaataccgaaatatgagtttaggaatatgagtaacattatgattgacaaagcaccagcactggagtgggcccagcacttcatttacatcatcctgtttcatttttagagcagccctaaaatgggctttatttttgaacacagagactgagtaactggcctaaggccacacagtcaaaaatagagaaatgggattaacacccacttgtttgactcctaacctgtgctcatccttctaggccttcctcccagccctgcacaatctttgggaaggtgttcagcagccctgacactccctgcttgagccattctccatcccctgacccacctgagtcatgtgattcccaacggtggcagaactgggattccctctaccctgggatgacttcctgttgagtgagaaaaaaatgtgctcattccatagtacaatttgagttaacacaatgcctgttcatcacatgctggctccttttctcacccagctgccaggtcctttgtctgtttcccctgaaggaaaatcatcaacttccaatggaggcaccaacttctctggacagtagcagaggccttctggacatctgaccagcagcacagcatgctggagcactcagcgaggtgtaggaaggtgacttggctggggtggaccacaatcaatttggaaagccacagccctcagacatttacgataaagcaggagtgatttgagaacctctttcctagctactcatcttcccaaggcagctctatcaccacagtcacacccagccagggagataaaaggctgacgcttgctatctgctcctacacaaatgagctacatgggcatccttcatatgggctgttcttctcctggtccagtatagaaaacaaagttagtgactggggagagggccgaccatcctgtaggggcaaatgcattccccttaccgtttgtggcctagtgctccgtccagctttcttacaaagtaagcatagttgggattgggtttttgtgctatgcagcttcatctactttggcaaataacaccttgaggcttatttgcaaggatctttcccaagtcacaaaggatagcagcacagtgcagtggttagaaatgcacgttttttattattccttttacacaagttcaactcccagttctgttgcttcttacttgggaccatagaaaaagcatctaagctttctacacatcggtatctttgtttacatatggtgataataataaaacctgcttcatagaggagatgctctgtggaattgcccagtatagggcttagcataatgaaagcattcagtaagtgctactactattgtttactattattgtccagcatttactagagtcactaactaaaccatctggtcccagttctgatatgtttttctcccaggaaggctttgccaacacagccctcccaccctagtctggattgagtattcttccttggtgtattccgcagcccgtgttcttcccccataagagtgaaaatcacccaggcttgaaggaagggactatgtctgctttgtttattgtatctgacatagaacctggcacacagaatgtggacactcaaaacatatttgttggatgaataaatgaatgactataaggaaagcttgaggtcctcgccatattgaagaacccaagaaacaatcaggcaccaaaggctctattaaaggaaacggagggtacagtggcagcacagtgatgagaaggggtggcaggaccattacgcatgtcttcctacccctaaatcgcatctgtgccttttatattgtatcatgttagatgagggtctctcctgcctgtgagagtggttagctccccttccacggtcatccaaatggttttctttcgagaactagcaattacttcagtccttctctcacgcaatcacagcagctgacccgaagccccttgctccagatgcatggaaaagcctgctaggctggagaacttcttactttctttcaacctgtcaaaaatgacagctgtgtatcactttggggagagttgagactggcacaaaactcatcccctgatgtgtcataattacatttctggctttattacacttcttagtatgtagtttgggtctggacactaggatggggtggccatgctgatgtgatgtcctgagctgagagacctcagggtacatgagggctttgtgaaggtctttatgatggaaaaagtgtagcgtccagatagatggatagcaagggagaccctacagaagttcatctgaatctgtcctaatacttctgagtcggatatcctcttctttcttggcatctcaactgagctttgctcttctaattcatcttagaaagtgaaaataacaatttcatgtcactttttgtctaccacatgggcaaagctatttttttaaatgataatacatagtgtttgtaaagatacggaaaaagcagaagcccttttaagctacttgagaaatataaattagcacagctatgtgttccaatacattttttcattactcagaactagcataagcctttagcaaaatcatcaatgataaaacacgcgcttcccttaccccagtgctggagacgagaattcctgcaaggccagctcggggtgtttaggaggggaatggaaattatgaggcaagtcccattggggtaaaagttcgtttctaaaacccctactaagccatcttgttcatcaacataaaagtatcatgatactccatgggtttaggatggaggctgagataaaatgagaacatcgaggatattaatcacattttgctacatacaaaatttggaagcacagccaaattcactcaagcttggactttaaaatgggtttcctccctgcaggcactgtgcacagaatatttgttgttattttgtgatcatcagaggaacgtgagttgtgcatggtgcatcattctgctggacacccctgccccccaagtttatgatcatttaccttgagagctaaaatcagatcgtggcattccacacaaaggctatgctgctgtaattaatgcagagtcctcacatgctgtatggtatgaattgtattgctaattatattattatgaatgtggtttagagtattattaatgcaggaaatatcaatacttaaaagcctcactggcatgaagatttttacttcggtaggcatgaactggcctggaagcattaaatactctcttgcttagaggcattaatctgtattccctttgaatacatttaattaaaaatttcacctttccaggaattgttgtttttatgcaaccccaaaatggaattttactggagggcaggtcttttacataagcaaccatttgttcagccagggtgacgtccctcagacaaggtgtctggtaacgttagggatatggtgaaggagctgcccttctctgtcacagtcttgctttcttgagagaagtctcagctttatagacaaaaataaaaccatgttcagagtcaaatgcagggacacaccatccaggatacaatttcattgtgtcatttgtcattgcttttttaggacccacttaagtccatcttaatccactttggaactcagcaaccagggctctgaagtttgcgatttcttgtatgtgtagatacttgcagatgtgattttgctttgtatcctcagatccatgaggtagctattattatttccatttttgcagacatgaatggttttttaactttagaagtgggatccttaacctcagactagaggttaatcacatgttgatagcaccgaggcttgaggagagtcacacagctggtaggacctggctgggatttgaacctgggtctgtctctaaagccaagtcccttcctagtttccttcaggctcaggccagtgactcttccatctagggtaacaagccaacccactgaatgggactgagaggtttcctgggatctggaacttctagttttaaaatctgggacagtcccaagcaaactgaagcaagttggtcacactaattccatcccctaactcctcattttactccatcttttcagctgattgagatgttgagtttattatagacaggatattggagtctgttgactggctccctttctagaaagtggttcctatgctaggaatgtcagactggcacacagagaacatttgccacagggagggatagaaattccttgaagcaaatatgaccgaagaagtcccacaacaaggggcatggatcagttaccacaagatgctaataccacagtagatgatttcctgcagcattgggtttggggaaccataatggttattattcggagcaaggtgtcatggagacaaataaacagacatggtctattagggtaatgggggaaaaaagcaacatttatcaagtatttacctctccaaataatttgcagctgatttaagaagctcttcgtgaccacacctaagagtaccagactctaagactttactaataaagttgaaaatatgctagtgttaatatagctggcacgaaagaataggaaataaatgcctgaagtttgtcagcttattaatcattcctttgtaagcggtgcttttacttttgttgttgcaacatctaaccacagttcattggttaaaggccaagctagcttttgcattggcatatcaccatgcgcaatggctctgtgcttcttgtctatttattaatgctgcagacttcctacaattcagtctaaaaatagcatcagttctgtgaaaaatactgcatttgtgctttagccatggtaaggaaatatggaagggtatatgtgtgtgtgtttgtgtggacccgaagaaaacattgtggtgcctaaaatccataattgttacactcctgaaaaccttacttttttggcatacctaaaattaaaagaaaaaaactcaaagggagtaagtggaaagagaagggtgaagagagaggctgattccctcccccggcccaaatcctagctatgcataatctctgtttatttttagtacacaaaatgatcatgctaagctagaatgaaacctcagaaaaagccttttattagagggttttatccttaaatgaaactgtgttccctcatctcaggtcctctgctaccttcctccatctgtttgaactgcaaagcatccatggaaaaactatgggtgggcatatttccttacacaatgtctggaaaaaatatattactttgggtgcttttggacagaacattcctagacaaaatttattctaactgtaaggttttcctaaaccatatccctggtttgaaggtgtctatctatctatttagccatgccagcactcaagcatgaatgacacagtgataatttctctaaatccatgatttattttggacccacaagaacttgaacaagacaattaaggtttgagaagccatgtgaacctgagggagttgccagggacacaggtgaagagtgatagaggatgtgtttcatcatcaaaaggaagaacagcaatagtgataaggtcctatggctgcacaaatagagaaagtgaatggtttgcctatcaggcgtatcaggtgttgggatttgatgcagaactcctgaataatatgttgtttgccttttggaggaattaagaggaaggaaatgtcattcttcaccttcacacatgattgtgaagagagatggtagaatgagaaattgttgtttcctgtttctgaaagatactgctgggagcaagggtgacagggaagtaccagaggaactgggacagcccaaagtggcctgagaaaagaggacttggcaacatgctgtttaatcagccttggtatcagaactgtgtaccagacagagggataacagttttgtaatagtagagcgtagtgggaagaacttgggctgcagaatcatccatttgttcaataggtgtttatggagcacctgctgtttgctgagcaccttcctgggtatgggtcaaaagaagttacactgaaacctggttccactactttctagctatgggtctggggcaaagcacttaacccctctagaaaacaccaatgatggtctctgaaaataaggattctaagtcctaatcttgttgggaggacaaaatgagatcatttatgaatggtgagtcacttaaatctctgtaagccttaggttgcttatctctaaaatgaggataaaattacccaagtcgtagagctatgatgctgtctagatggagtaacagagtaactagttgtgtgccagccccctaaaatagtagatggcattttaggaggctgtgtgttggctcaggtgaatctatttcagaaagaacaaacttcaggagagtctctgtgaggatagatgggaaactgtcactttgggaaggttctgtacctcaaagaaagcctgtatcgtgcaaaagattccagaagaagggaggtatatgttaacccttattttatgttttcagaagaaaggaatatgtattttgaatcagaaataaactagatcctttttcagatagtaggttctgcctcagatcatgagggacatagtgacagactttgctttcagtgtgcccttgggcagcttactttctgctgctgggcaaactgatatttgcccatacataacagcattggaaaacagaaagtcctgaatgtcataggagagttatgggtttcaagaactttccaagagctagcaaggaagtttgagactagacccaactgaaagcaaatgtcctatttgaaaaggggaaagtgttaccatgtgtcatggcatggtgaaaaggacaagaccttgaacaaggagagcagccacaatttcaaggctgacaccaaggcagcagtgcgaggtcaggcagaccctcttaaacccaatgaacttcagctgtccctactgtaaaactgtccaggagtatgctaactttcaaagttctataatattaggagtcttatgatatctgcttgctggtttataaataatttgggaaaccgagactccatcaaatgtagtggcccagagtgaacttgtgattgtgttttcttgcctttcttactggaaggcacctgggttatttctgtcaattagaccagccatttccaatgaatatgctcaccccaagcttctcactgctccagagggcataaagaacacattctttctcacatctagagactcaatgcctgaatgggcagcatcagacagatgtcaaccatgaaactttacacatacacacacagaaaccaaaaaaagtggaggctgaagccgcaatatattgcatcaatttacgggctagaacagaaacagattttcaaacaccatatacagatcttccgtaaaggacccaggggacaaggatgctctcaaagcatggaagaatgaaagggaaacaatgagataggacacgaggaagaagacaaggaagagaagctccctatgtgattaaatgcagataggtggaggaaaaataaaaacaagcttcaatctctgatccctctcaaagttttgaatactctctgtgggaaaacacacaatgaaattagaagtgatgcacattgaaatgacactggagaagtggtggcagaaggcagggtcctcagctccgacccatttctgctgaggatgaagggacatgggccctgctgcacctgcaacctggcctgtcagtggtttgcctcattcattcattcaacattaatttgtttctctgcttgcctactaggatcccaggctcattagggaggcagacacatattcagctcattataccacaggatgatagagatacattcccaagcatgggcataaaaactaagatgggggtaattgattcggtctggggcccaagttcaaggaggacaaatctattgagtcccaaaaagctgcatccttgggcccgttactcattccctctggtttccctttcctcatctgtatagttaatggtgccgggggtaaggcactgagcccagtgcctggtaccctgtaaacaccaagtactggtaatgattagaggtagtgatttattaagcttctaaaagagttttatagtcatcattttttctcttctggcaactgttccaagaaaatccaggtacggttgaagattgaaatgtgtgtggcttcttgggatcttggtgtagactctgctgctctgaactaactgagtagacaggtgtcatgacacgtgtctctcttgctgagttccagaatgatgaaactgggctttgaacataatgtcttcagcctcatgaagcccctatacgtctgttcttcgcccacgtcccttacgattggctcacaaaccagatttcttctcatgaatcacttttttcctcttaacatcttctgctctcccaccaggcacttctctataccttactggttctggtggcaggtggcactgcacaagtctaccaatttgaaggcctgctgccctcccagcttgtgtgcgcctcttcagcaaggctggccgaaggccctgccctcaggttgcttaccgtcagcctctctccattctcaggaggccccaaatactggtctacctctattcaaaatcctccaatgtcagccaactctctcagaccaaaggccaacatcctcattatgatgtttgtaatccattaggttggtgcaaaaatgattgcggtttttgccattgcctttaatgacaaaaacctcaattaccttatttaaaatattttttatttccataggtttttgaagaacgggtggtatttggttacatgagtaaaatttttactggtgatttgtgagattttggtgtacctacacctaagcagtatacactgaacccagtttgtagtctttaacctctcacccgcttccctccctttcgccctgagtccccaaagtccattgtatcattcttatgcctttgcatcctcatagcttagctcccacttacgagtgagaacatacaatatttggttttccattcccaagttacttaacttaggataatagcctccagtcccatccaggttgttgctaatgccattaactcattcttttttatggctaagtagtgtatatatatatatattacatgtatatatatacaccacagtttcttttttttcacttttcctcccagctttattaaggtatacatgacaaaaattggatatgtttaagtacacaacttgatgctttgatatatttatagtgaaatgattactgaaataaagataattaacatattcattacctcacatagttaatcattttgtgtgtgtgaggtaagaagacttaagatctaccctcttgtaaatttaaagtatacaatatagtattattaaatatagtcaccatttctgctttttgggtttgactatataccacagttctttatccactctgattgatgggcatgtgggctggttccacattttcgcaattgcaaattgtgctggtctaaacatgcgtgtccaagtgtctttttcatataatgacttactttcctctgggtacatgggactgctagatcaaatggtggttctacttttagttctttaaggaatttccatactgtcttccatagtgattttactagtttacattcccaccagcagtgtaaaagtgttcccttttcaaccgcatccacgccaacatctattttttttttatttttttgattatggccattcttccgggagtaaggtggcatcgcattgtaaaaacctcaattacttttgcactaacctaatagttccccacaatctctctgaactcatcttctcctgctgtttccctcattctcttcactccagctgcacttccctcctagaagtttctcaaagaactcaagtcttcactcttgctcttccctctgctcctgagaattctgccccagcagaaatgctgtccctctgcctggaatgtgttccccaaatatctcgctgtctaactttctctgagatttggggtgccagataaaatacaagatgcccagttacattcgagaacagataaataataaataagttattaataatgtattactttaataagttattgtttattatctgaaattcagatttagctggacatcttgtagttttatttgctaaatatggcaactatatcagagttcttcacttagaagttgccgtttggatgcttatattggttttctattgctgctaagacacattactacaaacttagtggctgggaacaacataattgatcttgcggtagatcagaagtctgagacagatctcattgcactgaagtcaaggtgttggcaggattatattcctctctggaggctctcagggagaatctgtttccttgtctttcccagcttctagaggtgtacacattccttggctcctggcacccttttattttcaaagacacaatgtcaggccaagtccttctcatgctgccatctttctgattctaccttctgaatccttcttccacttataaatacccatgttagtcagggttcaccaacaggatggatggatatatagatgatagatgatagacagatagatgagagagaattcattaggtgcattggctcatgtgatgacagaggctgaggagttctgcagtagatatctgcaatcttcagccccagggaagctggtaatgtgactcatggcaagtctcaaagctacagagccagggaagccaagggggtaattctcactcccagaccgaaggtctgagaacctgagaggtgggggtcgggggagcactgcctagtgctagaatccaaaggccagagaacctgaagttctgatgtccaaaggcaggagaagaagggtgtcccagctccagaaaagcgagagagaattcacctttctctgcctttttgttctatctgggcccccagctgattgtgtggtgtctgctcacattgacagcagatcttccccactgagtccactaactcacacaccattctcctctggaaacaacctctcggacatacccagaaataccactttaccaggattttaggtatcccttaatccagtcaagttgacaccaaaaattaacgataacagtacccttgtcattatattgggaccacctggacaattcaggctcctctctggatctcaagggcagttgattagcggctgtaattccctatgccatggaacctgctgtagtcacaatttcgaaccattagaatgtggatatctctgcagagccactattctttctatctcagtggctttagccaaggtatccacattttcaaccctcccaactccaacatttcatatccctcttccctacgttaccttttctctttggtacttatcactacctgacatagtatatatcttttgtttatttaatttatttattatctgactccttcattaaaatgcagttcccttaagagcagtgattttcttttttcctgcttatagcacccccagcacctagaacaaataaagagcacgtagtacacattcagtaagtaggtgttgaatgaatgaattagtgaatgaataattgaaccacaacctctgccaactccattttcatacagtgctggcatcatcaacatgaatcttacttttcaccaaactcccttctatccctgggaggggagagggctgcagatacaagcgcacagtgatggaatggctggggagcaattgagcagctgagtgctgcattattgagaaatctttcctttcctttgcgtcagagcagagctggagagctgttgcctggtagaagctcccaagaaagcagccaagaagacagctgttctaaatgcagccacacttggcatgcccagaaccaagagagagaagaccacatccccacactgatcagcagccccgaaatcctcccaaacagcagccttagggacacagccccaaaccccagcacacagctgtctttaacagtcttgcgggtacttatcccagggcaggaggcaggtgtaaccattcagtcaatgttcagaagggattataactgcatgaacaagatagtcatgttccttggaaactgtcactgacagctctcaaggaacatatccaaattcccttatttgcagtattgcaattataaagctgcatttataaatgttagtgtttaaatattaccttaccgtaagtacctagtctctcaggtccctgggaagaataaccaatatgctataaaagctgtatatttccagtgaggcaaggatggataattgcaaagggttcctatgctgggggtcagtctccaagcagccattgtttgccttttgggatatttggtgctttgtttcaccaaacacatcaaaatgctgatgcttttctcatgttcaggaaacacggatgaaagagcaatattgcgtttgacacatttcagtttaatgtaaaccctaatggcatttgcagagggtttatcacacacagaatgtttttgcctacatcatctgtgcctctcagctcctctatggggcagaaagtgaggctttgatttaaccggatccctgcctgcctgtccactgcagctcaggctctcagcccctccctcatactctctttccacgatgtggtggtttccaatgccctgttctcttgcattcacacgtatatttcctctgcctgagataccctccctacctctatcttaggaatcttctctttcacctggctgactcctaattcatctttgtatgtctcaacttaaatatcgattcctcaggcagcccttcctgacacgctttgcccttctttattatgtgcatccagtttggaatccttgtttatcacctgtctctccctccaacagggagcctcaggggagggagctgcaactgctgtgttcaccattgcatcccgagtgccactctccttcctgagcatatagaaggtgcctgataaatactatgtgatacatgcttgaataatgtgccccaggttactacagttatgaaatggataaagcaagatctggtccatttgttttccatcctaccgcatccctattttcaagcattcattccttccacaaacatcagacctattgcttggtaacttgaaagataaataaaataaactcacaggatacagcccagccctctaattgtttatagtctagtggggagcacactaatagttaattttaattgtcaacttagctagggcgtaatattagttgctgcaggtctttcttacctatggttttgtttcctgcagtttcggttacctatggtcaactacagtcagaaaatattaaagagaaaattctagaaataaactattcataagtttcaaattgccattctgagtagcgtgatgaaaccccacactgtcctttgtcccgcctggaacatgaatcatccctttgttcaatggatacacactatctacactatccacccattagtccctgagtagcctggatacacactatctacactatccacccattagtccctgagtagcctggatacacactatctacactatccacccattagtccctgagtagcctgcttggttatcagatcgactgtcgcagtatggcattccaggtgttcaagtaaccattactttaattaataatggtcccaaaatgtaagagtagtgatgctggccattcagatatgtcagagagaggccataaagtatttcttgtaagtgaaaggtaaaagttctcgacttaatgaagaaaaagagtcctgaagtgactaagatctacggtaagaatgaatcttctacctgtgaaattgtgaagaaagataaagaaattcttgctatttttgctgttgtaccttaaactttattataggtatctacatataggttaaaaaaaatggtatatatagaatttggtactattgacagcttccagcctgtggaaactatggattttgggacttggtaacccataaaatcacatgagccaatttcttaaaataaatatgtacatacatgcatacgtacatatacataccccattggtactgtttctctaaagaatcctgactaatatagtgacagacaatagacagtcaatgtctgaggccatttagagtaattctgggccactggccttcatttttagtgccttggctgaactgaaggacaataattcgtcaataagaatctttaaaacttaccataaatttgcttgtacctctctaggtgacacacagcactccgcagatgtttgttaatgattgtggtgtatttccaggcagatgattcctctttcttttgtaaacctctaactactgtgccttagaatttagagatgctgctagaacccacagatgggatatttgaggcaatagcccaatggtcaggacaagttatatataccatagacagagtgaccaatattttttagacatccattgtatcatcaaaatctaattttcaggttatgtgtgtgtgtatatttacatttctctctatatatacagagatacatagagttgttcctcagcatccataggggattggttgtaggacccacagacaccataatcccccatataaaatcgtgtatttgcacatagcctttgtacttttgctcatatattttaaatcatctccagattacttataatacctaatacaatgtaaatgctaaataagtagttgttatactgcattgtttaggaactaatgacaagaaaaaaagtctgtacatattcagtattgacacaaccatccattattttttcaatatttttgacctgtggttggttgaatccacagacgtggaacccccagataagaagggccaactgtacatacatacacacacacacacacacacaaacacacacacacggcggggaatatctatacaattttaacaagtaggtcgtgccaagttttaaagtgtcttctgtgaaacccctgcccccctcttggtaatagtccaatcatattaaacatgtatagagcactttccataagccagaacctaggtaaatacctcaaataaatgtgcttgtttctgctagttaccccactagttagttactattgttataccaatcttgccgatggggagactgaaacaccaagagattaagtcacttgcccaaggtcacccccttattaagtagctggagtttgaaccgcagctgaatttgcatacctagccacaacacacgaggctcccagacacccaaagtccttcatcttgcacatattgtctaatttcttataaactatgtatgtcaatcagagtccacccaggaaaacaaaacccacacctcataatttaatagaggaaatttaatatagcatatgcttataaagatgttggagctggacaaacaatcacaggaagatgaggaagcactaagattagcaattgccactcctggggctagaagaacaaaggcagaaggtgtagggtcacctggtatcagctggaactgtagtggatgtgtctgatgacagctgctgaaaaggctacctgaactacagagaaggcaagaaatacccctccttatttccttaaacatagagtaggttgaataggctccctcaaaattcatattcccctggaaacttagaatgtgaccttatttgggagtagagtctttgcagatgttatcagttaaagatctcagcatgaaatcattctggatttagggtgcaccctaaatctaattactggtgtccttataagaagaggagaggacacagacacatagggtaaaggccatgtgcagatggaggcagagattggagtgatgcagctacaagccaatgagccccaaggattgcaggtgcctgccaccagcagctaggatgagacatggcaggattcttcatgggagccttcagagggagctcggccctgcctactccttgatttcagatttccagcctccagaacagacagcatacattcctgttgttttaagccacccagtctgtggtaccaggatatggcagtcctaagaaatgaacacaacctgcttctctctaatctccctgagtacctccaactggccaaacctcgcctgaagccagttggcaaagacagctgggaaataatgtgcaggggcttgtctcctgccatgcagagctggaaggaagagacagggctaagagcaaagaggcaaataacccaagcattgtggaagggggtgcccaggcaggaagatatggcagagaaattatggctgtagaatcagaggtaaagaacagaacagaaggggccttgaatggtctcttcatgggcctaacggatgcagcagaaatcgtgagcttggctagtctgacagggctgccccagggtaggaaaacagtccaagcacttctcccctgggtgggtcagaaaagcagtcaatgacctccttcccaacagcctcaaaagtgaaatcaggaaagatcactctggaagaaggatggtcccttcaagactggagtgacagctgccgccactctcctctgcctgagaacggagggacaccctgtctccagggttggacgcgataactttcatgagtaatcaatttgcaaacagactgagaaaaggcaacacatcccccggttgcatcttcagataaaaaggagtatgttttgaatttgacaaccaatctacctttaatcctatcaggaaataaacctcaatcataatctgatgttttggacttgcatcgcttctaagggaaagtgtttcctctatcccttgttcttcctcttcagagcagagtgagtttagtcatgtggatgcctgttattcattcttatctgcttcttagtggggattatttgcttttttgttttttttttcttttagattccatatattttttcattatgtgtttcttaattagagagactccttcactcttagataagagtttgttttttaatctccccccacccccatcatctgatgtctttctggtacggatttagccagaggagtaaattactggcggtggggcggcggggaggggagggtgaaaaaacctggctgtggagttgaacatttggtatttatcactgaattctaaatatgggttattatcggagacgttagctactaaaatgccatgtgccattggcctgattactactctttggggcattcattgttatctagtgaccctaagacttccagagaccatgtgacttacttcccaaagaagcttctcagtcccataatacattgagcgcctggctcagtggggctggcctttaaggccatagcatttctcatcacaacagtgttcatcttttgcgtgctgacctagttccaggcttttgtattaagggttacttactttgtttcaaactgtcagagataagtagtattatccccattttctagatgaggaaactgagattcagagaggctaaaattcttggccaagaacacatagctagataatggctgacttggagggcttgaacccagatgaatctggttccaaaacctacacccttctgcatcacctacctctctgtgtaggttttggaaccagattcatctgggttcaaacccccaagtttgccatgtattagctctgtcgatcaataccatttgcaaagagaaacacaaaaacagtgaaaggctttgaacttggtatcttagaagtcatttaagccactgatattcagagaggtaaacaacatagcagttacgagttaatagtacagggttgaagtcagagaaacttgactgaacctcttctctgcccttcaaatagctgtactgccttggatacactgtaggaaccacattctttatcactagttctggatgatttaatgggtttgggtatgagttttctcacctgtaaaagtgggccaaaaggtgggggtgagggttaatgacataataatttaaggtgcatactccagggatagacatagactaggcattctgtagatattattaattaagttatgactcaacaaatatttgagtatacctaataccgtgttaaataaaaagaaaagtaaaatatagcttgccgtagataagaggtgaacgaggccacaagaaaggaaaatttctaatgcaaatataaacactgggatgtgcaaagattcacgataagtgctatagaagcaaaagagtcccttgcaggataggatggtcggagacagaggtgggatttgagctggaccttggaggaccttaaatggttcagatggtgtgacttagtgtgggcgactggttcgcaacaagtaaaggagctctctccaggacataactcaactatttcactgggcatattgtttagttgatctgatacctttttaatgcaaaactttctcaataaagtaagcagtgaattgaacatgctctgcctcaagctctttatcctattatggagacgtaacaagtcatttgcagccaccttcttggaatagtaccgatttagttcaagggtcaacaaactttctgtgaaggacaagatagtgagtattttttaatttgtgggctgtccaactactgagctttgctgtagcacaaaagcagctatagacagtaagaaagcacggatatttagtccacaggtcatagtttgccaaatcctagttaagatgactgagaaagaggagagaaggccttttaaaagcgaaaaaaaaaacaacacaagcaaaggtctgagcaacgcgttgacctagcaactctgaagagacctacatacaaagagtagagggttcaaggccataggatgtcacacaaaaaacatggaattaaaatgttgatggtagacagagcctagattgggagataatcaaatactgctttgtagttcacagccaactctgacaagcaccacctgttcctgagattcgggcaatgagatgccccagaagaatgggtatgagtgtgtagtgaaaagaatcaaatttctccaggagaactgtcagatgaaaagcaaaacaagagcaaaacactgcactgtctacatttgttaggtcctctgttaatatgaaaaggcaggaatcctgggactgaactaagagcttcctgcctggccaggacatacatatgcattgtgcaaagcattttgcatgcaggagacaatcatttattcatcaaatgaacaaattcatcacttcagagcacacaggaccatgcctgatttgtctgtcattaacaaatgactccttgctataaatctggccaagctatctattatccatccatccatccatccatccatccatccatccatccatccatccactcattcatcaagttcctgttgtgattacaaaatttcataccaaagggtcagtgttggggccagaatctccagaaaaaagaggtcagaagcataggagagcaagctcaacctaaaacattcactaaatctgcaaaaaggtgtccttggaactttgccaggatgaacaatggctttcttagggatcctatctggacttgacagggacaccatgtttatgggttttatattcaaagagggatctcgggccttgctgatcccttccctttccacagcgtcctgggattcctcatggtattcttcactccggtactaccccaggaagagaccaaacaaaagtgcaagcctgcatgcaggctgctgcagatgttgcagacatgttgtctttggcctttctttttaggcaaagggaaaaagtccagtgggcactttgtagctgtcctgactgtgcagattagtttttttcaacatcaaaggaccatgtgttattatgctcagttctataatgtgcatttgactggtgttttttttatgtgtatgtggagtggggtaatgaggaaaaggcatatatcttgtaacctggctcatacttattacaaacaggggactcttcctagagtcgatggatggggctatagaggattcaacaaccaccagaaattttgtacaaaatttgaaagacaggctgtatagccttcaccagattctcttgagggtctcagacctcagggagggtaggaatggcagctcccaacggatttgactagcaactaagggaacccactccccaaacctgcttcctgatttcatttcataatgccctaggcctttgctgttgccaagatgcactggcttactgccaaagaagacaggctcttatctgagttagttctgccacctacagcacagagcccagcaaagccattgcatctttgcagcagagaagaagcctcatttgcatacatgaataaggggagggctgcctctccagccccggactctccactggaagaaaaatgactttggggattctcgattagcattcagagatgcaagctcctttggggtgggttacagcgatgggaagatatttttacattaaagggaaagggataaattttgaggattagcacctgaaaaagaaatgttgctgaaaacccagagaggaaagtcactgcaaaaaaggaaaagacaatgagctcatgggtcctcacaataagtgtaactctcccattttatagcatgcccaatgctgatagtcctttctaggtccaaacaggtcacccccaccgtctaccttgtcgtacaatgaaaaatacttgctttggaagaatgtgatttcctaagacaggatagttttgttaatatacttaaagcatttttaaggattccctctaagggcagagattgtgttattctcatttttgtgtccccagcaccgagcagaatgcttgatacttaggaggaagctcaataaatgtttgtttgttgatgtaaagtaatagaaatgtagtttgtattgcaacctatgcatgcttgctaatatataattaataatatctacagattattaaatagtcatgcattagacatattaactcaaattctcacaacagtatataagatgggtattgttttgcaggtgaaactgaaacccagtgtttttaaataacttacccaaggatgcatatctagtgagagtcaaaatccatacctaggctgggcgtggtggctcacgcctgtaatcccagcactttgggaggtcgaggtgggcagatcatgaggtcaggagattgagaccatcctggacacacggtgaaatcccgtctctactaaaaaaaatacaaaaaattagctgggcgtggtggcgggcgcctgtagtctcagctactcaggaggctgaggcaggagaatggtgtgaacccaggaggcagagcttgcggtgagccaagatcacaccactgcactccagcctgggcgacagagcgagactgtctcaaaaaaataaataaataaataaataaataataaaataaataaataaataaataatccatacctagacttcttagcttgtaaatccatgtttgttccactccacccatgtattttatctccagcataagctcatttacaataagtggtaaatgaaccaaatgaaaataatttgaaaatgttgaaaagatttttaactgttttaaatactaaaaaaaatactctaaaatgtttcctagtctttaggatttctctgaagcttttcttaccattcttgcttaataatagatgcagtggtacttctttgagggataacccactcttaaatctacttgcacagatgactgtggaatctttcactccttttggtctggtgagcactgatggcttggaaaggcaatgaagtagtctgtaacttacactttgatttgtagtagcaaagcatctttttttacaatttttattttagattcaggaagtacatgtgcaggtttgtgacacatgcatgttatgtgatgctgaggtttgggcttctattgacaccgtcactcaaatagtgaacatagtacctgataggtagtttttcaaccctccctcctgcttttggagtgcccagtgtcattgttcccatctttgtgcccatatgtacccaatgttcagctctcttttgtaagtgagaatatgcagtatttggttttctggttttgtgttcagtcacttaggataatggactccagctgcatccatgttactacaaagaacatgattttgtacttttttatggctgtgtagtattctatggtgaatgtgtaccacattttctttatccaatccaccactgatgggcacttgggttgattccacgtcttcgctattgtgagtggtactgcaatgaacatatgagtaaaggtgtccttttggtagaaggatttatcttcatttggggatataccctgtagtgggatcagcaaggaattcttaacagagtaatgcacacagagtcttcataatgttggaatatggagttaactctatagtaatcttgcctttttcacaggtttttccatattaacactttagatttcaaaaaggacatcaaagtaagcaagattgaagatccagcattactaacccaggtctcattactttacagcctggtttattagggttggtgtcttggcccctgtgatgtgcatattccttgtgttgttcaggctttaatcttattgtcttccagagaaattacaaatgaaagaaaagtgcagctggcccttaaatggggtgagtggtttaagcaagcttaggtcagtaataggtacaaacaactgaagaacctttctaggtaaacataattatcatgcttagacttaagaaggaaggaagagaacatgagacagttggtggaagtgagaagaggatggatttagaactggacaccactgggggtttgtgcaagtcttgctgtctctattatctgttcgaaagccctggatatataggtaagtggacctcaaattctagtcgtgtttgtcagaattatgtgagggcatagggatacaaaagtgtgattccttttcttacctattataagggtcactcctataacaaaagacaagttaacaagagaaaagtataacatatttattgaatcaaagttttacatgacacaggagccttgagaatgaagacccaaagatacaggaaaaatgattcatttttatgtttaggctcaatgaggaatgcacaactgtgttggactgtgattggacaaagagagtatgacctaatgggaataactgaatagggaaacgcagcaaggcctgtctgttcagattcttctttgtctctccgttcagcattccttcctcctggatatgggacaggatccttgctggaatgtgggtcttatgacctacttccaaagcaggtcacagaatttctttatggtcagctcttatacagaaaggcagggaaaagttagaataatatgtttagattttatgtctacctttggcggggataggttctggtttctatgaccttccttggggaagaggcattctagtttctatggcttgctgtgggggcgaatgagggatggcagagtagggcaggacaaagtaaaagacaaactttgctttatacagaggccttcacttgggggtatcattttctgagccccaacaggggtatacagatttggaaccccacctcaagacccaatgaaacagaagtggcatagccctgaaatctgaatttttaacagtcagcccatttgattctgatggaagtgtttcttagatcacacttcgagaaacgtcagcataggaagatcctccagactttctaagaatcactctttaaatgcatctattcgtttgagttaaactaggaacacagagataaaaggcgtagtctcagccttggaagaattcatggcctagtggtaaaggcagacttagaagcagatggtttcatagcatgaatgagtgagtccatacagcagaaggagctgggtgctatggagaactgaagagaggcacgcagctcagcctgtgtggggagaggtgcacatctgggaggaaggcttaacagaagaagtaactatgtcttcaaggatgagtgagcattttccaagaggaggggagagaagaattccaggtagagatgtgcagtcttcagagatatcaaggctcagagctcagaggaccaaaagcagggtggcctctagggacatgttcaagatgagggattgcataagaggaggggctaataaggaagataggctgatgacgctgaagactgcacatgtctttcataaaaggtgatgctttttcacagaagaaggtgcatggccgatatttatatcattgtaattgcaatagtgattaatgtgcaattccaaattgtggtctctgtcctcataagtacagtattctcaatgcagtggtattctgatgagcttccaattgagaaggaattcggaaaagtccaaggcaatcctaaatggttttatcttcttgttttcctcattaatctttgtcatcagatgtcttagaccaaagtaaggctgaaaaaattctgaccaaaggaaggaacaaggtggctgtatgcagaaccacaaaaaaacctcccacattgaatgaatgttgacatatgttatttacagtatcatcatgcataaaatacagatgagtacatgaataaaaataaaatagtattcaccatccacctttctaagagttaagatcaaaaagtgcctgtagttgccactctgttctccagtttaaaagatggatttcactaccaatctgcataaactagcattgtaactcacagcgtgtggttatacaaacaagaacagaaaccagagtagaaatcgaagcatgctgaaagaagaggggttttttttgtttgtttgtttttgttttgttttgtttgtttttaaccagaaagagttatttgaattcagaatagagctacatatatccaccccattgtctgtacaggtgtgtgtgtacacgtatatgtgtgtgtttgtgtgtgtctgtgtgtgtatccgtgtgaatcacattcagctgtaatatattataaatgataattaagtagatataatcaagtttttgtaatatttatttttcctcacatttatataaagaaaatcaaaaccaggaaaataaaagtattctcaaagctgtctacttgattccagctgttagcattatttattgtaattagtgttatgaagtagtgaaatgccaatgtctttgaacttcttgcagttgtgtgtaatattggagccaatgcaggaactgatgtcgagacataaaacttacaacctcagtccccgagactgcctgaagacctgcttgtttcagaagtggcagaggatggtggctccgccaggtacaccctcattcttcactctctctctaaacacgttttcagaggtgtcttccagggatgaagtgatgtgaaaaagaagaaagtgatcattaatttatcaggacaagtagcttattagggatattctgaccatggttgtggacataaagacaatgaatttgtgacaggcaaacatccttaagaattatctacagtctcctcacttaccagattaggacctgcaactcagagaggtaaaataacgtgttcaaggtcatcaagaaggtcattggcaaagctgagatcagagccaggggttcctgtcttctaatctagtggttcttccactgagccagactgctggcttctcacggcctaatgttttaggtttttgttttttaagaatgacagacattatgaaaaggaaggaagaaagggaagataaggaagaaggaaaggagaaaaaagaagggatggaaagaaggaaggaagaaaggaacagatgaatgaaggaggaaaggatgaaggaaaaatgaagtttgctctgtttttaaagatatattgtatcaaaagttctgatcatgaagagaatatataagcaattccatttccctcacttccctagaatgcagtttagatactatagtctcctgctggggttctgaaatcaccgattcaagtcatcattaattgtcttcctatctaatatactttcactcccaggcgtgtgttgagcctcattcatcataaaagcaaaatgtagccatttgctaaaaattatttttataaaaagtaattattaacacgaggcacatagctttctgaatcacaaaatataatggtcaccttcggctggtaagtggccaggggttttatgtaaaatgaatatagcaaatttaatcaagtacatatttagaaagctgagaaaataagtgttattttatgtagaatagttacatccccatcttatgggaattttagacttttggaatattatttttcaaatatattaaatgtgcttaaattggctttattttttcttttaacgctaataagactttatggagaaaacgtaatccactcagcaagtgctatattttctaacataggcatatataattgatatattattcattaattccttcattcattcaataattatttattgagatttattaggctccagacgtggttctagccactgggagttacaaaactgaataaagcatgcaaaaatattgaatccttaccataactttaaatgtattatctccattttatatagtgcactctgagacttagggtagtaatttgacacagccagtctcatggctaacaaatgaaggaggactgtgtcaccaaaaggtttttatgtctccaaagtctattattttactaccacagccacctactggtaatgggaatagtccagaatacgcattttaggtacacttgccccaatttcatggtcaaagtataaataaaaagagcaccaaatttatactcttaaggtcaaagaaagaagatacttgtcaggagtgggcctgagtatctgctggactttagaatgtcctcctcaaccctttattcaactccatgacctggaacagttctatatcctgttcctctcatccttcagagcaagcaccctgaactcgatggaaggaaatgatagaccatttgatgaaaatctttaagcataagagacaaaatatttagggacgataaaaaaatagtaggtgagtagaaaagtcaaaaagaagtcagggatactcattggactaagtgatctttgaaatgagccttagaggaagatccttcccattgtccaccagaagtggcataggtgtttttttggtgtgattttgtcttgctttgctttgtttttgagacatggtcttgctctgtcacccaggctggactgcagtggcacaatcatagcttactgcagcctcgacttccgggctcaggtgattctcacacctcagcctcaagagtatctgggacccctggtgcgtatcaccacacctggctaatctgtgtatattttgtacagatggggttcaccatgttgcccaagttggtctcgaattcctgggctcaaacaatccacttgcctcgtcctcccaaaatgctaggattattgccatgagccatggcacccgtccagcataggtgttttaagaaaatgctacaaggccctcttatttggttccagtgtagccctgagttgccttctctccatcacagtcaggtctaaaatagagctggcaaaaaggatgctcttacttgccatttccaacttattcagtaactggcaggagaaggcttctgaaactttctcatttatgaaacaaagattacaataatagttcctaactaataggattttttgaatataaaatagtgcattggaaacattaagaatagtgacaagcattacataatgttctataccttataagtaaacaaacaaataaataaagaatatttctcttatcacactttaccttgggtctctatatttctattaaagggttgccccatccttcaagtccaaaatatttttctctgtttctgaataggcctttctttaagaggtctagtttcccctcagtaatatgctggctataccatgtactcagacatatttttttctagcaattttggaattagtagcatttattaaacagcagggcccaaaccatgggtattccttctgaacttgggaatccctaagctccacatccacagctgatggaactgactttacttgagaattctataaaggtataatagaggtgggttgcaatatgacatttcaccagtagatgctgctgttgcacactggctcatgaatttggctatttaaagttcatacttcactcgtaccttggagttagttaccctagggatcccaggagtcctctctctgttttaaagagaagatacaccagaggaaaaaagtttcccaaattttctaatggcaaaatattttaaatccaattatgaaagtggtacttgtagttacatacctaaaaaatatttttacaaaattaaatacataccattagagagaatgattaaataaaaattatttgatctacacacaaagaaaagagtgtcacatattttgtgctaaaaacacatctacagttttctccttttattctttctaaagctataagaaatggaaaatgtttaaatagtctactcttcagtttaccaagacagcttccttagagtaaccatactgatgattgccttgttgcttttgccctagaactgatccctcttcccttttccatattgcagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgtaagtctcgctttcctcttaggcccgaaatcctaactgtctgcttcctactcaaagggcccaaattaaagtctcttttcattagaaaaaaaaaaaaaatcctgggcaggttggaggtgggggagggataaaagacagggacagaggttgggatgggagggaggaactctgccatggaaaccttcccctgcaaactgggaattagaaaggaatattaagagtcgtgctgcaatgggacctgaattaaaaagccatcagagtcacagacaggagatatgtcacttaaggtttaattaaaatatcacttagcagcatgcctggtggcgtattaaggcctctcagcaccatcattggagaccctgtgctccactggaaactagctcccagcggctcagtcccatattgtaatttgactgggccttcccaacatgggcgtcccctcttattttaagactcaggtaattaaccagcagccactaaacatgtagctcagtgaagctctcgcttagcccattgcattagctaagggggaggatcagcctctggtttggtctcaactctctcgaacccttggcccctttctttcatttctttatcttgacaaagaccattaggaaggggacttctttgaattccaaagctgacagctgagggtaatcccatatagtgaaaactgcacaggaactttcttcatcttttattcattcttcttgaattctgtcccttctgcctaattccctcccatctcctaactccccagccccttattagactatctcctttaagtactttgctcctttaaagtgcttctgttccttctctgctgtccctgtcataccaccctatcaccaggtgtttggccatcattcaaatcctgagattttcttagtgcttcatggataccttttagatactctgttttccaaagttgccctatttcttgttacatccctcaaccagtacaattttaccttttccgtctttcccacgtttttccccctcacccttcttgctctcatccttacccttattgttctgatcctgctccatcgcttccatgtgcgagtggaccttcgcacagggattccccacttacttccaagtgtgtctttcacatctgcccccacctacttgtatctactttccactggtcagttctctttggccaaaaccaaccccatcagtaccctgaggattccttgggccattgtttctcttctcctgtctcccacagacagggggtatacttttcattcccactgcattagaaagaaggggtcatggggagaatgaccagcctaaaatggaaggtgccatgttacattttacaaggttacaaattgcagtcttcaaataatgaaaatagtctccaggtggtcctccactttctgagctaggctttatacctaatacctctgaagatcagggggaaaaagccaaaagagggaaataaagagtctctttattaaaaaagtatcaagttatgcccacttctggtgaaattttgaatagagaaaatggcctgatttagataaatcaactgaaaaagtgtacacaggagcccatttctttatccaatcctggagttaaaggcagtaacattcgttagtttcctctagcaaataagaaaaagtgcatctcagaggattctgaaacggtgatatagctacttaaaggcactgtagctgcaagaatcccaatcagttcaacagatgttttctgagctcctactatgtgcccacactgtgccaggtactagcaataccaaggtgaaaaacaacaacaacaaagccctgtcattgaagagctcactgtctaatctagggatggcaaggacattttctctctcctgccagccctcagagtatggtattgaggaggattctaaggtctagtctgggtttggtgggccatccattagtgatgtctgacatggttgtagaagttgagagtagcagcttacatgtcatatgttttgacacatatggtctagtcagaatcatttcaatttcatttgaaagaggatatagcttctgtactctgttatgctcctgtcttccaaatcaacaactgtattttactggaggttacctgtatccagagggtttgtaacaagtagagaccctttgcattttgtgtgattaagagcaaggcaccgttaggaaatgagagttggattccatcactatctccacactatgcagttaaagatgttttaataaagtaaaattgtcagatgttacagagaggcagaaagaacaaccagattaggaaaatgtacaaattcatatgtgtcctggagttgaatggacattaaatgataagcgttggatgacttgtggtgaccatatcttttaaccctgtctactgagttatcaacactattctactggttaactagagatgctacctgcaggcatccactgtctggtccaaaggcatgtgccactatgaccacagctgtggtctgtgtagctgctgcggcagcgatgtgtgtgtctggcgagggctagggtttaatccttggattctgcttctcactccatgagcaggggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggttggtggtctttgcacgggggattagtgagaagatgtgaaatgggtgagagctggtggcacctccgggcttccagcaaggagcagaagttggccttgtggggagctgagggcatatggacctctctcagatggctcgctgttgtctctcgtggacacacaggatagagatgggaaggaaatgtactctcactgccaatgttggggggatttttaacaaaatgggggggaaatgttgctaacaacccctaatcagaggcagcctagaatgtgcatcatgctttatttattttgtgtgagaataacaaatcaagactgccagagcagataatcactatcctagtctagaggcttagaagaaccaatagaaacatgcacataaatttttaagtggccttaactgtctatgtgcatatgaagcccttaacttgccatttgtcaattatgcacgcacacaaacacatacacacacacacacacgctctctctctctcacacacacacacaactaagtatctagctagggatattttatataattagtaaaacatatgtggcatccctttgaaatttagtacatttaaaaacacctatgcctagacatcttttccagctgctcctagaacaaagattcaccgaacagattacaagcctgttggctccattggaaatgattcaaaccactatgttcatagtacttttcttcaatgattgttgttttctaattcaatgaatgcatttggagtgttgagagcttttcttttaatatcatgcttaagttggctgctttttattttcctcctcctctttcaaattatgcttcctcatactctcccatcctctctcaatgactttggagtcacgatactaatgcagacccacttggttggttaacatccttctcctgccctgtgacgccttacgcatgtgttttccaagcccttcaagtgtgctggacacaagtcatgaaatgagattaaccctcaggtcatgctctgtacaacctagccctattctttccatctccctttgttcttgatcataagtgtcatctcctaattgcctataactcagtggcactcttttatcctgaacatccccaaacaggtaacactgcagctgcccagctaactgaataccattcatgcctctgtggtggccacactccatctaaaatcctgtcatcctttctgccagtcagaaggacggtatctactttgcatctcaccttaacagtcttcatgagtctcgttccatgtcactgtcatttctggttcttcattgcataataaataaataaatcttggaagcacagagatgaatatcccctggcatttttattgctgggtttaccaagctcacattttaggcacttacttactccatttgggacatttctttttaaaatcatttttatctattcacaagaatgattagtcagaaaacatagtttggaaacctattaattatctcccctaactcaagaatggtggggagcagaaataaataaaacaaggttttccattgtaaaagactagggggtaactaagggatttgttcaatggacactttcaaaatcccactggtccttctcctgacagtaggcagtattccattctactgtcccaggaaggccttctctgggcaaagctctagtaaaatgaatttctgcccagttgtcaaaatattttattgaattagcctttctactggaaaccccaccctctcatctccaaaagcatctggctagccctaccttctctggcctcagtggaggctgatcacagttggtcactttcctgaagttactgcacttttaagtggagtattgctcagagcctgcccagaagaatccacctgacagatgtcctgtcccatgccaaggtccctcatcaaccccatatggtcccctttgaacaaagaagctggagctctgccctgtgtatgcattcttcttccccatccctggcctctccagctgtggcctccccatgctcccagctacagtaggtggcttacttatttgcatggaaggacaatttgtacttaaaagagtgattagatggattcttcttgcacgcttccatctctgatgactaccagcttcatcaatgtaattataattagcgttcttcatcttccctttatggcaccagctggacagaccggttctctttactgcccagatgggtggcagggttgcctgtgtggtgataggtgacaggcaccatgaaataacagatggtaaattcaaggcttgttggcaatcagcaggtttttgctaatgacttaattagctatgcaaattgtcaaatcagtgtgaacattgtttttatcgaaaactttacctaaattaattaccataattaagtagcagaatgtcaaggatattggctgcataaaagggcctggctgagtagagaaaagagagattctgtcttcaattaaaatgtatatcatccctgggacagagaaaataccgtttggaatgagttgtgtgaatattgcagaattgcaccttacgtgtgtctccggtcactgctagtttccaaagccactcacaggccctaaataaaagtggcagatttttggaggtattgagaagcacccagcagaaggttccacagccctctcaaaagtccccaatgtcggcaagttgaaagcatggatttttttaattttgaaaaatacatttttttatttctgcagattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgacca

SEQ ID NO: 36869 - DNA, 27607 bp, Homo sapiens
tggagcgccgttcgccggtatgtgcgcatgcgttgaggtctcttgacgccgattggggggtcacgagtcacgggcggcgtgcggcggctggtgggggcgtgtccggcggagcgggcgcggcgttacgaggccgctggttggccagcgctagtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttgggtgagaaccgggctgaggggtcggccgggacctaggctgagaggacgaaggagtcacgctcggaggtggcgggttagggcacgcagagctcgggccgaggggacggagaggaacctgcaataaggtgacatggcctgaggcggcagaggggacgcaggctgagggccaagagcctgggccggggcaacacggtttgaggagagacggtctgacatggcggaagggatttgggctgaggacacacggaccgaggcgacactatcttgaggcgaggaaggggacccaggccgaagacaggccagcgggcgggggagaacctggaccgagggagtacgtcctgaagccttggaggggaccggcctggggggacggagggagtccgggagagaagccaggtccagaggcttttcggagctctaggggagtctgtttgaaggctctcaggcggcagtgatggggcctggggctgaggacgcctgcccgagggactgaccttttcaacccctggagcagtggatttgcgtgggccctgggcggtgagggtgaaggctgaagggggctgacaccaggcagaggggctcagggctagatgatcctaggagcggtgagccgcgtctgaagtgtggggggtgcatggggtgagtacggccctggttagcagtgactagtttaaggacagctgaacggaggaacccgggatgatggagtcaagactgtggaggtctcagcactttgggaggccgaggtgggcagattatctgaggcggggagttcgagaccagcctggacaacatggtgaaaccccgtctctactaaaaatacaaaagttatctgggcctggtggcgggtacctgtaatcccagctactcgggaggctggggcaggagaatcacttgaacccggaggtagaggttgcagtgagccgagatcgagccactgcactacagcctgggggacagagcgagactctgtctcaaaaaaaaaaaaaaaaaaaaagaaagaaagaaagaaaaaagcctgaggaggcctgggttgaggctggagactcctgggtgggggaatgcgtggtggtggcttggccaaggagatggagggataacagggagagacagggggactgagagaaccaaaacgggggatcaaattcctgctgtgtgatcctcgagtaatagggatgacagagacatgctgagaagagggatgggaaaaggcctgggagacagaactaacacatatgacgtggcataaaactcacgttagctcctaaaagctgacacgaccatcctgtgataaattgtagtggcttagaagtgccaagagcccaagtagctctgccacttacttcatgactttgggtaaattgtttagtctccctgctaaaggagatcacaaatcaaacctacctcccatttgctatgagtgttagaattgagcctggcgtggagttacatctctgagagtgttagctgttgttaatgtgacttccagaaggaaacaggttcggagcgtgcagagagctgatgggggttcaaggtggacgcccgagcggagaggtctgggaggggtcaggagagggagagactgagaaacatgagtgtgctaagaggagctgaaagggaacagaaaagggatccacgaagacttagtagggttgagaggagcatgaggctctgggcagaggaaggagaagggagtttggcagggggcggtggtgtgggaggtggtgggatctgtgctgatgggacgacccgaaagggtcaaggggaggttgtggaaactgagaggagacctgggaaaggactagtgggcttgtagagagaacagtgtgtggtggccactcagaagcagagcctggggacggtggtgggactgggaacatctgcagaaggctggagaagggggtttgggaggagggcctggggatgggaagagactgtggtaggagcctggcagaggctggtaagacacgaaggagagggatctttacaagagaggaaggaacaggaaaagggctctaggccacgccccttgtttgaggttggataatgtttagcaaaataacttgaagaacatgatggcgaattgcctggtgtggagaaacatccggggctgatggactggattgattaggtgaaaaatgttttattttagaggctgcgaggagagagagggtgtgtgtgtgtttctttttcttcacaaggggagaagttcaagtgctgtgtttgggggtggggccacgagctgggtttttggtgatagttttcctgggtggctctgggtgtctggtccctttggcccagggattagtgggctgttggactgtgtgcttggagggagcagctaagtcagccccaaggcatttgctacctgattgggaaggcaggatgaacagcaaacaccaataaagtggaattacctactgtaaggaggggctcgatgatgtcattcctgtgactgtctgagctcagaggaagcagcgtgaaccagggggaggctcttggtgaggagtgagctgggccccaaggaatcccaggacttgctggggagtggggccggggagggtgctctaggcagcagggatggtgcaacagagatctaccgtgacgggaggttctgcctggaaagacagggaactgagatccagagggatcagaaatggcttcctgggggagaggccccaaccctggggggatgaacatgagttctggggtgctctctggcagggagcagcactccaggcaaggattattatggagcatgccttaggaagatggaacacagggagttccacgttagaccataaaggtggaagcggcaggtgaggccagacaaggaaggtctggtgagcaagggctgggcctggaggaggcactgaagatctccgaggaggctaagggaggcccatcctggcgagctcctgtttgccttctagaaaggactgcagcagctggtgtgggggagagtgacagcaggaggctgttgcagtgccggtaatactagcagatgctggttattaagtgctcgctctgactcagaccctggcctgggccaggctcaacctgctgatggatggtatggatttagtccttacaaaatccccgtggaggtagagaaacttgggggcttagagaagttgacttatttgcccagccccacagtaagtgggagaagtggcattcaaacccagttctgtgtgattccagagccttctcacttagcccctttgctgtgctaccacggtagtttctcctcaaggttcatgaccatctctgggcactacatttaggaaggatgttggcaaactaggtgtgttggagagctgccaccctcttaactgtcctcccatggctgttttctccaaatatgtgaaaaaaagagctggtgtgttcatctcagttccttccagctcccagaggagctgacctggtgctgtgggagtatgagtgaggttagggcagagggcagggaggatgggaggctggcctgaccggagcttgtgtgcctgggagctgggagcacagccagaggccagcttgggaggacctgcttggcgggcgggaatcactcaggcacctcctcctctctgatctgggtttgcttgtgttcaacatttcataacccacctttattcaaggtccttggtagctgccgggactggagaagggagcgttgcggctcagcttgtccttggtgcctctcccttcccctttgggaaccccagcaatgacagcatcccacattgaggggcctctgcccctgtcaaagggcaagtcagagagcccgcacctgggacgcaaggcgatgggtgtctgtgctgtcgcctgccttggtgctcagatgccacccttgctcttcattatttctgggctgccagacgctagggggctttgatgcaccagcagccactgaaggcgacagcaccagccagttaggagaagctcaaagccatacctgttcctccccttggtgatgggggcgcagctcaaacttctgctctggaagcaaaaagacggagacttcctaactacagcacagtgagccagcagcagaaggggatggctgagtccaggcacactagttcctcctccctgctgcgtgtctcctggggaatccagagtgcctgctgtgccgtttggggatcctgcaggttctgaatggcggctctgttccctggggcttttcctcatccctgatgtttcccagccacctcccctgtccccaaaatagccaaaataaaaacttccttcctcttggatacaaacgtgtagagggagtttcttcatctgtgaaatgaaaatcatggtaactgtttcctcaggtggttttaaggataaatgagacgatgtgtgggaagtggtgggagcacgttgcctggctctgctaatgtttattaagggctcactgtcatctttattagtaggtattgtcattggaagttgagctagaagtgctggagaaataggtggcagagggtgttctgtatacaaacagtgcattcctaagatcagatcttgacaaatcagttcctgtttgaactacctgtaggcaataacggcgggaccctgggagggccagcttgtctgtacagggcctgcccagggccttggctgagactggtgtgggcacgagcttccagatttctctccagaccgccttcctctgcagagcgtgcagaaaccccggcgccatttccagtgggcaccctggtgaatcacagtgccctgccagctgccaagatccacaactgaaaacttggcatctcttgcccagtctcagagtggagtctttcctgagggcacacaaggtttctggggaatccgagagttcctggctttcctgatggataggactttgctgcctggccatacaaacatttccgtctcctttttgggatggggctactgagaggcaagggtctttgagaacaccttttaagaaaaaggaagtacattcgcccttggtctgtggtgaaatgtaatcccgttggggtgcaggagggcatccgtataagaaaataagaaacagggcgcctgccaggctgtgtgccgtgtggcaggtgagatcctggctctgagctcatctcgaagggccgtgggcctgtatgtattttgagcattgtgcagtaaggggtggggcatgggaggccaggactctggaagccgaaggaggagcattacttagctaatctgggatggagatgaagcccatgctgctattctgaagtagggaagcgtgcctggaatcggtcctctgcggggcctgatgagagggatgctctcgtttactgaacgcccgtggtgtggccagctctctgctgggcacgccgtggggtgctgcctgcaagattgctcgtgcttcagcagccctgcaaggtgtggagtcttatgcctagttacacataaggaaacgcaggctggcacacgatgagctggcgctgaggccaggcctgtctgactactgtcagcatttattttattttattttattttatttattttattttattttattttattttattttattttattttattttattttattttatttttaccaccacaagaaactctctagaattcccattcctgggtggcaggcacccctttgagcgtatttctcttcctttgtgtaatagcaaccattgagcaccttttccattctgcgctctgtgccaagtattgactatgtgtcatttctaatcctcacaaagactcctcccaggccagattcattgtctccattttatttcatttttcattttttgagagacagggtcttgttctgttgcccaggctggagggcagtggcgcgatcatagctcattgcagtctcaacctcctgggctcaagtgatcctctcacctcagcttcccaagtagctgggactgtaggcatatgccaccatgcctggctaatttttagtagagttggggtctcactgtgttgcccaggctggtctcaaactcgagatcaagcaaccctcctgcttcggcctcccaaagccctgggattgtaggtgtgagccactgtggccagacatgctgccattttgtagataaagaatggaatctcagcactttgggagcagaggcaggaggattgcttgagcccaggagttcgagaccagtgtaggcaacacagggagaccccatctcttatttaaaaaaaaaaagcctcagggataactagccccaggtcgaacacttagcaaagtacctgaaacggacttcagcccaggtctcgccaccccaaagtcattctctttctaccccttgtctttgcccagacaggcatgtcacaagagggtcctgtggcgatttcagagctgggcagttagcctgtgacactttattctttcaccgttgttaactggggcttgtggagagatgggaaagcagagctgggctcaggccccgccctgcaggaactcatactctgcttggtcaggcaaggcccactgcagagtggcgggaggcagctggtggtttcccgcttccaggtgatactggtggcggtgccttcaggatgctgagcctctggcagctcccagctccagtgcagtcagtggactagcagggctggtggcccccggctccctgtgccagggtggaccctgcaccacaggcagccttaactttttctgacgttccttctgcctgttggcttgttactggcaggctcggtagggggctggcttaattcatactcctttgcctagaggatgctccacgcagccccagcagagagcagcctctgctcgtgagatgagggaagcctaggcagtacaggctccctggcttctttaatctagaggaggggtgggggcaggcagggaccttgtcctccctccttattttcccaaggagccttgggcatggggaaggaagccttcctgatcactgagtgagaggcaagggcaggactggatccccagggccccagtcctctttccaagccctgctgcttcctggcagggtaagcttggacaagccctccgccctctctgagccccagcttcctcgcctgtaaagcaagggcagcacccaaagggctctcgtgaggagctgtgggctccttccaggggagtgcctgggaggcagggaacgccatgcgccagccgtgattaaggcacatggtctcgagagccgtgcaggaggtgggcttacagggaagacacaggcatgtgacgggccctaggacaccttccccactgagggtgctgactggagacttggggcagtgggccttaagtctgaggaggaaaccgtaggcctgtggctgtggcttccacagaggcaagagagatagagtgagtccaggacccgaaatgggggcctgactttgtccaccctgcctcgtgaggtccttcgggagctgcaggtggtgggtctcagggcatggtgtatttctggcagccaggaagtgcctggtggatggaggaaggaaggagggggctaagactctgccctgcacaaccccctggcccaggtcccatcaggcatctgtgtattcctggcagtgcccagccttccatatggcagtccctgaggttggtggctgtgtttgggagacctgagactccttcctccgccttggagggggagagagcaaagctgagcgggtaattatagacagccctgcatcaggcagcccaaaccagttccctctattcccggagtggctcagagccgtgggatgggaggagtgaagcagaggcagcttgggggaggtcagtgggggagggacagtcagctgtcacatgcgctgccacccaggccctcaggagaggaggcccagctagattttcctttcgtgtactgttgttatctcctggcacgtaataaatgctcggatacctgttccccaggtgaataaatgtgtatgtgaatggcttcttcaggatcttccactggaacctaggcacgtcactttccccctttggggacttcactcccatttctaaaagaagaggatgggaccctggagatctcctgtcatcccctggccatggtaatgggcaagaccgcggggtgcaggggaagaaggaggcaagcctggggcctgagcaggtgttaatccctctggcctttccaccccacagaatcattgaccccgtgcagggttggctgtgcttagcctgggatcacagagtttcagcccgggcagctggtaggctttgtgtccgtcctgaaataaacccggctgggctgactctgctcattgttgattgcccgctgtgggccactcagtgacgtgggtcatttctgcccatccagggtctgtgctttttcagagagtgcatggagctggataggacttagtcacactcaaaaagaagggaaggctgagctgggggacctgtggggtgggcagacctgtgattaaggtctgaaaatgtccctttaagagaacattccagagaaggtccttctgagggttttttgcagccaggccccaaaggacccttcaggattctcagccagaaggttttgaaagtttcttacctctccaaggccaggaatgggttctaaagaagtcattccaggctgggcacggtggctcatgcctgtaatcccagcactttgggaggccgaggcgagtggaccacttgaggtcaggagttcgagaccagcctggccaacgtggtgaaaccctgtctctactaataatacaaaaattagtagggtgtgatggcacacatctgtaatcccagctactcaggaggctgaggcaggagaattgcttgaacccgggagttggaggttgcagtaagctgagatcgtgccactgtactccagcctgggcgacaagagcgaaactccatctcaaaaaaaaaaaaaaaaaaaagaagtcactccaaacaaggcccaaggtgtgttgggctggctgaggtgaggtgggtgagggaagacagagtgcagcagggcgagtgcgggaagaacacattgctcagggccacttcccagggacagcagagggtgggggacagcatcagcacagccccagaaggcagagggtaggcttttcatctggcaagatgacagagaggataggaataaatagattatttacctggtgtgatgtggattcaggaggccaggatccctggcccaaccagcccgcccaccgtgggggcatttatttgcctgctgacattgccaggcctggccgctgatctgatcgctggtggctgctttccaggtagtcggtctcagtcaatttttccttctcaaactcacctgatcagctgaattacctgggccccccaaaccccaattgttaaaaatctcatttgcaggccccatccagaccctactgagcgaatcccaaagtgtgtggctgtgggactctggtttgatgaaatgagcacttcatgtggctgaaagggatgggcaggttggacacactgaatccgcagtgcagagggaaggaatgctcacatcccagctcccaaaattacctttgagcccctccacagctggggttggtgtggacaagttcccaggtataatgttgggccagttgacacagggtgtgggatgggatggtgaggatgatttgaatgggaaagtacccactcctcccttttctcttccttaaaaataaactaaacactagttatgccagtgaagagaggccctgaaatccatttggtgggactccagagtgtgtggattttattctactgattatgtagatattgggagtttgagcagttacagagactacagacctcgcgggctaagcctggttgtattattaagggcagaagaatgcagtgggacttacgggtttgaggtactaatgaggtcccccaagtcaagaggaggctcattatgtacatgtggaggtcaagaagccagagtgaagctgcccaaacagggtaccctttatgttttcaaattcctgtctatctcccagtgtatccctactgttggacaataagtttttggggggttttgctgttttaaataatgctatgctgaacatccttgtaacttttctgattagtttttttaggataaattgctagagatgtaattcattgctggaccacagggccaaatataaatcctaatacttaaaaatatgtgtgtgtgtgtgtctgtgtatgtgtaaatgtatagatatatacacacatatatacacatacacatatatacacatgtgtatatatgtacacgtgtgtgtatatatgtatatattttttttctcgaaaagatgtacaaacagttaaaaaaaaattcagacagtacaaatacgggatgtccagtgaataagtctgcctcccacacctggccctccttctgcaggcttcaccttaagagaaaaatgctgttactaggtttttgtgtatttgcccagaaatatcctatgtttatataaacatgtatgtttctattattttcactctctttctctttttttttttttttttttttttgagacaaggtctggctctgtcgtcgtccaggctggagttcaatggtgtgatcttggcttactgcaacctctgcctcccaggctcaagtgatcctcccacatcagcctctctagtagctaggactacaggcgtgcaccatcacaccctgctaattttttgtattttttgtagagttggggttttgccgtgtggcccaggctggtctcgaactcttgagctcaagcaatccgccaaccttggcctcccaaagtgttgggattacaggagccatgaaccaccacacccagcccaccctcttttttttttaaacacaaatgggaacatcttatatctacactttaaaatagtgcttcccatttctttgtatggctgtgtgatatatatgcccagtcctgagctggtaatgacacactccagggctgcaaggtctttattgagcaaccacagagtgcaaggcacaggattaaggctgcctctgcgaaagcaacacgatgtcttaaactgggctagtcccccagaatgctttgcagtctcccggggaaaggggatttgtagcgcgcctgggacccagtgggcccctagtatcccaggcaggaagtagaagaggctgtcagaccctggggttgtggtggggtcaggaactcttcgccccactaccccagcaagcacccagtatctaccccagtactcccggagggagctggtctgcccgaagtgagtgtgccattgtatgcaggggcgggggccacagactcaagaggcctgggggaagctggcttcacaggtgaagggtgaggggtaggggcacgtctgtgcccggcactggagcagaatgcttgctttctcctggatagccgactagattgtctcctttttttctttcctttttccccagaggctcatccaaaatagaggaagcatgcgaaatctacgccagagcagcaaacatgttcaaaatggccaaaaactggagtggtatgtcatctccgctagagctcctccaaggtgctctcctcctccctcagcttccactcacacaggcctgcccgagaggttggccttgagggccctttctctttgtatgccctctccggcatcggaaagccactggcctgctctcttgttttgtgcctgctgggttactttatactctgggtcatggggccttggtgaaaggacagagaggatgggaataaatagattattagacctagataaacccatgtggattgatgagctcttagagtcctccttaaattcagaacttcaggtttcctggtaacttccttagtgcttccatcagtgtctaaattctaggctgggggaggatgttcaggtgattccaataacaacgtgaatcatggctgctgtttgttgagtcctaagtgctcatcatttaattgcgttagcacagcagccctaagggtcagtctataaatatccctattttacagatttggaaactgaggcttggcttagtctcttgcccaggatgccagaactagtaagtgacagaaccaagattcagaaaccaaggctctgactgcagagcctgagtgtttaacctgccccagtgaggcaggatagcttcacagaggagaggggtggggaggagccccttgggctcagggaggctggagatctgtttggagctccctgcaggcccaagaagtccaacaagccagtgtgttgagccctttcgaggctcatttcatcatacatctttcatgtcaccaagattgaattaaggaaatacggcaagagacccagtgtttgaatgcagggaggaacttctgactgtggaggagagggaacctggtggtgggaccatggaggcagggtgcagaggtgcacaataaaattgattatcatcgtttttgagaatgttgttggtttccccaaaattcaaagagttattcctgagttttcacaaaatacgttgtgaataaagccaaatgttttttgtatttttatgctcccaaacttagaaaattcctctagagaaaaaaagcttattttttaattacataggtgttgcttttcccctaaaatttgttacctctgcccccaaactcttcaaagaaaagccctaggccatttccccccggtaatatccccttttcttgaaatttttttttttttttttttttttttttttttgagacagtcttgctctgttgccaggctggagtgcagtggcgcgatcttggctcactgcaacctccgcctccctggttcaagtgattctcctgcctcagcctcttgactagctgggattacaggcacgtgccactacgcccagcttatttttgtatttttagtagagacagagttttaccatgttgtccaggatggtctccatctcctgatctcgtgatccgcccacctcggcctcccaaagtgctgggattacaggcatgagccaccgcgcctggccgtaattttatactcaaatttggaactcttgaaaataatgaaatcatatagtgaaaacccggaaggctttgtcttttctgctgctcaaaacttaagaggatagggccaggcctcctggtcctcttccagcttagaaactctgactcagattcagctggaggagaatgaaggggagaagcctcagagctgagctggaggtggtcagctgcacgaggaggaggagagatgctgctgcctcccaaacgtcagttaggagatgtgtgggcagaatggcttgggacccacagaagctgaccgtgtgcagatgagcacaggatggatgaggcttcaggcacggtctcttctgccctccgcccatgggcactggtctgcatgtattcattcttgctgtccacatcctgtttccctctctggacatgcagctcctggagggagccggctctgtgttgtccgaccccaactccatgagcctcacaattcatgcaagtgccttgtccatggggatctgcagtgaagggaacagaatgtgaacagaggcagaggagttgggagaatcaggaagagctttggggagctgtggaaaaagaaacaggacttggaaaggggagtagatgggaagatgttatgtggtttaatctcagttgccccttgcttcccaaaatacccctccgaagccaccccatgatttcagcctgtactttgccttctagtggtggttctgggccctgtgcttcgaggctcccctggggaggactgcccaggccgggaggtgcaggaggccacctcactctgttttatatcctttccaactcagctctatctgccttctccttggatctttagaagtggtggccctggaaatgctggcatagctgggattagggacatggtgttttacctgggcttaccctggctctctttccatatacctggggctcagggccttcccccgaggcagcttcctgccgccctcagagactgtcaggtgggccaccaggagcctcagcgcaggagccagcagacctgagcgcaggagccaggagacctgagttctaggcctcggtctgggctcgctcaggtcaccctcgtcctgtcttggggactctttccgcattctcgagagcccgacccacctcccagggcagtgtctctgtggcttcataaagtgtggagccccactgaggccaggactgcccttctcttctgttccagctgctggaaacgcgttctgccaggctgcacagctgcacctgcagctccagagcaagcacgacgcagccacctgctttgtggacgctggcaacgcattcaagaaagccgacccccaaggtgagggcctctgcgggccacacgggctggctgtccggagcgccatcctagcaccctgcattgattcctcaggtttcctggcggctctggtttttccagtggccgacatgtgataggctggcaggggcgtgcctgaggcagagtgagcgttgactttagaactggctctcttccttccagttggcattcgcgccctgctcaagtctccgcccccctatctaccgtgtcggtggtgtcggtgcagctgatcaccccttcccaatcccggagcatttgggagtgggagttccattgcagacccaccgcctgccggggagagaggaaaatctgttctgttgtcagaattaacatgcagaagggagcggtgtggggggcggggaggattctgagaccagccaggtaggagttgctgccgaaaaaggagcggaaattagcccaacctggcttccctacatcctggggaggaattagagagaacagagcccgagatgtagttgccagagaacaaattacttaaaatgagagcgtgctagggacagaaacccagtttggggctgactcatggtgagaaaacagttttgtccccctgggtgcctcccgaagaggaggtccagcccagtgtttgcttgcatgtggcgggaattttaatttattttttaaaatgttggtgccaggtacaggttgctaattagaaagcacaggcagtttttaaaaatgaccatctattgtcactgtcatctcaggggaatggaaaatatatgaatctttaaaaaataaaaagcagctatataatcttggaataaaagcctgtccttcccaagagaagacaggtttgcagcagtgcagggagcttcctccatggatcagtgagcactggttcacatggcgtgtttgagaactgctggcatacccctttgtcgtgatctgacgtgttagttcccagatgaggatgaatttgtgttgaccagtagctcttctctgtccttagactgaccagttgctcctcagcagctgggcatctcatgcgttggcctcagtggtcacatggtggggctcaggcctggcaagaggccgaggagcagccttgtaactgggtgggccatggggcttgcctggctggtagcactgggccacagcaggctgcgtggttgatgcagtgatgacccagggagaccctgggttggttttaagcttgattcaccacatggagtctccatgccttccattaaactgccccgccaagcctttccttctgctccctgggaaactggttggcctagaggtgctgtcttagcatctgtgacgttcagctgctgccccatctggagtgactggaaggacactctggggcaacactgagcgccaggctgccgaacagagagtgccatttgctctttcagcagacccctcacttcctgcagacaggccctgcctggcagtgggatatggtggggtccctcccctgcgtttgatctgagcttttctagctctccagcgagactctgcagggtgtgggcctggagtctggatgtggcccctccctggccttaggaagctcagaaggtggctgaggactccgaccggtaggaaagtataaagatgatgttacatccagggcacagaggccaacttgcacagagctgaggctgggggcgtgaatttggctatgggagatctttcaaggaagaaagggggcagttctgaaaggagagcctcacctgggtagagctgagagcaggtgccgtgtccagagccctggggacgtggtgttgagcagggaagggtgttagtgcagcttccagagctacagcctaaagatacgcacgccagccatgactcccagtggggcaaggggcacattggcatcaagggcagtggctgctttgtgtctgaggctagtcaggcctcacacaaggccaggtgcagtggctcatgcctgtaatttcagtgctttgggaggctgaggcaggaggatcgctcaagcccaggagttcaagaccagtctggacaacatagtgagatcctgtccccaaaaaaaagcctcacagagaatgtcatgtagcaactgtgtgtggctcagcagcgcaggtggtgggtggtctgggaggaccctgcctcccctgtgatcctgggcaagtcagtcttttgggcctctgtttcctcgtctgttaaagcagagactgctgtgagatgatgcagtcatgcccagcgcggcacctggtgtgtgataaacttccagtcaggacacccttggctttcatcagtccaggggcccctgcctgccctgggctccccacagcctctgcccttggccgggtgccttgtgagacagcgctggaggcccgatttggaaccttgcctggcttccccaagcaggtggccggtaccctggggccgtcctcatcactggtctcctcagcagcctagaaggcctctgtcttgggtcagcacttctagggcttcctccaggactccctccagaaggacctgcccccaagtggcagctggagtgtgcctgaggcccgactgggctcccgaattcctctccctctcgcagagggtggcctgctgccaccttggtggctctgggtggggaagggtgatgctcatatgtgttattggttcctcagttacccaaccatggctgctgctcagggcagactcgggccagcgaggcctcttcccaggcctgcctgatagttgggggtgggggcagtgtgtgtacctggggcagagaagcgacctggcccctgcttgtcccccacttcctccccagctgccatttactgggtttctactgtgtaccagatgcttggcatcttttaacccatttgatttctttgtgcattctgtgatttgcccccattttactaaggaggagatgaccaagtgtaaccaggaagggcttcagagacgcagaagtcaggttgggcgtcgctggtaggagtgactgcggggatgggcggtggcctgggccatagctccccaacttgggctgtattgctctgagcccctttccagccctctgtgggtgggtacaggaggggccaggccacagaactgggtgttgctctgcctgtccgagtgcacaaggcctggtgacctgagataagagtagcagtcatgagtgtgtcagaagctcgtccaggagccagctgtcccaggtgtctgctggtggcccgccgctttccagacatggaggggacttaaccccgtgagtccatgttgctgcctggggggtaagctgtctccctgctgctactgcaaggactgtgccatgctgacggcgggtgctccagagccagtgccagcaggcccaggtggcagctgcagatctcactgctcactgcggagcagcagcctttgccgcctcagcccacagggtgccaggttggtgtcctgggtgttccggccaggagagtgaaccagtgagcagcccggggcctccatgtggagactgcagccaggtggggcggggcaaggcgggcctctcacctcactccagctgctgctctcctctgcagcgtggcccggcttagccgttgcttctgggtccgccgattacaggatgtatgtgtcttcaaactgccggatttaggttgtgttctctccccttcctcctcatctgccccctttttgccaccgtttccactgtctgctgccacagtctcggtctgtcagccctagaacctggactgagtgctgtaccttctctcagtcccttttagatccccagaggtctttctgaattggacaaaacctacagaccccactccccagaggagtgcttatggaccccactgtttacatgtcagaaggaggggttggactccctgaaagcccagccacagacctgagacaaagagcctctgtccagatgcctccccacggagggagtttggagtcccatccagaccgtgagccccttgagaggagcccagccccggcgcttcttggtagcaccctcttctcaggcgaacatggcctgggtgaccatggagacccccacggtgaccaggaactttcagatgcccaggctgaagctcagagcccatgccctgtggcctgtccaagctccctgcctttccctctccccaacccaggcctccctccccacaacacccctgtcctcctgagatgtgctaaaatggtgttcttaaaaaataccccctgagagctcatttctgtctgctagaaaatgcctcccactcatgcttttctctctcctccaaataacttgtcaaaaaaaagcctttcccaaatttaaaatcttgcaagagatagtacaacaaaggtagcccagttcttcctcagtgccatcctggtgtgttcaggttttttggcaaaacctttgaggagctggtgggtggcaggactaggttaaagggactgagcagagggctcccgactgctgagctacgaggaagagggggcagtggagagcacactgagggctcagtgttgatgacatccagcctcctcgtgccagaggtccaggtcctcctggtgcaggagcagaagctgctcaggatcctgcagagatggtggcagagcccaggtagaacctggcaccctgttgcctccaagaccacctcagatgctggtttggccgcctcccatgcctccttcccctttgccagcagctcagtccttcaagagcagggccttggcaggtctgtcttaaaacaccgtgggagtctggccatcatcctggcctagcactgctgtgccctgtccctggggttgtgggaagctggtagcatcctggcagcccgaggagagaagggctcccccagaagcatgtgcccagcaagtcacagtctgcagagtcagccctctcaccagatttcctggggctcagggattccgtccccttcttcccagccccttgagagtgtgtggcagcgctggcagctctgagcgcctattgatctctctgctggcagccaggtgcgcctgcgtccgcctcctctcctcagcttctgctgaaacgacttcactttctcatgtctcctcccacctccctttctctccagaggccattaactgtttgatgcgagcaatcgagatctacacagacatggtaagggctgcttgcttgtcctgacacccccgggtcccactgcattgccccagccttgcgtcccctctttcagcacccccagcactgttcttattctgcggccaaaccacttggggagggggaagtgggagctggggggattaggtcacctgagctggcctgggctggctgggtcttcacccagctccccaccagcctgacggccccctcactccacaggcagtcatggttttcattcatagaacttaggttattgagctgggcagggtggctcatgcctgtaatcctggcatgttgggaggctgaggtgggaggatcttttgggcacaggagttcgagaccagcctgggcaacatagcaagacctcctctctacaacaaattagcctggtgtagtggcatgcacctggggtcctagttcttgggaggttgaggcaggaaaatcgcttgagtccaggaagttgaggctgcagtgagctgtgatcacaccactgcactccagcgtaggcgacaaaacaagaccctgtctcaaaacaaaaaaagaaattaggttactggagagtgtgtgtccggcacttccccttgcccagccttcccgcaagtgtcacatttgataagcatcttgcagcaggccacagggataggcagagcccacaggaggctcagcacctgccctgcccccagggcgcgttgccaacgacagatgcagaccagatgggcagctgccaactggagccagagtgaagggtcccacccaggccggggctcctgtcagtgctttctctctctctctttttttttttttttttttttttgagacagagtttctctctcatctaggctggagttcagtggcgtgatctccactcactgcaacctctgcctcccaggttcaagcgattctcgtgccctagcctctcgagtagctgggattacaggcgtgtgctaccatgcctggctaatttttgtattttcagtagagatgtggtttcaccatgttggccaggctggtctcagactcctgacctcaagtgatccacctgccttggcctcccaaagtgctgggattgcaggcatgagccaccgtgcctggccagctcctttttgcctctccgcttgccctgtctgtctcagccctccaaccccaggcagggacacgagccctaccccttgcgttcagggcagtgctgcagggatgactgtgattagaacaataatagcagctgccatttattaggccagacactgcagggtggtttaatccacagccctgtgaggttggcattattgtcatccccgttccttagtggaggagaggggctcagacaagtgacatgatttgcccagggacatgtggctacaagcaggagtcactgagacccgaaacaaggtctggctgagcccagggccttgccctttcctactgccctcagcaagggggtggcgttggaccagcccctggtgcagagcagttaggcaagcgcctggacactgggtggaggcggatggaaggtgcgaggccccttggaacctgaggcctccctggggagctctgggtgtgcctgggggaggctgacagataggtgttggcctgggggcagagctggtactcttgggcagaggtctcaagccctccctcccatcctggtttctccagagccctttgccaagtggctctggactggtccttccgcctctctggctgttatcagaggcttcctaagggccagggccttggccaagtgctcgtgctcacattctctctggtgtcacaccatctgtgccctcgtggatgggatggaattaggctaaggccctggagtggcttgtccaacatcacccgctcagcccagcacgcatagccaggcctctagtgctggggccctcccttctcactcctgtgttcccccacctctcgatcttcttcacacctcaggtcttcttcatacctcctcacaggcgtggctgaggggtgggaacttgaagggtcataggtcagcaggcaggcacgcaggaggtcatgagtcgcaggcagccccttcctgtgtcccctccagggccgattcacgattgcggccaagcaccacatctccattgctgagatctatgagacagagttggtggacatcgagaaggtgagtggcagcagggccctgcatgggctggcagccaggaccagtgctgctctctcttcttcccaccaggggagtcctctggtgtctgagtgccgagaagggggcatggggcgccggcagagcttggagaatggggtctggctgtgtcccaggcaggcagggcggagggtgtggaagcttcacggaggcctcctctcccttccctgccctcccctggaacccatcccccgtgtctccccaggccattgcccactacgagcagtctgcagactactacaaaggcgaggagtccaacaggtagcccccttcctgcctgccccagccccgcagggaccgccaccacttcccctcactactcctccccacacagctcagccaacaagtgtctgctgaaggtggctggttacgctgcgctgctggagcagtatcagaaggccattgacatctacgaacaggtggggacaggtggggatggcggcttccaccctgccccctctcagggcctgtgcctcctcctaagccccggcaccttgttctggaaccacccctcccccggctcaccctctgcctctcccccgacatcccttgccatgtcatccccccaccctgtcttcagcctggctgaatgttctccacctacgactccatgccgtgccagcaccgtctctctccctggctgtgcccctcccacacccctcgcagagcttcctggaggggcccagagtgaggctggctaaagaacccagagggagggaatgggaagaagtgccaagaggcccagggtggccgtgggcaccccaccccatggcccgatggtcctcatccacagtgggagggagggagtgtcacatggggtccccccagcgtgcacggagccctgggtgatggccgagaaaaaggcaggcagctggccccctgggagagaggggcgggcgccgcctctcatgttcccaccgcctgccgccgctctgcccaccgccatgccagcctcccgttggtcctgacagccaggctgcctccttcccactgtctcaggctctcagaaggcccacgaacacctggctacagcctccacccccacccagccaccatcacaccctgatcttggtcgctcacgcactggccgctgacctctccaagctggtccctggctccctgcccttggggtcctgggttaacagggcctcacctcgggacatgaaccagctcccagctggccccccagtgcctggcagtggctctggccctctggctgcttgccctgagctcaccagtgccacttctccatggctacaggtggggaccaatgccatggacagccccctcctcaagtacagcgccaaagactacttcttcaaggcggccctctgccacttctgcatcgacatgctcaacgccaaggtagcacaccccacgcccgcaggaccaccgcaccaggccaccatgtgcttatctccaggccaggtcccgttgcccccgaagagggacgtgctcctccctcacgtctggcccctgccagccagcctttggatgagaagtgtggttctcacagctgtgtttctgtgctggcatcacctgcccacccagccctggaggcttttgcgggtccagctcctgcctcacttagtgctctttccttcatgggtgcactttttgaatcctcactgcaccccattaaagtcagcaccattgtcaccgcgtcttatgggtgaagatggtgaggctgggacgagagtcccttgtttgaggccacatgactagggacctgcagccccagtgttccagatctttgtgactcctgctgtcgtggctttagctgtagctcacacatgcccacctattttcaggacacttggcaaaagaggggccaaagagggcagtgggagggggcgtggccagcgggaaggagctggagggttggcgctagattttgcttggccggagtttttttaccattgcctggcagaagcacggagtccaggatttcctggtgtccctggctcacggcctggggtggtggccccacacaccccacacacacacaccccacagagccctgccctgctgtgggcaccggtggtgggcaaaagcttgggctttgtcagaccaggttcccattcccaccccatgtctcaccgtgccctgggcaggtcactgcccctctctggatctgtttcctcactttgaaaagggggctcaccgtcatttgaccctctcagggtcctcaagaagcaccagccccaggcctggcatggaggatgtgctcatttgtcccctgccccagctgagccaggtgggaggaggcagtgggtgcctatctggggaaccttccccctccacccacctctccctgcagccatctctgcagccaggctggtgctgagctcagctacgggaaggtactgacagacacagagccaggtgacacctgaggctgggggaggggtgcaagagctgactcaatatcacccgacatccccaagtcccctcagctgctaggccagtagctctgaggaccctcttgttactaactcatcttctcccttccctgctgcccagctggctgtccaaaagtatgaggagctgttcccagctttctctgattcccgggaatgcaagttgatgaaagtaagtgctgggtgctccggcctcccccttcccgaacctcagacgggggtggctggggctccaggtgggacaatcgccaagacttgtccagtagttctcagagggtgtctttgttttgttttgttttgttttgttttgtttggccatttgagtctccattttccagatgaagaaagtacaactcggggagtgctggagctcaggatggctaggtggacacacacacacacactacacacaccacaccacaccacacacaccaaacatacactacacacaccacaccacacacatcacaccacaccacacacaccaaacatacactacacacaccacaccacacacatcacaccacaccacacacatcacaccacacgctacacacacaccaccccacacaccccacacacactacacacacaccacacacagcaaacacatcacacaccacacatatcgcacacacactacacacacacgacacacccctcacacaaaacacattgcacagtacacacaccacacgacacacccccccacacacaaaacacactgcacacacaccacacatgacacaccccacacacacacattgcacacacactacacacaccacacacaccccacacacacaccgaacacaccacacacgcaactcaacacacaccaaacaccacacgtgcccctacacaccacaccccaacacacacaccacacacacacacacctccaccacacaccacacccaacacacacaccccccatacccacacacacacacattctgtgtgatgttctatgttggtaaggttgccctgagagcaagccgtttctgatgaatagggcagcaggatcgcaacacgcccgtacccatccccagtttaacccacacggattgaccctctgagagtcctcaggaagccccagccccaggcctggcatacagatagcgtgtcctttcatctaatccaggccagacctcaggtcagcataggcccctgacccctctctgccatttgcttgcagaaattgctagaggcccacgaggagcagaatgtggacagctacaccgagtcggtgagtggccagcatggggggccaggccccttcacggggatgggtctcctaggaaagctgcccttctcagacacgctctccatgacattcacccatttcatctggcccccagcccactgtgaagttctttctccagtcaccccagaaaccttacaagtagcgccaagaggcgcagggagtgttctccccattttatagatggtggcactgaggttggggaggtcaggaggctcggccttggcccctcagggacagagctggtgttcagagccacatctgtctgcctctgaagaccagggttccttgagtcccccaggtgagtgtgtgagactcacagtgggcgccttgggcacccaggaggcacagacggggagggaaggggtgagaaggagagtggagctgaggacatgggagaggtgccagcttccctctgcctggtggagccgcccacgcggctctctctcccttccctttctctgttcccagcattcccgggcttagtggtgtccggctcaggtcctgattcactcctctaatggcacatgtcaagcatttctccctaggtgccccttgggaatggaagcccctaactgaggacagtgaaaatgccatcctgttcctcctgccccagacagtgggtggcaactcagccaggagctcagggaggggatgcccagcaggccgtggcttctctcccccgtgtcccatggcactcaggagtggccttttccatatctccaggcctcagtttcccacccattcagtgaggatgctggacttttttttttttttttgagacggagtctcgctctgtcgcccaggctggagtgcagtggcgtgatctcggctcactgcaagccccgcctcccgggttcacgccattctcctgcctcagcctcccgagtagctgggactacaggcgcccaccaccacgcctggctaattttttgtatttttagtagagacggggtttcactgttagccaggatggtctcaatctcctgacctcgtgatccgcccgcctcagcctcccaaagtgctggtattacaggcgtgagctactgcgcccagccatggacctttttttttttttaaagctacaatatctttctcccccaagggaaatgatgtgcccagcatagtcaagacagacaagagggagctcccatggctgagttggggcctcaagccctccctctactcctcctcagagaccaggggtgacagagacagatcttgaaaaccttgggacaagtgcccttgggctgcagggttgggaacggggggagcatggccagcctatcacctggtgtgccctcaggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatgagtc

SEQ ID NO: 36870 - DNA, 2826 bp, Homo sapiens
gggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcctccccttggcggggagaagctttttttcttgctagtattcgctgtgttcatggtctagaaatgcggtctggtctcgcctcgcctaccaatctctgctctctatgtatgtagcgtacgggttgttttgggtgaatcttgaggaataaatgcctttatatttcacaggctgtaaattgaacttcccacacgattagctttattatggcttgtgaactgctggagtctggctttacctttttgtatgtgaacaaatcaaattgcttaaaaaagagttttctttagtatagccacaaatgccttgaactgttgtctgggattgttttgtggggggagggaagggagtgttccgaagatgctgtagtaactgcctcagtgtttcacgtaagactttttggtttgatcatctttgttgaggtaggactatcagttccctctaaatgtatatgttgatttatgagtaattgttatttattctttatttatttatattaattatgaagattatgatattatttgattgcagatttttttggcgcgctgccccctccccaccctgccactcttgacattccactgtgcgttttagaagagagcctttttctaaagggatctgcttaaagttttaacttttatacctatctgagtgaattacagacaacctatcatttattctgcttcgagggtccccagggcccttgtacaaccgacagctcttacttttaaatgcaatctcttttctacatacattattttcttaattgttagctatttatagaaagcttcaatagaactgtttcaactgtataactatttactattcaaataaaatattttcaaagtc

SEQ ID NO: 36871 - DNA, 4199 bp, Homo sapiens
gcgagggaacggcgggcgggcgcggagcatgcggagcggcgccccgggcggcccccgggcttgggcgagggcttgggccaggcgcgcgggccgttggggttcggagcttcgtgggacccgcggccggcgcggggacgtacggcagtgactcggggctcaccgggggccagtgccgggccagggggccagccccgcccgcgtctcggcccggacggcccggcgaggaagctcccatgcgggaccgcgcggcccggtgagggcgcgcgcgggcgggcggggacgcagccggcaccatgtccatgctgcccaccttcggcttcacgcaggagcaagtggcgtgcgtgtgcgaggtgctgcagcagggcggcaacatcgagcggctgggccgcttcctgtggtcgctgcccgcctgcgagcaccttcacaagaatgaaagcgtgctcaaggccaaggccgtggtggccttccaccgcggcaacttccgcgagctctacaagatcctggagagccaccagttctcgccgcacaaccacgccaagctgcagcagctgtggctcaaggcacactacatcgaggcggagaagctgcgcggccgacccctgggcgccgtgggcaaataccgcgtgcgccgcaaattcccgctgccgcgctccatctgggacggcgaggagaccagctactgcttcaaggaaaagagtcgcagcgtgctgcgcgagtggtacgcgcacaacccctacccttcaccccgcgagaagcgtgagctggcggaggccacgggcctcaccaccacacaggtcagcaactggttcaagaaccggcggcagcgcgaccgggcggccgaggccaaggaaaggtacgagtaagtagaccttcttcggcgccagctccccggggcccaagggaggggttcgcagggcttctgccggtcccccggagaggcctaaactgggcccccaggcccggccacagcccagcggcagcccggcctgacttggacgatgcttaggcctttctatgccggagacccggcgagcagggatttgtctaaagcgggcagagcaattcaggaagttgtcaactaactactcggtcgctagaggaaaagggtggagaagcagagagcttcggggcagcgcagaactgtgggcctgtatcccctgtgaggcaggcacagtaggtctggtcatcctcaggacagaggggtttgagcccagatgaaaggggatttgcagatttcttgctggtggtgcttcccggcatttccccccagccttagctccaggccaaagtgtgatggggtcgggactggggctggaacttccctagaatgacctggatggggaaaagccaggccatgaattttcgttgtcacatggagttgagagcgggtcctttatctccttagaaaggatccagaggtgaaagggaggaagtgtcagttctgggagagaagagacgcatgccctgttttctgccttgctagagatagccgcccttccctggcactccaggcccttgatgcctctctccttaggccctacctctgatgggtaggtcggaatgtctgcggtgagctgagaggcacagaggggctgggagttggatgtcctcaggtaaaccaggacttcctgaaccagcctaaaggttgatcattaggcccttgccactgcctgccctataacccctcaggacctcaaacctggagagaaacttattatgggaacagaatccagcccggggtaagagcaaaacaggacacctggggttggtgatatggggtgtgttccaccctgagtttgaatgatcagggtcagaggtgagggtgctgaaccagaaacatcttagggggagtgctgcaggctcagatacttccaggtatctgagaccctgaggttggagtttccacagtggtgaggtctcagctgccagccctgtgggaagctccctcccaggaaagcagaaagaaaaaccctcccgaagctggtgacaagagatcctacccaggattttaaatatccaaatctggggaggagctgtcagtcaaaggcatagaaggaggtgggttctctctgctgggtccccctccacccaaaccggcatgtgatcagactcctgaaaacctgggttctcagaccaggccccagatgagagctgcagattcccggagtggctggttacaatggaaaagcctcggccttctcccaggggctgccctttatcccccaagcttctggtctccgagctgacgttttcactgtaccaccacggaaagggagtcctccatccttggacccttgtctctaggcccagcaaggagagccctcacagggctgcccagtttggagctacagggaaaggacgcttagccccaggagcctgtctcccagccaggggtctccctcgggcagaaaaagcaaagggaaatgaagtcttgtgagaggccctaaatcccttgacctgggatccagggttccttaacctgctagccccacatctacccagcaaacctggcttgtggagcctagagtgatctgaaaatccaggcatcgtctcttcctcccggctcaccccacaacttcagggaaccctgttctcctgcacctctgttcctgaaaagaaatattggggaaggggggaaagaggaaatatagaaaagatattgatgagattgacagcatgagaggtggggacgataagggcagaggggcaagagaaattgggtgttgagagatggagagaacgggcagaaaggagaacccagaccaggtcgaggaaatggtagaaaccgaaaacacccgcaggccacaagcccgggatctgtctcccgaggctggtggctggctctgactgtgactgagatggcgctgggtggtctcgatgtccctgctgaccccgctgctttgctcccgcacttgcagggagaacaacgagaactccaattctaacagccacaacccgctgaatggcagcggcaagtcggtgttaggcagctcggaggatgagaagactccatcggggacgccagaccactcatcatccagccccgcactgctcctcagcccgccgccccctgggctgccgtccctgcacagcctgggccaccctccgggccccagcgcagtgccagtgccggtgccaggcggaggtggagcggacccactgcaacaccaccatggcctgcaggactccatcctcaaccccatgtcagccaacctcgtggacctgggctcctagaacccatttgccttgatgagcttgccttttgtgacttgacactggggacgtggagtggcggtgtccaggggcgccccgcccctgcggccccaccaggtactgaaagacccgcaggctgagcgggtagaacagccgggtagggcagatagctgtctatgttggttcttgtttgggatttattttcaacaagttacttttaggatccttttggggctggagactgagtcttgaaccacagaagggaataaattatacaccactgtcattctctctctccctctgtctcttccttttaccctctcttgtcttgccttttccccctttcctcttcctttcccttccttctcttttcttttttctgctttctgtctttctccctctccttgtattgctttccttctagatttctagcttgccaccgttcattctctccttctgtctctccctttctctctccttctctgtttctcctctcttctctcctgccagtctcttgtactctgtgtcctggtccctccgtatgtacccctgtctttctcctcctgactggtggtctatctgcccctacctctggccctcgctttaccggagtagggggtgggagagggaagaggagagaaaatacagggactttgaacctaggccatctcctgaggccttttccctcgcccatgtgggtcagtgggagctgcaggtgtcagcttttcgtctagtaacttaagtgagagagaaagggcagcgccacagaagcccctaaacgccgcctcgtcatacgcccctcctccttctctcttggcgaggccccgccacaccgcgctcttcctcccgggactgtgactacagcgctcccggctgagcgcgccccccgagccgccgacttgccgtctccccgtaatgccctcatgtgaatgttcttcgggaaatatttctgcttttattttataataaaattagaaatcataaat

SEQ ID NO: 36872 - DNA, 90217 bp, Homo sapiens
gaacttggggggcttctcctcttgtctcccactggtgctctggctgtgaatccatccaggggccaggatgacaatccgacaccaaggccagcagtacaggccgaggatggcatttctccaaaaggtaaccctggcccctcacctggaccctgggaggagggcgggggaccgcatctgcgaagcgtccgaggacaagaggggcaggagtggagagcacccctttgggtcgatttgtgctgctcgattttattaagtgacttctttgctgtgtgtgtcgatattgatggctataataattaggttttcgtgtgccctgcctgtagtggagaatctgaagccagcgctgatggtctgcgggaggtgaaaacaacctgttactcgggagaggcaggttcagttcaggctgtggcagatttgagacagcctgctgatattgttgtaagacgaccagatgtgacattgccatttttgccttttttttctgatcccaaactgcactattttaaagtgtgtgtgtgtgtacacatagaccatgaaaacggggtgatttgtaggataaagggccaccccatttacaatgccctgagagccctcatttgagtgtgtctatctgtgcatctcctgctgtctgcgctggcggcagaagtcccaaccttttcgcttcccttgcgaatgctttcccagacaaagtgaccgggcacagggtgtgcacacaggatggacatgtgggaggtggaatgcacctgtggggtgatgtgtttggggacaaagtggttcatttagttctgagcttctggtataatcactgtccgatgagatctacagaggattaggtcccgggtcacatctttgtccttcctcccacccgtagccacttttcacagcgtagtgtccatcttcttaggcttatcttgttgagtagaattagttgaatgttttgtgacaagctgagctctccctgagcccctggagctcagcaaatttgtatagtcagtgaccgctgtcctgatttgcccaggactttcaatgctaaaacctggacagtcctggggaccccgagacggtcgcatttggtccacctgtttcaagatgctcgtgctcatcttccgggtagcagaggtgtgggtatcatctgtaaagcagacaggctgaatgttgtctcactcagaaagaaccctgagagcctgtattgcagataccagttactaaaagcagaagaaactgcctaagtcggctatctcaaagccacacatcatcttccaggatttatcctaggactgtctcctcccaggcaggacagctctggcttgggggctcagagggtaattgtcaagagataaattcagtttgtttattgaatctctggcattcttttccatcatgactcttctctggtagattctcctctccttaccttggtcttctgactagtgtcttggtctctagtttctctcctccaccccaggcttccctcctcctccccagccacccctcctccaccccagcatcccctcctccaccccagcatcccctcctccacccaaactctccctcctccaccttagtctcccttcctccaccctaacctctccctcctccattccagctcccctcctccaccccagctctcccccctccaccccacctttccctcctccaccccaggtcctcttcctccaccctgtcttccccttcctctaccccatcctcctcctcctccccagccttctcctcctccatcctaacttacctctcctctaccctaacctccccctcctgcatcccagctccccatcttccaccccggtctcccctcctccatgacagctttcctacacacactgtttttttcccccaaatcaatggtgacctccttgacctgaaacgctccactggcttcccacattcccagcataaagtccaaccttcccctgagcagcctggttacccaggattccgctcccaccatcttcctggctttgcctcctgcctgccttccacacctgccctctgggaaacaacaaagcagccacaggcacccctgggctcctgcctcaaacacttccttcctttttaggaacccggtgccctttcatgcctcagggtccgtctgctgggaaagtcctttctccccctctcgcttgccaagctccacttctcttcccatgcccagctcagtcacccctcggctgtgaaggctggttctcctaatgcccctgggcaggacagctcccttctctgtgcactacagaccttgccacacctccagcattgctctttccctagaccttgtgctggcaagggccctgtctatgtatcctctatatctatgtatgtattggtcatgtcacagagctccttggagcagcagacagaataaaggtctgcagaacaggtctcaagagcccatgccaggcgatccttaatgaagaaccagctacattcgatgttcagctttctggagaagggcctggaacaaaaaaatgtggacctgggtgcaactgtcactcatcactcgttccatgcatgtgatgaagtacacggtgtccatgatggtgtggaggggtgggcattatgtgcattatctcatctatttcattagctggaggttatggccaccattttacagagaagaaagctgaggctcagagaggctaagcggcttgccagtcacgcagcactaggtggtgaaaccaagaagaaatacaggagtggtcgttgtctgtcacaagttgtggtgcaatgccctgagctttcccatgacgtagggcagagtgtggaggctgtgggaaagcctggctcagtgtgcttagggacacagagctgagacctgaaggatacatagggtttccaggcagaaagggaaagatgtttcaggcagagggaacagtttacgcacagaggcatgggaaagctagtgggtttggggccatgttctgtaatggatggattttgaagtgcaaggggagtgggaagctggaaaggaaaggcagaggtagtgggtgcctatgggccttcaagaccttttaaaggtttggttttatctcatacggagccactatagaaattggaatgggcaagtgatatggcagatttgcaaattaagaagatcactggtgggccagttgcagtggctcatgcctgtaatcccagcagtttgggaggccaaggtaggtggatcatctgagatcaggagtttgagaccagcctggccaacatggcaaaaccctctgactattaaaaatataaaaattagcagggcgtggtggtgagcacctgtaatcccagctacttgggaggctgaggcaggagaattgcttgaacccgggaggtggaggttgcagtaactgagttcacaagttcttgccactacactacactctagcctgtgtgacagagagagactctgtctaaaaaaaaaaaaaggaccactggtgtgagccagaggaatgggtggaatgccttctccctgaactaagagagttcactcaggatcctcctgtgcccctgcagctccaacctcttgagaaatgacaactgtcatggggccatggagagccatactggtcagaaaggaccgtgtgcgattcccgaggttctcacacccatgcctccatctcagtctcaatgcagctgtgggtcgggatgcccgccggccatgctgcttcccacctctgatgcctgggctcgtttcagatgtggtagaaagaggcagaaggcccatctgttcatggctttgctggggaattagctgatggcacacagtggacagatgaacacaggtgggtggcctcctgtggttccagcacccatggactcttgttctggggatggcccattcccctctgcaattaccagatcaccatcccagccagtaccaccaccgcccttgggattcaccatgggcgaatttcttggactttcttggagaagccttctggtgacagctttgttttcctgtgcggcttctggcatctctttttgcctgagaaaggaatgcagaagcagaaatattgaggatatccaggccgagtttggtatctcttgcttgtaacattctttcattcaatacagacatataattgggtacttatgggctagatgctgtgccaggtgctgggagcaccaaggagcttagagtctagtggagaaagacagatgtataaacaaggagacaagaagtgttccataggctgtggcagacattgttggaggatacatgtgacaccaagcagggagtggtcagttctacctggggtcaggggggatcaggacagattttacaagggggcttgcaatggagtcgaattataaaaagtcagtagtttttggccaggaggttgaggaaatgagtgacattttaggcaatacaaaacagggacatgtgaagtagcatggtggtttgggagattgcctgcgggttgggagagctggccccaagtgtacaggaagtgagtttggcgttgatggagaagactggtaggtaagaaaggcccagatctgctgggtgcagtggcacatgcctgtaatcccagtactttgggaggctgaggtggacggatcactaggtcaggagttcaagaccagcctggctaacatggtgaaaccaaaaatacacaaattagccaggcatgctggcatgcgcctgtaatcctagctacttgggaggctgaggcaggagaattgcttgaacccaggaggcggaggctgcagtgagctgagatcatgccaccgcactccagcctgggtgacagagcaagactcagtctcaaaaaaaacccaaaaaccaaaaaccaaaaacaaacaaacaaaaagaaaagcccagaactggagggcttcctaggtcatgctacagagtttgatggcttctgtgtttaatgagaagctgtttgacgttttaaaatcagggatgaataagatgagttggtttatatgctagaaagatgattctggtgagagggaatgagtaattctcaacctgggctgcactttaaaaaacattaatatcaactcactctactttgagtttctgatttacttggcctggaagtgaggcttaagcattggtctttttatgccactgtttttctcccttcctttcttttttttttttttttgtttgtttttgagacagagcctgtctctgttgctcaggctggagtacagtggcgagatctcggctaacggtaacctctgcctcccgggttcaagtgattctcctgcctcagcctcccaagtagctggggatactgggacctgctaccatgcctggctaatttttgtgtttttagtagagacggggtttcaccatgttggtcaggctggtctcaaactcctgacctcaggtgccccacctgccctgcctcctaaagtgctgggattgcaggtgtaaaccacaaagcctggcctggttttctttttgtttctttctttctttttttttcttttttaacaatttctttttttagagatgggttttcactatattgcccaggctggactcaagctcctgggctcaagggatcctctcaccttggcttcctgagtaatttcatttacaggtgcctgccatcatgccaggcttaaccattgctctttttgaaaagttttccaggtggtttgaatgtgcagtcaggatgagagcctctggggacatttggcaatgtctaaatacattttaggttgtcataactgggggtgctcctggcatctagtgggtggaggacatgaatgctgctaaacatcctacaacacacaggacagccgccctcaccaacccccaaagaatgatccagctccaagcgttgatggggccactgttgagagccctgggctaaggagcaccccggaggctggagacagatgccagctcaaaggcagaacctgatagtccaggaagggggttagaagatgttccacggaggcaggattgagtgggcagagaagagatgtgttgaaaacaaaagcagtcagactgagcaacatatcaagacccatctctataagaaaatttaaaaattagctgggggccaggagtggtggctcacgcctttatcccagcactttgggaggccaaggtgggtggatcacttgagcccaggtgttcgagactagcctgggcaacatggtgaaaccctgtctctaccaaaaatacacacacacacacacaaatgagctgggcatgctggcaggcacctctagccccagctactagggaggctgaggtgtgagaatcacttgaacccaggaggcagaggttgcagtgagccgagattgtgccactgcactccagcctgggcgacagagccagactctgtctcaaaaaaaaaaaaaaaaaaaattagctgggcagggtggcacatgcctgtagtcttagctatgggatgctaaagtgggaggatcacttatgcccagaagtttgaggccacagtgagctatgatcatgccactgtactccagcctgaaaaaaaaaaaaaaggaaacaaaagcagattcaacaaaagttggccacatcttggctggggtcacctggaacgattcccaggcttttgaatcggtgggaagagcagattttggagaaagactaccgagcactggttagggcatggtgcctcatgagtgtctgagcgtctgcgagacatcgggtgagacagcgggagggtggctggactctgtgtggccaggcttattagcaggagtacatcctcctctgttagaaaaacaactctgcggttctgggtcacttttcccatctttgtatagaaaagtaccgattattattgttcccccgggtgccttctccagcttaaaggaaaattccagccccagagatcttccgcagtgagtgacagctccttaatgtgaggagcagcgtgggcgtggtgggtgggatgtcagagccatcaaagccctcatttctgatccctctgtgatgtcggggttccctggcacgcccactgtcatgcctcagcacattggcatctgagagaggaaaggtgcagctgacaccctgacccccttctccccgacacggggtcagacagggtcccgcggtggcctggttgtgcagcactgacatgttgcctgggaacgaagcggggctgatgctttgtcttgggaggagctgggaagcagagtctgtttgggagtgagagtgttggcctttgagggtgagcatgcccccaaggacacaaggaggagagtgcaaggtctgctgaagtttgcagcagaatagcaagggcatctcactccctggagaacttgggaaacagttcagattctctcccctctgtgcaggggaagggatgtttctgattgaatataggacacagagtctgtatgagtttgtagggctgtcgtcacaaagatgcatagactgagtggcttaagcaacagaaacttctttgctgacagttctggaggctggaagtctgagatcaaagtgtggcacggttggcttctcctgaagcttctctccttggctcgcagatggccgtcttctctctgttctcacatcatcttccctctgtgtctatctgtgtcctaatctgttctcataaagacactggtcataggggattagggtccactccatgacctcatttcaccgctttattttatttttttatttttattgagaatgagtctcactctgttgcccaggctggagtgcaatggcgagatcttggctcactacaacctccaccgcccgggttcaagcgattcttctgcctcagcctctagagtagctgggactacaggtgccccccaccacgcctggctaatttttttgtatttttagtagagatggggtttcaccttattggccaggctggtctcaaactcctgacctcatgatccaccggccttggtttcccaaagtgctgggattacaggcatgagccattgtgcccagccttatttttacttttttgagactgagtctcactctgttgaccaggctggcgtgcagtggcttgatatcgtctcagtgcaacctctgcctcccgggttcaagcgattctcctgcctcagctcctgagtagctgggattgtagcctgccaccactcctggctattttttttttttttaatatatttttaatagagatgaggtttgccatgttggccaggctggtctcgaactcctgaccttgagtgatctgcccatctcagcctcccaaattgctgggattacaggtgtgagccagtgcacctggactcatttcacctctttaaagaccttatcttcaaaagcagtcacagtctgaggtactggggttaggacttcaatgtacgaatttgtagggggacgcagttcagcccatagagctagagttctgtggtttcctggggagactgaggagacgcctcagaggaatttgtacggggaaaggtctgaggaaaaaggatcggatcccaatgggccgaactccctcaaaatgttcccgaggtccacgtgacgttccctcctcccacccagcccttctttctgtgaagggtgacacacctcctagaaagaaatctgactcccctcattgtgtttttaaaataactctcattattcctcctctgaaggttattttcaaactctttataactcgatttttttttaaatgcaaagacaaggaatcaaatctgccaactttctatcagagaaactcgggtttctaacttttaaagtgggattatatgtcttctccaatatatgggctccctgcttttataacatgctgctgttacatctaataaaaaccattttgaatgaaggcagcctttcatccggcagctaatgtgggaaaaaggagtcttgggccctcatattagaaaatcttggcctggcgtggtggctcacgcctgtaatcccagcactttgggaggccaaggtgggcggatcacgaggtcaagagatcaagaccatcctggcaaacctggtgaaaccccgtctctactaaaaatacaaaaattagctgggtttggtggggtgcgcctgtagtcccagctacttgggaggctgaggcaggagaatcgcttgaacctgggaggcggaggttgcaatgagccaagatccgccactgcactccagcttggcgacagagcaagactgtctcaaaaaaaaaaaaaaagaaaagaaaatcttggccgggcacggtggctcatgcctgtaatcccagcactttgggaggctgaggcaggcagatcacttgaggtcaggagtttgagaccagcctggacaacatggtgaaacctcatctctactaaaatacaaaaaattagcgtagtggcgcgcgcctgtagtcccagcttctcaggaggctgaggcacaagaaccgcttgagcccaggaggtggaggttacagtgagccaagatcatgccactacagcttgggctacagagtaagactccgtctcaaaaacaaacaaacaaacaaaaaaagaaaatcaggcacttcttgggtaccatggagacctgaggtcacagttagtggagaactccagaaggagtcactcctgcagcctgttgcctcctcagttccctgggccacccccaggagcagcagctgtacctcccagtgccccgcaaacaccctcctggcgttgtccctttgcttccctcattgctgctggacctacagctgacccagtgacctcagatgctgccaagtcctgacactgcagatggccaaggactatggctctgagtcaagccaaaataagtattttctgttccaaaacaattctgtgagccgagaatgtgtccgtgcagaggaagctgacagtcagtcttgcaccaggagtccctggagctgcctgggtctgcacgctggctggctgtgtgctcagagtggcctcagctgtgtacctgcccttggcccatttcttgaaatcgtggttcagctgcaaatgctggtttagcaataaagattgaaatagggaatctcacccctcagcatcaagttaggtcatggtcccacgctccttgggaaggtgggagcttcccagcttcaggctgcctgagtgacaggtggcaggtagcatttttccacttcaggactcccttgaatgacccgtcaccttgaatgcacctggatcattctctctctcttttaaaaactttttttttttttttttttttgagacagagtctcactctgttacccaggctggagtgcggtggcatgatctcagctcactgcaacctccacctcctgggttcaagtgattctcctgcctcagcctcctgagtagctgggattacaagcatgcgccatcacacccagctaatttttgtattttttgtagagacggggttttaccatgttggccgggctggtgtcgaactcctgccatcaaatgatctgtctgccttaccctcccaaagtgcagggattacaggcatgagccactgtgcccggcctctctttaaaaaatttttattttattgtggtgagaacatctcacacgagatctaccctttcaaaactttaagtgcacaatacaatattgttgatgaggtacaatgttgtacagcagatgtctagaatgtattcatctcatttaactgaaagttctttatgtctgttgagtagcaactccccagtttcccttctctctaacccctggcaaccaccattctgatatttgatctatgaatctgtctattctaggtacttcatgtaagtggaatcgtgtggtatttgtccttctgtgaccggcctatttcacttagcataattagccctaggttcatccatttgcttgcatattgcagaatttccttcttttcgaaagccaaacaatgttcttttgtatgcatagaacacattttctttgttcatctgacagtggacacttaggttatttccacattttggctaacgtgtatagtgctgcagtgaacatgggagtgcaggtatcttttccagagcctgatttcaattcttttgggtacatacccagaagtggtattgttggatgctgtggtagttctatttttaatttttctgatgaacctccatactgttttccacagcagatgcaccattttatatttctaccaacagtgcacagggttccaatttcaatctctttccatttctgaattaagaaacctgagtccttcttataccacccctcccttggagtgcggcctggtcctcaccatctagggagattctgttggccctctctgcactttttttgggatcatctcagccagtctgcagttgctattttttttgtgggtaggtgtggggaggaggacaagggctccctgtgttgcccaggctggtttcaaactcctgggctcgagtgatcttcctgcctcagccttccaggtagctgggattacaggcatgagctaccatgtctgacttgcaattgctatttcataaatactttgtgcacagaatgatatgaaatgctttgtatgcttaatctcatttagtctttgcaatatccctacgatgattggttttggtgttttttttgttttgttttgttttttgaggcaaggtctctctctgttgcacagactggagtgcagtgacgtgatctcggctcattgcaacctctgcctcccaggttcaagcgattttcctgcctcagcctcctgagtagctgggattgtaggcgcccgccaccatgcccggctagttttttttttgttgttgttatgtttaatagaaacgaggttttgccatgttggccaggctggtctcgaactcctgacctcaagtgatccacccgccttggcctcctaaaatgctgagattacaggcatgagccatcgcaccgggcctgatgctattgcaagttctattttacagataaatgagtcctagtgaaatttagcaatttaccaaaagcctctagcttctaaattggagcagagatgtgaaactgaactttctctgcattcagactcctagctttcatattagttaacttttcattttcatgtaactgtctgctcaactttctgaagactgggtgtatgtcttttaccttgtatccttgcagtgcagggttcttaatacatgctcaataaatacctatacttatttggtttgttgacctgggtttctattcctgggcacctaaacacaaccctgcatgcaaagtttcaaaatgtattagtatgaatgctactaatattaataattctaaccataatagtgaacatatgtctctcctgataaagcatatatcttcatgcatacataacatatatctctccttatagagcattttacataattaaattctaagggattataaagtcacaaattaattaaattctaagagattatagaattctttagtagtccacatcatggtccccattttatggagagaaaggagattcagagaggttaagtgagttgcccaagatcctacagttaatagagaaagaaagtcccatggagactgagtgctttttctttggactgcaagcaagcaccttcagatcatgaaaggattttgtaaattgtaatgagccagacagtgttgggagatgttgtttaattcagtgccagaagactaatgatggtgtaagcaaggtggctaaatggaggggaagcaggtaaatggatgagatgttttactttgggtaatggcgggaatgtggacagacttggtgtgagagcagccatccacgttgatgtccagctgcacgcagcagcccagacctcaggagagagccctgggccaggtgaaggcaggaaagggctttgtttcccgctgctggttcatgttctgtgcttctgcttctgtggcccttccacctagaacaccctcacccatgctccttttctctttctgcttcctactccttgctaatctttgtaaaattcaacctaggaggctgggtgcagtggcttatgcctgtaatcccagcactttgggaggctgaagcgggtggatcatttgaggtcaggagttcgagaccagcctggccaacatggtaaaaccctgtttctactaaaaatacaaaaattagctgggcgtggtggcgggcacctgtaatcccagctacttgggaggctgaggcaagagaatcatttgaactcgggaggcggagattgcagtgagctgagatcatgccactgcactccagcctgagcaacagagagaaactcagtctaaaaaaataaaaataaaaataaacctaggaggagtccttctctcctgcccagctctaggcactgctgtgttcacatgacaccatagactcacccttgtcattgcatgttctgcattgtcctagaatatctttgcactggtcagttagatctttgggctcagggaccacagcttctctctggtttcccagagttgatcatgactgtgcctggatgtcgaatgaccagctgaccattggcaagcacatctggggcagggggagtggacagctttcccgttagtgagggcttttccaggggaacatgaagtttgaaacctctgcacatgaagctttgtcaagatcagtagcaaacagcgaataacaagagaaacacctgggttttctctagtcatctttgttgactagtgtcaaacatccagtttgtttaaaaaaaaatccttcacgccaggtgtggtggctcatgcctataatgccagcactttgggaggctgaggcaggtggatcacttgaggtcaggagtttgagaccagcgtggccaacatggcaaaaccctgtctctactaaaaatacaaaaattgactgagcatggtgtcatgtgtctgtaatcccagctactcgggaggccgaggtaggacaattgcttgagcccaggaagtggcggttgcagtgagccaagatcgtgccactgcattccagcctgggcgacagaggaagacctgtcccaaaaaaaaaaaaaaagagtccttcagctgatattatttccatttgattttttcaagtgggaaataatttttaataataaaaatgaaaaaaacaactctaaagatagtcagggctgtccctgtggctgccttcctgcagtgcaggcttccttggacagtttgttgattctctttagcttcaactctccctgacattcatggctctaattcatatctctgaccctgtctcttctgaacctggggcagtcatttccaatcacctcccagacattgtgggaatctcagaagccccttacagtcgaccttccaaggcagacacctttgcttccagaagtggcttcttctttgcattttctagtttggtaactggtaactctggtcttataagttataaaccttggcattattctgtgtcacccttagtgaacctttcaatcacttgcaaatgcagtttattttcgctcttccagggctctgaaagtcatgcctccttaccatcttcctggccactgcctcatttatttattaattcacacatcacttgcttactgggtactatctatgtggcaggcatgcttcctgacacttgacatccagcagcaaacaacaacagaaaaagacccccaggaagagcttgctttccaggagctaggggagatgcaccaccgacaatgtattaactaggtcaattattttgtatgtttgaagaccacacatgctcttgagaaacggagcagggcgtcaggagtgccaagggtggagttcagggttgcagctttaggaatggtcagggtgggcctcctgagaccatcagaaggggaagaaggtgaggagggagccaagttggtctcttgcgaagactggcccaggtagagggaagagccagaacatgggacccgcccaaggctggctgggagtgtccttggtatggctgggggaaggaaggtggccagtgtggctggatcagagggagccggtggggagtgggtaagaaagaagtcagagaggaagggggtcccgaacatgtagaccagtaggggaactttatcatttacttggagtcaagtggtccttgcagtggaacagccacgcagaagagtgacatattctaaaataatggaaagcccatctggctgctctgctgagaatacaaagagtgggagtgttaagggttgaaacgctgtcatttcttttcttttttaaaaagagacagggtctcgctctgtcacccaggctgagtgcagtggtgcgatcatagctcactgtagcctggaactcctgggctcaagtgatcctcctgcctcagcctcccaagcagctgggaactacaggcatgtaccaccacgcccagataatttttaagtttttcgtagaggcagggtctcactatgttgcccaggcaggtcagaaactcctgggtttaagcgatcctcccgcctctgcctcccagattttgggattacaggcgtgagccactgtgcctggtcactgtcgtttctcacctgggctgtatgcaatagctttgaataggtcactgcacttttttctacctctgcaaacttcttcacacttcagtgttcttctctctgtcatgggccaaatttccagaacgctctctaggaacagtcactggaataaaatccacactgcaggggtggctttgaggtccatgtggtctggcctccactggcttttccagctgcaactcctgctgttttctgttccactaaccctgggagctgtcatccttccatgcctttgcccatggtgttctatcactttctgttcagcaaaatcctttcttgttaagctccatctttccttaaaagccaccccagaatctcccagtcaggatgaatctgcgagtcttcacatgcagggatgggatctgtgtctgtggagcacaccttagtcctggttgcattagagtcactcagtgcccacctggctcctgtaccagatggggaacccctgtgtccacctttgcattttgaggtccctctcagtgcagtggaaattgccctgcacaactttcaaaattgttctcgtcagtcggctttttcctgttctgtcttgcagattgaagcgctcgtgaaggacatgcagaacccagagacaggggtccgaatgcagaaccagagggtcctggtcaccagcgttcctcatgccatgacaggtgatgtagcttgcactttagtcttggcctggaatagaccccacaggcccaatacggcccacctcctgtgtttgtaaaaaactttatttttggccaggtgcagtggctcacgcctgtaatcccagcactttgggaggccgaggcgggtggatcacaaggtcaggagatcaagaccatcctggctaacacggtgaaaccttgtctctattaaaatacaaaaaattagctgggcatggtggcaggtgcctatagtcccagctactcgggaggatgaggcaggagaatggcctgaacctgggaggcagagctttcagtgagcagagattgcgccattgcactccagcctgggcgacagagcgagactccgtctcaaacaaaacaaaacaaaacaaaacaaagctttatttctaaataaagttttattggaacatatccatgttcactcatttatgtattgtctatggctgctcttacactacaatggcagagttaaaatatatagttgtggccaggcacagtggcttacacctacaatcccagcactttgggaggccgaggcaggtggatcacctgaggtcgggagttcgagaccggcctgaccaacatggtgaaaccccatctcttctaaaaatacaaaaattagccaggcatggtggtgcatgcctgtaatcccagctactcgggaggctgaggcatgagaatcacttgaacccgggaggcggagtttgcagtgagccaagatcgcaccactgcactccagcctgggtgacagaacaagactcccacaaagctgaaatgtttatttactatctagcgctctacagagtacatttgctgactcctggactaaagtcttcctctgaggaaggggtcaggagggagaaaaggactcaacaggtcatttcttgaagccattcctcccagaaggtcattttagaaaccttcactgtcattttttgttttgttgttttgtttgctttgttttaatgaaaccaagtagcagaaaaaaaaatactatttagcagaaaaaagttggcctttgttttgctccaccgtttaccttctaattcatttcaggcccttctcaactgccctgtgggagtggtgccactgtctcctctctgtgtgtgggggtgaggtgcctacagagcatcatttggggatattggcaagaagggctggacgccaatattaagagagcattttggttaatgtgttacctgttttctgatcttgattttgcagtaaagacaatgtttcatacttaggcgtattgcctgcagaagcagacagcttctcatagcccaagcccgggcctcaccacggctgtgctcaatgtgaggcctccctctctatgccacccctgacctgactatttatttttcactcaaggtgccctagtctttgcagagacaagctggctcacagcttcccctttccctttctgactgcttagaagaaaggatgcccccaccagcaatgtgtcactcaggtttccttgcatgcaagcaacagaagacccactcttttgttggagcaaaaggggaagtaattgaaatgctatagagcagctcatggaggaaaaggaaacactgacaagccagactttggaaaggccaagaaccagcgtagctctgggcacccaaagagtggaaacagggggcagacttttcagggtgcctttgtgtcccccatcacctcagatgcagctggggcaattcttcctgaaggcatccctgaccctgtccccctccctgcctttgactgtcattaattttggcctgaattctctactggactggggccctttaagggaaagtaccttgtcttgctcatctgggtaatcccaatgcttctcagagctgtgtttgtaacagatggttagtaaaagtttattgaatgcatgagtcacttattgtctgtccttgtgtggagagtgaaggattaaatccttcaggtgtcttttctagctgtagccctggtctcagtttactttctccattgtttttgtttgtttgttttgttttgtttgtttgttttgagacagggtctcatgctgtctcccaggctggagtgcagtcataaaattatggctcactgcagccttgacctcctgggctcaagtgatcctcctgcctcggttttccaaagtgctgggattaccagcttgagactccacagctggccagttttctcatttttaatgcaagaatggcaatccctccctaagggaacgagtgcaggaaggaagtgagagagttctgtgcaggtgctgagtatgcagtgggtgctggatggtggtggtagctagtgctttcccacacattgtctgttaacactcacaataaagttaagggtagatatgactgcccactttttgcacatggggttatggagaccaaagagtttcagcaacttgccttcatgtccttaagctcatttcatgagtgagcttgaatttcagcccagcaatgtgactccagagtccatatatatattttatttttacttatacttttttttgagacagggtctttctctgttgctcaggctggagtgcagtggcactatcttggctcattgcagcttctgcctcctgggttcaagcgattctcatgcctcagctccggagtagctaggattacaggcacccaccaccacatccaactaatttttgtatttttagtagagatgagatttcactatgttggtcaggctgatctcgaactcctgacctcaggtgatccacccgcctcggcctcccaaagtgccgggattacaggcatgagccaccgcgcccagcccagagtccatattcttatctactgtcagttgtgcaccagctgctttccttccctgcacacggggcacacttggttcctggatttgggcgaggtcgcccatcctgccatggcttccttgttcctcctgcacaggtgaattccagctgctgtagaaacaacacagggagaagccctggtcctgcaacaacagcaccgataaaaaaaaattatttaacttcttggacggcaggcgtcccagggcttcctcgggacaaaggtggctgatgcgggaggctgagcagcctgccaggctgtcaacgtagaccgcgtggtacagatgctggtggcaccataatctcatttgatctatttcgggaggcagtcaagtggatgagaaagccctcggctcctcggtggagagagctaatcagtctgatgtctgcctaggtctgtctctctgcctgcgcaccactgtgtagcatttaaagagagagacttggtgtggaaagtctaaacacccagtcctaggagtttagatgaaggattttgcttttgaacagccatccaggagtgaatgatgctaagagcaacagagggagaaccatggaaagccatgacagtgtgcatgtggacactgacagagatcatggctggacatttgtgtcctagggtgtgggcatgaagggaagaattacaggttgtctacacccagccatggtcgtaggcaggcaattacgcccagagagcgtgtatatgggtcataagaagaaatgtccctgcaccgcctccgaggagggaagtatcattggcaattatccagacataagaacacagggagtggagtctcaatcctggccctcttctttgatgtgttatgtgggcctgtttccatgcagacaggcttccagcttggcctttggaaagcaggctaagattgctggaaaatgtgaccattggcatctgcacgatggtatctgtgatgcggtgcttcgttccagggcaccttgtctatcttctgagatgctattaccttgtgcctacgagctgtaccttctgcttgtgaggtgagagggcccaggctgagggaaggggctcagagcttctgtggggtcgtacggcagctctgggcttgttggtggaacttggcttgccttgacccttagataaatctgaatccttgaggggagcaggtgggtgggacgggtgtacgggtgcacattctctcctggcctctgagcccgcctctcctgctgtttttcatgccattttttcatgtttttttgtgtgttgttcccaagccagcccctaagatttgcagggcctggggcgagagtacacatggagccttcattccatcatctaaagttataaatcaactaggataggtcccaacctcctaccctgacaaaagtaccttcacaatgtcatggaaggccaggttcaagtttagaagtttctgactcctcggagttctgcctgggaacttggggagttggagagccggccccagccctcagcctgtcctcttctcatccctgtctctgttttactcccagagtcccagcttggtccagagccctgcaaacagcttgcctcgggtctgttttgtgtgtgtgtatgtgtgtgtgtgtgtgtttagacttagcctatttactatccagttagtgaataacagaccatgtacaagttatcgtcaggtaaaagatcaatacaacaagagatgtaaagatgaagcgtgtgtgtatgtatgtgtgggctgggggtgcgtgcggtgttaagttgcacatctgctggagtcagatcatggatagccttgaattacaggctgcagagctgggactgagcatgatgaggtgggggtttctgaaggttctgagcgaagaggaatgaaatcgcagctgaacgggaaggagaccagtcaggcaacagcgtggaggagcggggatgtgtcaggaggctatgacaataaccgcaaatgtctcttgtttttcaggaagtgatgttctgcaatggatcgtccagcggctttggatctccagtctgggtgagagctcatctggcactcagttatccgggacagctttgtgtacagcaccatgggagaaactaaatagagacttagcctgtgtttctgagaaatttacattttaattggacagacatgaccttcgtgtgtaaaagtaccagaatcaaaagcaaaggcaggataatttggggacgaaagagttattttgtacaaaatatttagagcataaataacagggataagtggggaggactcagtcaagaaagtcctggagggggtgctgtgtatagctggtcttgaaagaagtgatgcttgtgaattggtgaagaggagctctgagggtcttcctataaggggacactagcaagagcaatggtttagaaatggaatgagtggaaagtggaggagtgacaagggagattgagagtcatggctccagatggctatggagggtggcagaggggtggaagagcacctgcagatctgggagataggcaataggaagccacaggcaatttttgagcatggcaatgtgcctgataatcatatttcagctagggtgcctcgcagtgtcaggcctctgagcccaagctaagccatcatatcccctgtggcctgcacgtatacatccagatggcctgaaatgaactgaagaatcacaaaagaagtgatatttacatggcctgttcctgacttaactgatgacattccaccacaaaagaagtgaaaatggccagtccttgccttaactgagggcattaccttgtgaaattccttctcctggctcatcctggctcaaaaagctcccccactgagcaccttgtgaccccccactcctgcccgccagagaacaaccccccctttttcctttacctacccaaatcttataaaacagccccacccctatctcccttcgctgactctcttttcggactcagcccgcctgcacccaggtgaaataaacagccttgttgctcacacgaagcctgtttggtggtctcttcacacggacacgagtgaaaggcagcaatttagaaaatggattggagcagaaagaaactggagagtagatttcacactagaaaataggctgttggtacaatgaggcatacaactttaggacttggtctttgatggagggagcgagacctggagagggagggctggggaggaagtcttcccacaccttggaggctgagctatgggatggggagatgggttgggtccttgggctggggggtcctgcaggaatggagggatggaatcctccccagaggatggaaggatatctgctttcattgatgctttggagaaagaaccaaggaagtttgtcctttaattgatataattgataaacaaggctgtgcttccgaataaactggagcagggtgggaattaaagtgaagtgggaaggagaggaagggtctggacccgagatgcaggcagaggtgagcttgggatagaagttggcaataaacatgatgctccttgctcattcttggagtgacaaagtgtctgttggtccaacagagacattttcttcccagtcctgtgacctttcccagacccaaagggcctatagaggcttctctaggccttccttaaccatcacccgctgcagcagaccacgtgtggtttctgttaacatccagatttcctagttcccatctagacttattgagttgtcactcctggggataagacctgggaggtcctccttttagcgtgcaacccagctcacgcttgtccacagccaagttcagcaaccagtgtcctcactgctcatgagatgcagtgctgttaggaaggggcacctgtcctggagtttggggtgccgtgggggccggcaatgagctcctgtctcagccctgctcttaacatccatgtctgaactgcttttcccagaggcacagaacttgggcaactttattgtcaggtatggctacatttaccccctgcaagaccccaagaatctcattctcaagcctgatggcagcctctacagatttcaggtgagtcttggccttgaccctggctgttcatatggggttgatctcatttgaaaaggtggggttcatagtttcacagatcaaggacttcagaaatggtggagggggccaaggtggttggatttctttagtcacagggttggggtccattgagtcacaatccagttttaaagcgtggtttccctggtttcttttgcagacaccgtatttctggcccacccagcagtggccagctgaagataccgattacggtaaatacttcagccccaactatgcctttggtagtgcttaacatgctgcttatttacttgctgcactttggtgacatttgtcttgctgtcatcatgacctttctgtcagtccacatctgtactgggcatgtccccaggggcaaggggctgggtgtgctgagcgttctctccccgactctgagcacagcagcctcaggcttagggaggctgcagatggggttttgaaagatgatgatggaaaatgtcattgctttcttttccagccatctatctggccaagcgaaatatcaaaaagaaagggattttggaagaatatgaaaaggtatggaggtgcttttaagtagaggttgttataattgagtggaagatagttttgagctgtactttcctcattcccacatcactacattcatatgcgcccacattcatatgcaatccatccagccagccagctagccatccatttattaattagaagcagctagctgaagtaaattctttctcatgtctaacttcagtttctcttgctgtaatttaagcccttgcctcagtggctactgggcacacagtggctacccacttccttttgccatcccaaaacaatgtgacataataaatatgtactctaatggacaacccttggttaacagatttgaacttgaattgttttttttgtttttttgagacaaggtcttgctctgttgcctgggctgaagtacagtggcatgatctcagctcactgcaacctccaccttccaggttcaagcgattctcctgccttagcctcccgagtagctgggattacaggcgtgtgccaccacgcctggctaatttttgtatttttaatagagatgaggtttcaccatgttggccaggctagtctcgaacttctgacctcaagtgatctgcctgcctcggcctctcaaagtgctgggattacaggtgtgagccatcgtgcctggcccgaacttcaatttatgatgggaaaacaataggactgtatagacttttgttttaggctgggtgagtccagtttcccaaagaacacatgctagccctcaaaaggccaaaatttctgggtggagggttaaaatcttgctgtgtttttatttttatttatatatttatttatttatttatttatttatttgagacaacgtcttgctcaatcacccaggctggcctatagtggtgcagtctcggctcactgcaacttctgtctcctgggctcaagcctcagcctcccaagcagctgggactacaggagcacaccaccatacccagctaatttttgtattttttgtagagacaggaggcccaggctagtctcaaactcctgggctcaagtgatccatccacctcagcctcccgaagtgctgggattacaggcgtgagccaccatgctaggccacgtgtttttattcttacaaacatgttttcagaaaggccggtttatctttgttttatcttagggtttattttgtgaatttgtgatgctctgttgttgaatagtgagtttccaggttgggtgtggtggctcacgcctataatcccagcattttgggaggccaagatgggaggatcactcgaggccaggagttcaagaccagcctggcaacatagtgagaccctatctctacaaaagattaaaaaattagccaggtgtggtggcatgcacaggtagtcctagctactgaggcaggagaatggcttgagcccaggagtttgaggctgcagtgagctatgattgtgccactgccttccagcctgggcaacacagtgagacactgtctcaaaaaaaaaattgattttcaaattatttttaatctctgatgctctcttcctaatcagatttgggatacatttatttatttatttattttttatttatttgagaggaagtctcactctgtcacccagcctggagtgcagtagcacaatcttggctcactgcaagctctgcctcccaggttcatgccattctcctgcctcagcctcccgagttgctgggactacaggcacccgccaccacgcctggctaattttttgtattttttttttttagtagagacagggtttcaccatgttagccatgatggtctcgatctcctgaccttgtgatctgcctgccttggcctcccaaagtgctgggattacaggtgtgagccaccacgcctggccgggatacatttatttttacaaaagcaaagaaaaccaataaaagtgaggcttcttgtgaaagtgttttgagaattcagctgctccttgagtgaacaccatggtaaaaccagcttagataccatcgggctgggtccatggttgccatgagccaggggtgtgcccttgctgacttagagtttgttgccctgcggcacatggcatatgtcttggggctttctgttctcattttgtttttcttctttaggaaaattacaatttcttgaaccaaaaaatgaactataagtgggactttgtcattatgcaggccaaagagcagtacaggtgagtgaaaggagaccatgcttgtcctctcggtgtctttcctccctctcttccttctttgtttctttttatttattttattttttatttttattttttttttgagacagagtcttgctctgtcgcccagcctggagtgcagtggtgtgatctcggctcactgcaacctccgcctcctgggttcaagcgattctcctgccttgcctcccaagtagctgagattacaggcacccagcaccatgcctggctaatttttatttattattattattatttgtatttttagtagagacggggtttcaccatgttggccaggctggtctcaaactcctgacctcgtgatcagcctgcctcagtctcccaaagtgctgggattacaggcgtgaaccactgcgcctggactctttccttttattaaaataaacttgtttttgagcatttatgtgcctaacactgggctgcgcagggggaatcaaaagacacagtctcataggtcaggcagatgaaagaataggctatggtgctgctgtgagatgagggccacctggctggggttttcagaaggaatcgtagaaatggcattgaacctggggaatgcataggaggggtccaggtgaaggatagcagttgtggaggaagaggagaggtgtggtgagaggaaggggctctcagcaggcagaaccagaggctggaggcaggagtgtgcccactgcaagcagttccttgcagctgcatctgagagtgcaaagtatggaattaggaagatgtgaactagagatgttagcaagagtggatcgtgagagggctttgtggtgagggccatagggagccatagaatgatgtttaagcagggaagggatacacagtgatcagattgtcatgttagaaccacgcctcgttcacttgcatttgcctgttgccatatcagaactggaactggaagtcccctccagggctctgccttaacaagagctggatgcagatattggggacagggagtggtagggagagggtgtggtcaggacaaggttagcctatcattacaaacagcccccaactctcaggggctggaaaccacaaggtccatttcttgctggtgctcctcatccaccgtggggcagctggggccctgacatgctttccccacttccaggacccatatgcagaagaagcagcaccatctgggctttgtgcgttgcttagcagggacagggatttcctgtgtgtatcagagcagccctgtcatcctgctcatgagtcactaggcaaagcaggtcaacgtcaaaggttggtgggtggggacatagaatcctactaggtgcctgagaagagggacagctgggaacatctggtgacccgcaccagtgattaccaaaaccgatgatccccccagtccagcctcactcgctgtgacagtcccagatccaggaaggtctagacttgctggtgctcagctgggctggatggggaagacctgattctcacccagcagcctaggtattggagtagtgatgaacactgtttatgggagagctggtccgggaaaaatagattcttatggcggaacagctttattgccctccaggggggaaaatatgttcttagggtttagaatcaggtagaacatcagtgagagagctgccactgctcattagccacaaacatgtttctacctgggtacatttgaggcgaaacaacacgggttatctttaatcacttatatttgttcataaggcttcatttggtgagtttctgggtactgtctcactttatgttggtgtggggaaatacttaccatagtaattattgtcacccttcatttctacaaatggggagactgagacttagggaggtgaaaattacttagctgaagtcacttggtgagataatggtagatcttaggctgatattacttaattccatttgttgcaccagttttgagtttctgatgggttccagcactgggctgggctccagggacacagagatgggtaagatgtgcccctctccctcaacccctccatcccttcttcctcctgtctgctctgagcaggactatcccagcaacccacaggactatgaaccctgacatctgctttcttgggcgctctgggtgctcttgaagcttggagctgttctcagtgatccctgcaggtccaccaccaaggccttggactcagctgcgataaagctctgtgctgcccaggtcctgggacattcccctctttcattcttccaggtgccttggaatgagcgattcctaaaaggcttgctccatttgagatggctttttcccacttattttatggcttaaaggctgcctctgatttcagatttagggtctcagcacaaaacgtggttgaccatgtaggttggcccataaagtagtcattttgttatgctgagtcctgtcttccaagttccacactcagcacccagacagctactcaagatctcatgttgctgtcaaacctcaaacttaccttgtccatattcaaatatgtctttccctcactctccaaacctcttcctccagtatcacccatatcagtacctctactgcccctaccctggttgaaccaaactcaccgtcacctgaaccatggcaacatcctcccaactggcctctctgctcccaatttctccccatgtttgaaacacagataagatcacctcaatccatcttctctagctatcggggagaacattcacttccaatgttacttcctcaaagaggcttttctgattagctgttactgcactcagatcatcctaaatttagtggctcaaaacaacaacaattattttattatgtgtcctgatttctataggttagggatttgggaaggtcttggcctatcaattctaactcagagtctcttgagtggttgctgtcagatggctggagctgggggcctggagcaactggggctggctggcatttcctactctcttcttgtagcctctctgtgtggtctagcttgagctacctcacagcatggcggcatcagggagggttgttagattgcttagaggtgtttggggacttcaagaccacatattccagtaaggagggtgactgctgtcccaccttttatggcctggcctcagaaattagtgccatgcctgacgtcccatgttggtagaaaccatcacaaaatcccatctagcttcaaggggaggagacatagacacatctgtcaatggaaagagtgtcaaagaattgtagacatatttaaaaatcaccacagaggccatccctgatgctgcatgatggtactctgtttccttatggcaaataatgcaatttgcaattctgtattgattctttgactgtgtatgtgatgtttagctcaaaagctactcaagggcagggactatgtttggttcaccagtagactcccagtgcttggaatatactggaagatcaatgagtacatgaatgaacgaatgaatgaatgaaaaattaagcaaatgctgttgctgaaaaaatcacaaactaaagtaattcctaggttactaactctcttgcattccatttatcatgactctcctctaataacatctgttacagaaaagcagaagagcaaagccggaaaggacccgtggggtaaatcagagagtgactctatttaccaggctctccagcattgtggaaactgcaatgcctcaggctggttgtggcccatgctcctgaggtcaggggctagttaatgtggtagaaaatccagttaggctgtcagggggaagtttgaaaacaatgtttatatttaatttccagaggaggctgacggaacgcccaaatggaatggcgctgttcacccatctggctccctgagtgttatgatgtttttcacagtacgttaacggggagatgaattcgccgactctgtcttgcagagggcgtgtgcgtcatcccacgttgcctgggaaaacaagcattaacaagtgtgagcgcgggtctccgtggaaatggtacagaagggggcccacggcgggatcattagtgttactttgcccctggaggaagaaggccctgcgtcatttcccatccagagtgggaaagggagagagactgagagataaaaaggaaaataaacagcccttttttatttatttatttttttttgagacggagttttgctcttgttgcccaggctggagtgcagtggcgcgatctcggctcactgcaacctctgcctcccagattcaaacgattctcctgcctcagcctcctgagtagctgggattacaagtgcttgccaccatgcccggaacatttttatatttttggtagagacggggtttcaccatgttgatcaggctggtcttgaactcctgacctcaagtgatctgcccacctcagcctcccaaagtgctgtgattacaggcatgagccactgcgccgggccataaatagccttttatagcaataagttgtgctcagaaaaagccccgacgtggcatgaactctttgcagtgccagagtagaagttacaggcacggaggagagaggactccccaggccagcatcttccttgtcaccatcccacagggggttgcctgcctgaccagacgttgactatgttgtttgcccaaacagggaaaagttaagaagccaggaggtcaaatgtcgacccggaagttcacccatgcgcgctgctctctaatgttgaagttggtggagttggtttgatttagggctggtggcggcaatatgatctcagtgcagcactgtcctgtccgggggagttagaccctggccagactcccaagtgcaagtgccacttctgccaattgctagcagtgtgaccctggtgggctggtggggcattcaccccctcttcatttcagtgccctgaactttgaagtaagaaaaggccaccgggaggatgaagtgggattaaaagagttaatacgtgtcaaagtggttagaagggtgctagtacttaagtgagatgtcagtgcttgctgtgttcattactattacggtatatgtgaattacttgggcaggttgggagaggggtctaggtcatcaggaatgaggggcatcactaatcaaaagacacaaagtcttcctggccttacacgtggcttttggctttccagggctggaaaggagaggaacaaagcagacagatatgccctggactgccaggagaaggcatactggctggtgcaccgatgccctgtgagtatcctcctgcctggtgtcctctgtctcttcctgtgcctcccacctccatcctgtgctctccatacctgttgccaactcctctttctctagggcgagaattggatcagcaggaggagctgctcagtgttgggttagcatccaagtgcctcttggccagaaaaggaagttctctgcctggatggggtctgctcatggcccatctgttggtgttaggtagggagggacctgaatgaatttgtcttttacgagggctgggacttttttttttttttttttttttgctaggatatcataccttgggaaaggaatataaggagaaaaaattagaacgtaggccccaatggaggcgccaatgcagaaaaatagagtcccgtgagaatggaaactgcttggccaaagttctccttggtgtctctagctccctcactttttcctctcctagatccagttcccagcagctgagatgggagaaggagaaggaatacgtctgtgttgagcttctccttgcttggagcacactgaatctctggctttgggacttcagtggcccagagggacaagctgtacagagctggtgtaacttgccccagctcatcactgggaaatggtagcctcattccccagcacacagaagtggggtctgactgctacatactgggattaactctgctacctcagtttcctcctgtacagctccctgtgctgcctatgggtcatgggaggtaggagatgtgaatgagattctggaaaccgaagagttagaaagaaatgttcttcctcctcttcctttagcttccttgcctgccaggtatcagaaattctcagaagcagaaggagaactgagtgaggcctggtgtcagagtttatggatttttgagtttcaagcccatccgattttggctgttttgcttatattctttatatactgaaaacagattctcctaaggtgttccactctgtagcggcatgggtttggatgctgtgttgctgaggttaaggtgctgaggttgatcccaaacagcttgtttgattttttctttgcttcagggtttctcctctagggaaaccagtttacagatgcctgacgcaggtatctgggggccgggtgacagagcacagggtcccagagataagcacccctcctggttggtagcgaagaaactctttgtatgagaaggagcctcacattgctcgtgtgttccagaagcactctgtggtgaggataaggagacatggcggatatgccacatttggcaagacaccttggtgcccagtggcaccatacctgagggtaggtaaagaacggcttctatattatgtgcagagactcctcactgtgcgaatgcctatgtgactacattccttgcaaagtgacatagactagctatgcattaacatgaaaaattgatcatccgggttcttctcagttcttctggggtaagttctcagcccccaccaggctagtggctgagtggctcttcacaggatgatgctgaatcacataaatatgaccatgtgtctctatgaccactgcctcccccccagcccatctccaccaccatgaccgtcatcccacctcccactccctcacctcctttatctccctgacctctaccacctctcttatttcccccactttctccaccacctccaccacccttattgtcttcatcactgtggtcactgtcaccgtcaccatcacagtagacatgaactgagaactcccagtgtgctgggcactgtgctaagccttctgcattcttttttttttttttttttttttctgagatggagccttgctctgtcacccaggctggagtgcaatggcacgatttcggctcactgcaacctctgcctcccaggttcaaccaattctactgcctcagcctcctgagtagctaggattacaggcatgcaccaccatgtccggctaattttggcatttttagtaaagatggggtttcaccatgttggtcagcctagtcttgaactcctgacctcgtgatctgcctgcctcggcctcccaaagtgctgggattacaggcgtgagccaccgcgcctggccgccttctgcattcttattgaacctttgcagccctgtgtggaagggtttattattattctcattgtactgataagcaagtgaaagctcaaggatgctgctaatttgcccaaagttacacagctagttagtgccagagggtctgaacccacataccactgactgtggagcaccaacccctgcaccttagccctgtgcacttctgcctctcatgacaatgtcatgtgatatcttggtacagttcagtcctttggtaacctcctcggtcattagaacgttgcctgggtcactgctgctctaagaagccgaatgcctgggtttacacgtgcctggtccttctttgacagcactggggacccaagttcagcatgaggctttgatggactcagagtggtcctagaacttccaggactaaaaactgctccccacatctaacctctttcatggctgctccctgagtgaaaaccagaccagtagtcaaagatgaggcaggagagtgcagtggccccactctctgtgattttcttaaaattctccccatctcttgttggcctgtgggggtggaaggtagtgtttttgaagagcatctcagtctagaaattgagcaatctgactgacaggctcaggaagccccggagctcacaggctgccagactgtctccaggagacccaaacaaaccgtcagttcaatgggaaaaaagccagccaaggcaaacaaagcacttggcgccgtggagtgtcgcggccactccgtgtcagactgtaaccaacagttgtagagtgagacgtggcctgctgttactgaaccgactcattcacttgttcatttgtctgttcattgatccatgaaatcttcgttgagccttgactttgtcccagggaaggggttaggtgctgggtgtgaaataacagccaagagtcattgagtactcctctgaacctgtgttaagctcttggcacagatgacctcattgacgcctgatgctatgatgtagggaatatcaccatccccgttattcagatggagaaattgaggctcatagaggttcagtagcctgctcagttctgggagaggaagccacatctttctgatggtaaagcccgatattctgcttctgtgcaaggaggccccacccgtggtccctctctcagctcaaggagctcaaaatccaaattgctggagcacaggtgagtgacactctcccagagataagacctaattgcagaaggggcacagcgagagggtgattgatttagaaaggcagggagaaatgtctgatagatggtgtttcagggagatcatcactggcaaaggccaagaccccacgtgggtggtggtagttgagggctctgacctgaattcctacccagagcccaaaggacacctgtgattcagcatcctgtaatgaaggaaaacgatgtttctcacctgttttttactcaaatggaaccaagtacagatctgagcacgatgcaaacaacagtgagttttgtaaatgaacaaagggagaaagtgctcccttagacaggcatgtggaggccttccctgcatctttgctgtgccatctgtgacttcctgcctcccaaggatgtagtctgaggctgcttcctggcggtgggtgtgcttatctgcttatcaagctaaatgacccttgtttcaaccacatatgcagacacttgccagagatgtctgccctccatttcccatcgaagttaggctaaatgtccaacaatggaaaatggcaaaataaattgaggtatattaacatgatggaacattgtgaagctattcaaataatattttcaaaggccattcattgatctaggaaaatgatctgacatacaatgtgttttttgtttgtttgttgttttttgtttgtttttgagacagagtctcgctctggggtgcagtggcatggtcttggctcactgcaacctctgcctcttgggttcaagcaattctcctgaatcagcctcctgagtagctggaattacaggcgcctgccaccacacctggctaatttttgtatttttagtagagacggcggtttcaccatgttggccaggctggtctcgaactcctgactctaccttggcctcccaaagtgctaggattccaggcatgagccactgtggcggcctgacacataatgttatattataaaaccagggtgggtggaatgctccatgtgccatggtccaaaaataaaaaataaaaaaaattaacatatattttgtgaatatctgctctatgccgggtgcttactaggcattggggatatttggattatgagccaagacagacattgcccgtgacctcaaggagtttcttgcagtctggtggagagacaaagactaaaatgattaaaccaatgaatgagtaacaagcagaatgccatggcagctggtaggaggcaggggctctgcgtccggttgggggtcagggaacacaggacacaggacgtggagagtgacattcaagccaagatcctctaggagctgactttcctaacacagcaacataaaattgtctccctgtttcacctcatctctatttcttttttctttctttctttctttcttttttttttgagatggagtgttgccctattgcccaggctggagtgcaatggcgtgatctcagctcactgcaaccttcgcctcctgggttccagcgattctcctgcctcagcctgccgagtagctggaattacaggtgtgcgccacctcgcctggctaattttttgtatctttagtagagatgggttttcactgtgttggccaggctggtctcgaactcctgacctcatgatctgccggcctcaggctttcaaagtgctgggattacaggcatgagccaccgcgcctggcctcatctctatttctttcccctgtcttattttgtttagaaaacgagttagtgttttacttagtatttgttttctgttccatgcaccagaagagtctgatatttttgggaagagagtgaagctgagagaaggaggggcagggggacacggtggagtaccaccgagaagtgtccgtcagctccacgctggccttgctctgtatgtgggttcctgggaacatcgcctcctcacgagcagttgtcacgagtacaggagctcctttcctgacctgaatgatgatgcattgagcaaattgcctctttggcttacacccaagggatgttgtttgtggggggcggggtcataccctggtgttcacagttcctcagggtggaggaggggagcttgcatgtctctgaaggcttcctgcatgaggcaccagggcagaaagtgcctgctgcctccttatctgcgggccacacaccgcaggatgcatcggctgcccttatttcctgggcgctgacagtcagttctggttaacttcatctgaacaccctgttatgtgccagaaactgtgtcagcagcactctggtgatgatcatagtgggtcaaagactttacactacctgatgaatgaagaaatggatgaatgaaaggagcttgggagtctctgaaaccagcagaggcagaaaggcagccctctcaccagtttcgagggcagggaactggaaaaggaccacagcttgattgggaacaactgagacttaagggctgctgcccacagaggtgcaagagccgaggcagcagtggccagaggactgtgcctggctgttctgtagggaaggcatggagagccaggttggggctggaactggacaggctggcagaatcatgaagcccagtgggtggctgcaggtctgagagtctaaggccgtctggtctgggcagctgagggcatagaggactctatctcagttatgcagtgcactgttgagcactggggcaaccaaatttatatcagagcctggggcacattggaaggaaagaactagataacgaattcaagacttgagcagatgaccacaccgaagtcaccgaggcagtgagcgcctgtggaatagcagccagacactggttgtagggcatcatgagcacaggctgtgtgtgagtgtgagtgcatgtcagtatgtctgggtgtgcatgtatgtgagtgagtgtgtgaatgtatgtgtgcgagtgtgtgtacatgtgtgcatgtgtgtgagcatgtatgtcagtgtgttggcgtgtcaaggtgtgcatgtatgtgagaatatgtatgtatgtgtgagagtgtgtagatgtgtacatgtaagtgagcatgtatgtgagtgtgagtgtgcatatgtatatgtgagtgtgcctaggtttgtgcatgcatgtaaacatatatgtgtcagtatgcacgtgtgtgagtgtgtgaatgtgttatgtgtgagcatgcatatgtgtgtgcatgtatgtgagcatgtttttgtgtattcattctcatagtgttataaagaaatacgcaagactgggtaatttataaaggaaagaggtttaattgactcacagttctgcatggctggggaagtctcaggaaacttacaatcatggcggaacgggaaaaggcacatctgacatggtggcaggcgagagagagcgagtatgtgaaagaggaactgtcagacacttataaaaccatcagatctcatgagaactcactatcatgagaacagcatgggggacaccacccccataatccagtcacctcccaccaggtctctccctcaatccctggggattatggagattacagttcaagatgatatttgggtgggaacacagaaccaaaccatattaatgtgtgtgtgtgtgtgtgtgtcaggacatgtgtgtatgtgagtgtgtgtgagtgtgcatatgtacatgtgggagtatgtgtaggtgtgtgcatgtatgtgagcatgcgtgtgtgagtgtgccagtgtgtcagggcatgtatgtatgtgagcatgtgtgagtgtgcatatgtatgtatgagagtgtgtgggtgtgtgagtgtgagtgtgagagtgtgtgaacgtgccaaagtgtgtgtatgaagtctgccttcagttatgcagggggatttctccataccagattcagggggcaactcctagaaccctttttggcaaaggcactgactctgctgagcccctgccatgtgaggttagatcccatggtgttatcccttcaagacacctgtctcaactctaatttatcctttgtgtgattaattgctgagtggctacctcccccttgagactgggagtgcctcagtaatgcctgctggggagcagtggtctcggggcacactcaccatgggctccccagggctcagcacaatgtccggcacataagaagtgccccatagatatttgctgatcaagatccacttgtaacaactagggtaaggatggccattccctttccctgtcctcctccccacccactttctattgccttttcctttctcttccctgtgtcgtcttgtctgcacatatttgcctccatggtagcccggtgagctaggttgctagatttagcaaataaaatacaggaaatttggttgaatttgaatttcagataaacaacaaataatttttatgtaaaatgtattttgtatatttagtataaatatataataagcatcaaaatattgggacagaaattatttgccatttatcttaaattaactgggcttcctacattttatctggcagtcttacatctgagctaaaacccagtctgatcccatggatgaggctgaatttgatggcaagaaagcccagttgcttcccaactctctgcttcagtgtagccaacctggttggtcacatgtgctgagcaatgggtggatgcctggcatcacacctgcatcaggggaagtgaaagacccaaattattggtctcaaagagtcaaggagttgagagagaccaagtaagattttctggagagctgggttacctgctggcaaagggaactaacagagattacagtcccagttttgggccattcttttacatatgtaatcttaaaatgaatacaaccccttgctcagcaatagctaccttctgtggagagcttcacaccctatcttgttaaatcttcacaagaacctgccacgtaggaggattcttctctgtttcttagagaggttagtgagtgccaagacaaggagtgttttccaagatcttctgcacagctgggaagtggcagaaccaggagtggcacccagacgtgcctgacaagcctggactttcccaaagcactgctctgtcacttcacttttcccgccaagcccaagatgaaaccacagagtgtggggaaggagcactgtgggaagagtcaggaagcccatgtattagtctcagtgaactcttttggagcctgaatgttacccatccatatgcccactcactcatccatccatctactcactcaaccatccatccatccatccatccatccatccatccatccatccacccatccacccatccgtctatctcttcacctatccattcaccatccatctaccacaaatttacccattcatccatgcatccatccctccatctatacatcccactatggtgctgagtttgccattcatctgtccatccatccatccatccatccatccatctcttcacccatccactcaccatccacctaccacccattcatccatccatccctccttcccttcctccatccattcgtacaccattccattccttcatccatccatctcactatggtgctggggatgccattcatttgtttgtccatccatccatccatccatccatccatccatccatccttccatccctccattcatccatctcactatggtgctggggatgccatttatctgtccgtccatccatccatccatccatccacccatccatccatccgtttattcacccacccaccatccacctaccacccatttacctattcattcatccatccacccatccccctctccttccctctttcctgccacccatccaactctggtgctgggaatgccattcatctgtctggccatccatccatccatccatccactcacccacccatcaaccatctacccgccacccatttacctattcatccatccacttatccatgcatcccactatggtgctggggatgccaaccacctgtccatttttccatccatccacccacccacgcatctacccatccttctctccctccatccttccatctcactatgttaggtgctggggatactgggaggcataacagccctcatgaagctcaacagctcacctggagggtttacacccactcaaagcttcccatgggctaggccacaagctcttctcagctcaatctcacaattggcagattaaccaagacccacagttaaccagaaactggagactctccctgtaatgaccttatgttgtttttattccatttagcctggaatggacaatgtgctggactacggcctggaccgagtgaccaatccgaatgaagtcaaggtaaaccaggtatgtctctgctgcatagtttgggtagggcctaggtcggattctggggctgggaaggtgtccacatgtctattcgtgtctgttagggcaacgatatctcctctttgagactatcaaagagaggaggaccgtgggctctgtggactcagggttaggggagaagtgggaccatggcaggatgctaggtgagaagaaattacgactgaagacagacagaggctgtagagtgcagggaagagctaatgggatctagatggctggttttcaaacttttctgagtcacttcccccttcgaaaatctgatgaaagttatgagctcattccactcaaagatgcacagacagacattctgtacacagtttcagccagttccttgatcctgaggagactgtagaccccagcctcgaaactcttgaatcagttttagatttaaccttaatccacatgacaggacctggaatctaacactttctttcacatcccagtggagtgggatctttgtaaagattctccaagcaggtttcattaaaaaaaaatacctttcctcaaataggccatctttcatgatggatagccaatgtcctatgagtatttatttatttatagaaatacagttcataagctgttgagcccatggccctattgacattttgggccagataattctttttttttcctatttatttatttatttatttatttaattcatttattatttgagacagggtctcactctgttgcccgggctgcagtgcagtggcatgctcatagctcactgcagccttgacctcttgggctcaggtgatcctcctgccttagccacccaagtagctaggaccacaggcacatgccaccgtgcttggctaatttttgaaattatctgtagagacagtgtctttctatgttgcccaggctggtcttgaactcctgggctcaagcagtcctcctgccttggcctcccaaagcactgagattacaggtgtgagccactgtgcctggctcagatagacaattctttggtgaagctgtcctgtgcattttagaatgttcagcagcatccccagctctgcccatgagatgtcagtacctccattcctctccctgcccacctaagccccagtcctaacaatcaaaaatgtctccagacattgcccattgtaccctgggaaggaagtcaacattactctggctgacaaccactgattccaatgaaccatcctagacccatttaaacagatcttaggtagtttcattgctttctgtcaaacattgtctttgggtagcaagggtgtcatctctagcctagggtgcatctatagggctctgcagagccttaaggcatgagtgggggcctgtaggggtgtgcaggggaaggaggagggtggaagtgggaggggaaagaaaaaggagccagaaatgttagcaaggcagctctgggacagtgtttgcttttgctccctggagagggtcaccgggggaaccattaggtctcttgtccacaagctggagagacccttcctttgatacacacagggcacagtcagccttaactcagctgttcccagggcagcctttcccgtgttccccttgccagagaacagatcactgctgaggccttgtaggcttggttgccatggaaacagaatcctcgagtaaaagattgaacctgggtggaagggttgcttttttttatggctaactagcagctctggaaacctctttcctggggaggagagagagggtggaggcagaaagcacatcactcattctgagatgggggggtgggaacaaagggtcacccatccgtgacccaagccaggatactgctcagctgtgtgtgtgtgtgtgtgtgtgtgtgtgtgtgtgtgtgtgtgtgtgttgggggtggttaggcaggaccttaacttcatccatttgagagggaagctaaggagctgagctgctccatcctgggggtgacttctgaggagggtgaccagattactgtctttactgaggaggcatctttgtgctccttggccttcagagcccacttcctgcggatgtggatgctggcaacaccctcagcccagaacccagtgggcaggctgggtgtacgacagagggtgcctttgccatggtggggtgtgatacgggctgtgtctccgctgtttaccgttatcttctctgtctctctctctctctcttcccagctatctatctatctcctgtctgtgcactctggctgctgtggaataaagtattaagaagaataaagaactgcaattctcatgcatgcagagccccttccagccctcccctcaggcagccccagcatgctgtggtttatctgtctgcaacattttccactgtctgcgagtcccctgtgttcccgggttaatctgccctgagagaagagggttgccaagagcatgaagcatctccatgaagacctgggagtgcagaggctttggatttttgtctcacttcagagaactcatggtgcctgagctggtttgaagagaggtcattttgagaaggaatcgatccttctttctttttttcttttctattctttttttttgagacggagtcctgctctgtcacccaggcaggagtgcagtggcgtgatctcggctcactgcaacctccgccttccgggttgaagtaactccttgcctcagcctccagagtagccgcgattacaggtgtgttccaccacgcccagctaattttttcatatttttagtacagacggagtttctccatgttggccaggctggtcttgaactcctgacctcaggtgatccgcccatcttggcctcccaaagtgctgggattacaggcatgaaccactgcgcctggctatcaatccttctttttaaacttttattttaggttcaggggttacatttcaggtaaactgcatgtcaccggagtttggtatatagattatcttgtcactcaggaaataagcatagtactcataggtagtttttctatcctctccctcctcccaccctccaccctcaagtaggcctgggtgtctgttgttcccttctttgtgtccttgtgtactcaatgttcagctcccacttataagtgagcccatgtggtatttggttttctgttcctgcgttagttcgcttaagacaatgatctctagctccatccatgttgctacaaagaacatgatctcatttttttatggctgcatagtattccatggtatatatgtaccacattttcttcatccagtctaccaatgatgggcatttaggttgatcccatgtctttgctattgtgaatagtgctgcagtgaacataggcatgcatgtgtctttatgacggaatgatttatatccctttgggtatatacctagtaatgcgattgctgggtcaatggtaattctattttaagttctttgagaaatcaccacactgctttctacaatggctgaactaatttcattcccaccagaagcatataagcttcccttttctccttgccagcatctgttattttttgactttttgataatagccattctgactagtgtgagatgttatctcattgtggttttgatttgcatttcgagaatgagtaaattcttgagaagatgtatctgttttccccaaatagaggcaagtaaccgtcaaccataaggaggaaagtcattaggttggcaggtgtctcgggccctgggtggcccactcccactggctaatggcagctgggagggactggccaggggccgggaccacactctagaagtgagtcctcttttagctccaataccttgaggcatacggaacccccaactcctgcaccccaggaggtgatgggggcaggggccgctcatggcaggatcactgccatcatttagggatgagggcagtgtcgggtgctgaagagacccttgacattggcctgagccccagctctgccacttccggtccatgtgatcttgggcaagctctttcttgagccacagtctcagtttcctcatctctaacaggggaagcatgctagttccttcatcagaggattaagcaggatcacttatgtgtagtgtctagaatgctaatcaacacgtagagacactccacacacagctggtattattctaaatgttgtcatgctatgagagagaatttatgggacttgtagacctcagactccatgttagggtgctgtacctagccaatttcctcttctgccttttcaccttctcatacttctcccctggttagaggtggaaggaggggttacatgccaatttcaacctctctgcctactccaataagcagctgctcagaacctcagtctacactggcgagtatacagatcttttggtaaaaggcagaaatatggcctcccagtataaaatactgtgctctgcagaggtgctcagcctggagccctcacacaccatatgctcccgccaataggggacaaacttctttcttcttgtggcttctgtgtgaccatgcctagctgagggaagggaaggggctgatgtttgctgacagctccctgcgtgccaggcatggacctgagtgcgccaccctttgtaacggctcagctaagactcactactgcgttagaaggtagatggccacgttgacctccgtttcacggttgagaaagcaggccgagagagagggtggctcccccaaggacacacagctgagaagtggtgaagccaggatctgaacctcagctgatggccgccagagcccactccacatcctgcctgatgttttctaatgtccttattgtggcttttagaagtttttctgcatttcctgaagtccattaacagagacaatgtcagtttcctttttcacatgaagaaaacaaaatagagagacatagccgtttgcccaaggtgacccagccaggattcagttacgtgtttccagttctgtagctcatgggcctccctgatccaaccgctgctcccctctccaccccacaaggcctacgtcctgcacccagggccggcttcatgggcagggggcttgtacagccgcccaagaccccaccctcagaaggacccttgtttgatttaatgttctgttaccatctcagaattccttacactttttttctgaacagtgaactgcatttttattttgcactgagccttgcaaattgtaagcaattctacctctacttgatgaggtcgtacctggctggacggctatttacttcacatgatcgcaatcttaaatccaagactccttagacagctgcacccccttaatttttttaaatctatctatctatctatctatctatctatctatctatctatctatctacctacctacctacatacctatctatctattttgagacagtcttgctctgtcacccaggcatgagtgcagtggcacaatctcggaccactgcaacctccgcctcctgggttcaaaagatttttatgccttagcctactgagtagctgggattacagatgtgtgccaccatgcacagctaatttttatatttttagtagagacaaggttgtgtctttttggccgggctgatctcaaaatcctgtcctcgagtgatccgcctgccttggactctcaaagtgctaggattacagatgtgagccaccacgcctggcctttatttattcgttttgagaccaggttataagactagctaatttttgtatttttagtagagacggggtttcaccatgttgcccaggctgatcttgaactcctgggctcaagcgatccacctgccttggcctcccagggtgctgggattacaggtatgaaccactgcacccggctccatctcttttcttgcctgcttaaccacttgtgtttctggatctccgggtttctgactttagaccccctctctgctctcaatgccagtgctgcccgattcctcacggttctccccatctcgcctttggctccgtggcttgcttggccccccacctgagtttctctgcagatacctgcctggctaccccatcccaaggtccttgcttatttctcccctgcactcctgccggtggcctgaccccttctgccctgtgccaattgtctgcaccctccatccggggtttgccagtcagccggcccagagctatgtaaacaacaagtctagatgtgtccctatttgggcaactctgcaagggaaaaataagaagttgttagaatgctaagaatgcagagcatccggagattccttaagcagagtcttcctcctgtagcaaagtgtgtcgctgagatgaggcataaagaagtggcttcactccaggagggccggcagctgagaaaggagggaagttgtgtgtgaatgccaggctggaaaaaaactcttatttcttattttatcatgaggtggttttctttgaattgcttagaattgtgcgtactttttttttgtaacaacttcgttttaacataatgtttcttattgcctttggctaagatataataatattgatagtaggtttgaaagacttagcaaataaaaatacaggattcccagttatgtttgaatttcagataagcaatgaatatctttttttgcataataggtcccaaatattgcctgtgaatcctgcattttatctgatgagggcttaaattgtgccgctcacgtgctcagtggtggtgtagtagccctaatgaataggcactgtgtgtgggtctctgctatgtgccagggaccttatgtctattatcgcatttagtccctctttttttctattctccttttacgaatgagaaattagaggctctgagatgctgagcaactcatccaaggtcatagccaggaagtggtaggactagaattttaacctttgtccgatccccaaagcccatatgcttctatttctttttttccttccttccttttttctctctttccttccctccttcattctgtctctccctccctcctctctcttttcttttttcttttcctttcctttcctttccctttcattctttgtttctttctctttctctttctttctttctctttctttcctctctctctccttccttccttccttctttccttccttctcactgtctctctctctctctctctttcttttttgagacaaggtcttgttctgtcacccaggctccagtgcagtggtgccattgtagctcactgccacctcaaactcctgggctcaagcaatcctctgtcctcagcctccagtagttgctgggaccacaggcatgtaccaccatccatactctttcctgaatctcttctccaccactccctccaaatcaatttgtctcttcaccttttaaaaagttcaggactcttttctctcactgtcccctccctgtacacactcctagaagagcagagatccctgtatgttaatctagaggaagcagatcccatggatggctgctttttccaggttcataatttattgtacaaattgaattatcacatgacaagtcgacatgagcttctccaggcatgagaactaaacggctgaggcacagacagtttagaatccattatattgctttcacagatggagtttttttagatcttgacttgaagtgaaagatcatcaaagcaatgcctccatatgtggccagtactcaactcactgtacttgtgagcgtctaagagttgaaatgcattttaacgcctggaattgggcatcagtttctggacctgccatgatttcaatctagccaaagccacacattccacagccactgtccttcaatgtacgcaacctggacagctatttttaaagctagaaatacaagctaaattcatgtggacaatccaaggtagaggtgggaaagtctcaccttcaaccaaatcctattaatggagagcaagctgcagttccattcccagaaggtaactggtaattctgggaatcagaaaacaaaatagcaaactacagcacagaggcagagccctagggagataataaaatcaaatgaagtgaacaggagtatacaaattgtaaacccccgaagactgagataatggccctagaagcaagtatagtaagccaaagggagaccccctagaggcagaatggaaatgagcatggcagaaagtcctgcaaatacagctccctgcagggcccagagaacaccaggcagccaggatgcatctgtgtgcgtccactcaggagccctgtgcccccatgttctggccgcagaacagtggccgacaggcagaaagcttgatgctggggtctggacaccttggaggtgcttatgacactggcggctgagtgtgagcccagcacgattctgcaccatcatgagtgttaaggacagagtgtttctggtacttgtattttgtcttgcgttacggctctagttcacttttggtttacattttatttatttatttatttatttatttatttatttatttatttatttattctgagatggagtctcgctctgtggccgaggctggagtgcagtagcatgatctcggctcactgcagcctccacttcctgggttcaagcaattctcctgggtcagtcccgcctccaccccaccccccaccaagtaactgggattacaggtgttcatcaccatgcccggctaatttttgtattttcagtagagatgggggtctcaccatgttggccaggctgaccttagatgatcagcctgcctcagcttcccaaagagctggggttacaggcgtgagccaccgaacccggccttgtttatgttttaaattaagtgactggacagagtcattccatcctgtagcactctcagcttcagggcaaggaaggaatgggaagagagcaggctaggaggaaaaagtgaacaggatcagcgattttgtgtttctcaacaatcgctcttcagctttgcaaagggaagagctgaatttgaatcctggcccatccaattactgaccaggaggtgttgagaagtttacccacaacctctcagaagctttgtttcctcagctaaaaattagtataataaaatctccttaccttaagctttgtaaagactcaaagaagtataaattgctttgcagtagttgctaggcagttatcattatgtaaaagtacagctccccctttgagcagagggcataaaccagtagatgctattctgaataacccactccagcaaggctccaacagaaggaagtaattataaagtattagatttgaatgtaagtccactctggccccagggtccttttctacctgaaatgtgcatcttctaaaacagtgccttaggttggaagagaatgggatcaaataagtatgactgccaatgcatttggatcatttggggagtgctttcaattttttagtggaaaaaaatgctattaagcttagaaaatgtccccattcttctaggcccccaagcatgctgaagtcatcatttattacacatttactgagcatctactctgcatcggacattgtgctagggaagatagacctggtcccctgccattaatggtgccttcatgttgattcatacattaaacaaagagtcacacaaataaggataaaattcaaatggcgatcagtgctatgaaggaggaagtcagggtgtataagagcctaaaacttagagaactacgtgagccttacctttctgagataactcttcctaatcccctatgcaggaaaaagatttcttgtgaaaagcaatgatagaagagcaatccggggaagcaaaatgaaacccagcctgagttagaaaggagagaccagtacatgacattctagactggactctcctttactccttttcaatgggctcatgggccagtgtttattttgctgactgcctcaaaggaagtagtgtcctcctcagacttaaccactcttttccaagtgaagacttgggtgggttaagcagcatggatattaacaaggcaggaattaagagggtccgcgtgaggccgggtgcggtggctcacgcctgtaatcccagcactttcggaggccaaggcgggcggatcacgaggtcaagagattgaagtgatcctggccaacatggtaaaaccccgtctctactaaaaatacaaaaattagctgggcgtggtggtgtgtgcctgtagtcccagctacttgggagactgaagcaggagaatcacttgaaccctggaggaggaggttgcagtaaactgagatcacaccatgcactgcagcctggcaacagagagagactctgtctcaacaacaacagcaataacaacaacaacagcaacaaaaagaggctcctcttgaagtataagagtcagtaccagccagcccctggacacaaccaaacctagaagaactgaggctgggatcaccaccttgcccagtctccaggagttacatggagcagaaaagtggtgcagaggaagcacggcccactgcaattgcagatctatgtattttagccagagatagatctgaatggtttccaggagcttctaagagcctgaacatgaagcccctcttggaactgtcctttctttctctgccttaactcaaaaagttgagaggggacaccctgaagcttatccccagtatgaccctgctccaacagcttcagcaaggggatggggcctgattccacagggcagctcaactcggggactcagcttgcagtgcatgctggcctcaagcctttccattatgtgctttatttttggtaacattggtttagttttcaacttatattattggtcaaattgttatgactacttggggaatgcatctcaccattgcttcagagctctcccctgtaacaaaagaaaccaacacccaagctctgtgctagtttttctatctcttctctctttctctctctcttttttcttttttgagacaaggtcttgctctgttacccaggctagaatgcagtggcatgatcatagcttactgcagtctcaatctcctgggatcaggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagtttcaaatttagtccttaattgatcttggcctttaggtgagcaaagttacagtggtaaattacgctccttcgcttacaaaatctcttgcttggtatttattccccaggggttacatagaatagagtggaggcagtagacatggagaaatcctatcttttaagaaagaaaaaaatgggcatttttctcatggggaaggatttttatttttcaaatgggtgtttgaactgtaatgatttcatgacatctgcctaacggttttgtttctttgtcttacagaaacaaacagtcgttgctgtcaaaaaagaggtaattagtcttacacttccagtgaagaatggttttaaatcttctaacaggttatatgtactttgttttaccctctgcgcttggtaatgaaatgaaaaccacgtgcaatgttcaaacaattatttccaaattcacggacagcacagagtgacgaagcatcttctgtaagctctggctggggctggggctgaggctggcactcagggtctgaaaaacccctcgaaggcacagagctgaggggtggccagagaggactgtggaaccaatgctgcaggctgcagagactctacatccccaacgtggcccctgcacctatcattacagggccagaatctacccaaggtggcaactgcctattttggcaaatcttatgtctggggcccaagacagagtcctgggaaccatggggcattgagctggggtgtacggttagctatctgaacgtggaggaaggtggttgaggaggggataacttgctttggccaatgctgcagaatcaggaagtttaaggatgtcacctgtggtggggaccactctctgcttctgtctgccagagacatgtgagggaaaagccaagcgtttgtccccgtgtctcagttgaatgctccttagaacttttttttttttctgctgatgctttttcccagactaatacataatggctgaaggaggccactgatttgaagtctgtggtcatctgtccactgtgggcctgacccactggtactgagggggctggctctgggcatggaacgggatgtggctctgggtaaatggcttctgggtttggaggctgtgtgtagtgacactgaagggtgggagggggttgaataccttctaacaactgtgtctcttccagatcatgtattaccaacaggccttgatgaggtccacagtgaagtcttctgtgtccctgggagggtatgtccctgatttgttgatcttgctaaagtctgatgaacaggtagacaagaggagaacttctgcaaactcgacaagtcctgggctgacagactgaagattcagcagaactgtgagggacaaaaccagtctcttgggggcttagttcctagttcatccctcagaataaacctccgggtctcatcttgggttatgcaaaatcgagcgtaggtgaggttctagaaaagactgttatgtttcttggaatccactaatgtgtggatggggaagttagaaagagttggaagtccgtggactgtagaccctgtgaggatccaagacagcctgggttcctatcgttactggttccaattcattaggagtgtgtgagtcatgtttactggttccatgtgctactaaatgtccattgttcatctttgatttaaaatcccattaagataaattggacatttatgtttgatttattgaactttctggctaccttgacccagccccccataggacatcatctaggagacaagaaagagctgagtgctgcctcccacgtgcaagcagttattcttttaaaatgcggaatttatcttaggactgcatttctaactctgggattttcctgcacacatgaaaataaacttggcttattcctgggaggcacgatgtgactaatcatgtattctgactgtgtaagactcaagtcatggtactaatcgggactgaagatgctgttttgtttagtgccttccttcaatatgtttaagggttgggctcttgtaaaaatgttttacatcttcctatgtccccagtttgcaaaaatgccatctgcctgagaaaatatgccctgaccccacacacatttcagtgactctgctgctgctaagccctgatcccagctgaggagggcacctgtgtactcaggggcattcactttgggttataataatcatcattgttcagtgataaactcaaaaccatttacttccgtgttccataaacccagtttcatgaaaccaaacagaaagaaaatggaaggagacccaaggatagttcttagacccagtttccaatttttatttgtctcaggacctcattaccgtaattttgacatcattagtgttttgacctgtgaaccagtttttttttttgttgttgttgttgttttttacctccagcttctccactggtaaatgtctgggcccgtcgaggtgcctcatgcctgtaatcccagtactttgggaggctggggtgggcagatcacctgaggtcaggatttcagggctgaggtcggggcggatcacctgaggtcaggagttcaagaccagcctggtcaaaatggagccccgtctctactaaaaatacaaaaattagccaggaatggtggtgtgcccctgtagtctcagctacttgggaggctgaggcacaagaattgcttgaacccaggaggaggtggcttcagtgagctgagatagcgccactgcactccagcctgggagacagagcaagactttgtctcaaaaagaaaaaaataaaaaaggtctgattgtcgactaagagagtctcgggagagaataagccagggggcttgagttctgaatagaattgcaaacccagtgcttgtctctaaggtaccagtggtttatctctaaggcatggatcctgttctgtccaaatcttatggctgagggaagacttcagggcaggtgcatttcacattcactgtggacacaattccccacctacggggaggaggcacagcaggttttcaatacccagacagcaggaaatgcattgactcagaaggtctgactcaactcaagggaattagctttttttagaaaagttttttaaattgacacataattgtacatgtttagggggtacatagtgatgtttcaatacatacaatgtgtattgataggatcagggtaattagcatatccatcatctcaaacatttatcatttgtttgtgttgggaacattcaatatcttcttttctggctatttgaaagtatataaagtaaaacagaggttactacagactgggaagggaagggggaaggggagatagggaagtatttgttaaaggataaaaaattaggccgggagcggtggctcacgcctataatcccagcactttgggaagtttcaggcaggaggattgcttgagtctaggagttgaagaccagcctgggcaacatagtgagaccacatctctacaaagaataaaaaaaattagccaggtggtggcacatgcccgtggtcccatctcatcatgacactgacgtgggaggacggcttgagctggggaggtcaaggctgcagtgagccatgattgcatcactgcactccagccttagtgacagagcaagacaatgtctcaaaaaaaaaaaaaaagttacgaaattacagctagatagtgttctgtagcactgaaggatgactgtagttaataataatacagtatgtatttccataatagctagaagagaaggaattagctcttcctccaaatagtgtgtttggaccaattaagccccaggtttaaataatgggcctaagtttccaaacccaggcattatcctgagaaagggtagaacccaacatggcaagagtcttggagtctgtggcaactttgggcttctaagatgggtgcagagacacaagtttgaacactccaagttggtttgaatctaaaaacctattgataaaatataaacaggccatattttaatgaaatagatacagaaaggccgggcatggtggctcacacctgtaatcccagcacttcgggagactgaggtggatcgcttgaccccaggagtttgagaccagcctgggcaacttggcaaaaccctatctctaccaaaaatacaaaaaaaaaaaaaaattagcctggcctggtggtgcgcgtctgtgatcccagctactcaggaggctgaggtgggaggattgcttgagcctgggaggcggaggctgcagtgagccaagattgtgccactgcactccagcttggctgtctcaaaaaaaaaaaaaaaagaaaaaaaagaaaaagaaataggtatagaggaatgacagagggactggatggaagacaatgtttcatttcacaagtagaattgggactgattttgtcaaatacctgccaatcccaagggttatttgatttgaggaaatttctaggaaaacagtaataagtatgtcaccaaatcgatacaggaaaagaggacagcctggtcagttgacctgtgtattgatgtcatatcttgggtgtcgagcttctaggaaatcattttctgtttccttttcaggattgtgaaatacagtgagcagttctcatccaacgatgccatcatgtcaggctgcctccccagcaacccctggatcaccgatgacacccagttctgggacttaaatgccaaattgtatgtattttatatattggtgttttttaaaaaaccgtttttgagttacaattcacatgccataaaattcaccccttcaaagcatacagttcaatggtttttattatattcatagagctacaatcaattttaaaacatgttcattacacaaaaaagaaaccctggacgccctccagccttaggcaactatgaatctactttctgtgtttacggatttgtctgtctggacatttcctatcaatggcatcacttggaatctgaggaatgacagagggactggctggcagacaatgtttcatttcacaagtagaagaggaactgattttgtcaaatacttgccaatcccaagggctactcgattcgagcaagtttctaagaagacagtaataagtatgtcactaaatcgatacaggaaaagaggacaggctggtcagttgacctgtgtattgatttcatctcttgggtattgcgcttctaggaaatctaggaaagactatggggtcttttgcgacgagcttttttcacttagcatcatgttttcaaggtttacgaatcttgtagcatggatcagaacttcattcccatttatggttgaatcatcttcatggtatggatgcactagagtttgtttatccattcatctgctgatggacatttgggtggtttctgccttttagctattatgaagaatgcggctatgaacattcgtgggcaggtttttgtgtgggcatattttcatttctctcgggtgtatatccaggagtggaattgctgagtcaaatggtgactctatgtttaacaacagattggttttgaaaattaaaaaatcatatgtatggctttgcatgtttgatatctaattagcgtaaacttaagttctgggcgggcagggccctaaacctgccctttcccttaccctttggcttttttttgtcagttttgaatagtcattgctcactggacctgcacgcttgtgttatttggaagagggggcagaggcagaaacacaggagagttccggcacacagagggaggaagaagagaagggtgtaatggtcaaattagagggagagagagaggaggacaggggagaagggacaggcctgagtgtgtgagggaggtggggtgatgggaaaggaaggagtgccaggtataggtcacagcttgggtcaacactgccgaggccatgaggaacacacaggtgacactgacccagctgggtaagcaggcctggcctgggagggccctgattctcatcttaagcaacactggtacctattccacgtggcccgctctgggcagccaacaggttaaggaggccactcctctggagtcaggggtcccctgtctactaaggtcaactgcagagccaaagactctagaactaccttctggggaggcttcccttatcctctttgggctctggctgttggggtgcttctctgcagcccatgtctgcctcccagcgtactgaatgagagaggcgacctgtgtctgcctgtggacaagcatgtgcggacgctggctctccctggaggagaaggcagggaatctggccaggaagagggttgtcctaggagggcttggggaggagagatggatggccgctgaattttaaataaaatggggagcatggtattgaagacaggtagagattgctggcaagaagaaaaatgtgtgttctgtgtaagaaccgttgatcagagggcactgggtgggtgacaactggaactccccattaaagtgggaagccctgttcttttttgtggatcctatatgtttattgaaccaaatatatatatacacatatatgtatttgtaagtatatgtatatatatatttttattggtgcacctatcaactgtgccgcgtacactgaaccccgtttttagtcttatatccctcactcccttttcacccctttcccctgagtccccgaagtgcatcgtgtcattcataagcctttgcatcctcatagcttagctcacatgaaagcgggaagtcttgttcttaatggtttagattttagaacagtattacaattactggggaagcttaacaaaaacatcaacgttcaggccttatcctcccaaacctcttatttggttggcctgggttgctgtctcaccactatcagcgttttttgaaagctctgctgattttcacaaacagccaggattcttaggctggtttacagcgttgattcccagtgtgggccctggaccagcggcatccgcagcaccagggaacctgtcagacatgcgtattcttgggccccacccactcctactgaatcagaaactctgaggttgggacccagcaatctgtttcaatgcatcttccaggtgattctgatgcatgtggaagtttgcaaaccactgtcgtcatcacaactcagcttcttactaattatgtgagacttggcaagtatttaatctctttgagcctcagttttcttgacaatgagatgggatagtaatactcaattcatagtgttcttttaaggattcgatggtatgtgtgtaacgcacagtacctcacataggacaatgctttgtgaatggcagttgttaatgttatcagttttcttattgtttgtacacttgttcttatggaaagtgtaaaacttgcttggcatgctttatcttggatcccatagacatgaattgtgcctggttctggtcctagctgctacatcagtgggaaaaatggtgtgagggacttgaaaccttagtttcaaaggtctgtgttaggtttaggagaattccataagggataggagagaacactgagtctttttctgattctctggaatgttagatctctgctagctgggctcgaatatcctacctgggatcagggaaatctttccaaacaaggaggtgcagtgggacctgcatcttagaggaagccctgaaagggagtgcagagatggcaaatgggtctactccgaggcacatggcctgaggcaggtacaggaggagccaccggctcccaccagaagccagggtgtgccatggtaggggggcagctgtcgtgggtgataggcacccagcaggtggcagtgattgtagcacccatcaccaatgctgctccagaattctctcctagtccaggtggcagcctgaccctctgctggccaggctccaggctgttaccatgccttggaggaggcatttgaattcgtttgtccttaaggttaagtgagcaggacctgagtgtgggctccccacggtgggcatcctcctcacctctgggatggtcatgtctttgatgtgagccccgggggacttgtctgtggctgcatcttcctagcaagtgattacttggcttgtgtgttatgcagggattgggaggaggaggattgaattgagccctgggccatgagactaaaggccctcaccccaacccaggccaccacctgtcacaaccgctacctctctggtgcatttacaaatcatccttgcagggtggaaatcccaaccaagatgcgagtggaacgatgggccttcaacttcagcgaattgatccgagaccccaaaggtcgacagagcttccagtacttcctcaagaaagaattcagtggtgggtctttgtttacaaaaaaaaattaaaataacttacttttagaaagagtcctttaatgtctagcctagggtttggggaatttctcagcagatgttttcagagctttgcttatgcccttaaacagttgcttcctttcacagctttaagaatgggacctgagcccaagactcgttctttccatagactcaaagaggccccaccgtctgggggaaaattgcacctgctcacagaatctacatcaggatccctcacatttctgagggctccatccatcctggatgcccccactgtcacccgaggagcccccgctccttctagtcagcctctaaatataatgaacctggaggaagggaagggagacaggcaggctttccctttctttctctttttgtctcccagcctgattttcttttttctttgtttctttcttttttttttttctggagacagagtcttgctgtgtcgcccagcctggagtgcagtgggatgatctcagctcactgcaacctccgcctccctagttcaagcgattcccctgcctcagcctcccaagtagctggcgttacaggtgcctgtcaccacacctggctattgttttgtattttgagtagagatggggtttcaccatattggccacgctggtctgaaactcctgacctcaggtgatctgccctccccagcctcccaaagtgctaggattacaggcgtgagccactgcgcctggcttcctgattctctttagctcagtggttctacacattcagtctgcctggggatattttaaaacatgttttcctggatctcatccctaaagttgcttttaaattggtgggggttggaatccttgaagttttggaaactccccagatgattccaatgtgtggtgattgacagccatcaccttagctcctggcctgatttcttcagggccttaggagggtgtggattttagtgaaatgggcagggccacattttgtcccatctctgaatgtcacctcatgaggggaactgtgacttttttttttttttgatatggagtctcgctctgttgcccaggctgaagtgcagtggcatgatctcagctcactgcaaccattgcctccgaggttcaagtgattctcctgcctcagcctcccaagtagctgggactataggcacgtgccaccacacctggctaatttttgtatttttagtagagacagggtttcgccatgttggccaggctggtctcgaactcttaacctctagtgatccacctgcctcggcctcccaaagtgttgggattacaggcgtgagccactgcaccaggactgtggctttttaaatatactgcacttcccggagaagcatccacaaaaaaacacgaggccagatcagaaccaggctgtgcattcaccaccttcattgaaatatttacctttacgggattcttttacttccttgctcagtacccagccctgggggcatcactcctgagccttgacactcagctgcttactacccaagatccacttgtctgtggcactgctccagaaacgaatcctactggacatgcctttagcctggctgactgccggatgcaaaacattacatgataatatggattgttgataatcatctccctaatcaagtctaattgctgctctagaacaaaacccagaaaagatggatggactggcgaataagtggttatagtgccatctagtggcaaagtgacaacatacaccctgaatttattatctcccccccactaattccttagtgagaatccagcgaaaagatttccctgcattatttaaaccgtattattagcaatctcctcatgagattcctgaggctttaggtatgaacagggcagataaatcatcaatttgctcatttactttttaaaaagatttttaaattgaaatattatttgcatatgatgaaattaactttttaaaagtgtacaattcaggggttttagtgtattcactaaattgtgcaaccatcatcactaattctagaacatttttgccacattaaaaagaaactctttacccattagaatcatcttctattcctgcttctcctgcaccccagccctaggcaaccacaaatctactttctacccctacggattcacctcttcaagacatttcatgtaaacgaaatcatgcaatatgtgaccttttgtcttttttcacttagcataatgttttcaaggcttgtctgtgtttcagcatataacagcgcttctgttcctttttttttttttttttttttttttgacaaattctcactctgtcgcccaggctggagcgcagtggcgtgatctcatctcactgcaacttctgcctcccgggttcaagtgattctcctgcctcagcctcccaagtagctgggattacaggcgcccgccaccatgcccagctaatttttgtatttttagtagagacggggtttcatcatgttggccaggctggtctcaaactcctgacctcaggtgatccacccgcctcggcctcccaaagtgctgggattacaggcgtgagccactgcgcctggccacgtggttcctttttaatgactgcataatatttccttcattcctttttaatgaccccataatatttccttgtttgtatgtaccacattttgcttatccatttgtaagttaatgaacatttgggttgctttgactttttagctgttatgaataatgctgctatgaactttggtgtacatatttttgtgtgctcatttaatatttttggtgggaaaacgtatgtaacataaattttaccattttaaccatttgcttttgagacggagtcttgctctgtcgcccaggctggagtgcaatggtaccatctcggctcactgcaaccactgcctccctggttcaagcaattctcctgcctcagcctcctgagtagctgggattagaggcgcccgccaccacggccggctaatttttgtatttttagtagagacagggtttcaccatgtttgtcaggctggtctcgaactcctgaccttgtgatccgcccccctcagcctcccaaagtgctgggattacaggcgtgagccacccatgcccagccgaaatcttcttcctttttaaggccaaatgatattcccttgtagtcttcaccatattttgttcatccattcttttatcgatggacatctgagtgctttccacttactggctatcacgaataattgcttatttaattttactaagcaatcaactgtcttttgctatgggcaagatggtttacatggcacttttgtcagatcagttacattttagttgagagcatcactggtctgtgatctcagtccaaagaacgccctaaagttcatgctgaaaaggaaggacctctatagagctatgggacaaatgccaactagtttaaaattgtgcagccttttctaatatgaagcacccaggagcttttaaaaaaatgcagttgacccttgaccaacactggtttgaactgcacgagaccacttataggtggatttttttttcagtaaatatatttaaaaacttggggggatttgcaacaatctgaaaaaacttgcagatgaactgcatagcctagaaatagaaaaaagttatgaaaaggtatcatgaatccataaaatatatatgtagatacatatccacttatgtgtccattgactgtttatgttattagtaaggcctctggtaaacagtaggctatttgtagttaagtttttggattttctactgcataatggtctgcgccctaaccccttaattgttcaaggtcaactgtactgagaaaagagaggagaggattttgttgttcatttccccacactgtgacacactccacgatttacacacacacacacacacagacacacacacacttgctctctcttgtgatcgtctttattttcccaggcaaaaatcaccacctgggaccactgtatgaacatatgcgtggtacctctggacgctgcaggttagagaacctcgagttggagggagatgaaggatttgggggaacctggcttttccttctgggccaatcccctctggctcaggtgatgctcagttcagtcctgctcctggccagaccttccctgagggtcagtccatcagcactgcttcttgaacagcctctctgtaagaaccgttggcctggaatatgtctggtgagggactgcaaatgatgggttctctaagcacagccaaacaaaggaggaagaactcacgctcagtcattcaacgggagcaaaggaaggaggtcttgatgtagaaaaccgtagcgtagcaacgcatgtatagaagcctattcatgtgcgagctcgttcaagcaatatttcctacagccaaattctagaataaaaaagagtacgacaacctctggggggtgatatgaactctggcctgtgtattgttggaggaaaggaagctgccacggtgtgaatgcattgctgcaaacatggtaggtgccaatctagtttatttctaaggccacgtattgagcaattactaagttcccaatgttcttccaggccgtagaagtgaagatgtggctcctttccccaaggagtattgttgtctagcatcacaatgtgcaatagcttgttctgcggcaggaaaggtgttcactgagctgggaaatggaatccatcccggttgactcatttcttttatttcctcttttcttcttccaacttatttcctgcccggccctcatccacgtggacttctcaccatgcaggagagaatctgggattctgggaagcctgcgaggatctgaagtatggagatcagtccaaagtcaaggagaaagcagaggagatttacaagtgagcatcagccagggtgctggaaagccttcccttgggcctctgaggaccaccccattgtgcttgaggtgaagataggatgagaggacaacagcctggtagctggctgggccctggtcagcatcagttcactgtacttgccatgctagaaatagttccccgctgctttgggaggtttgggggttccctgaagaaagcctggtgagacatgcagtgtgagtcacctgttcctatgggaatgtgtctaggggttaaaaaagcaagctgtcccgaattacagtgcagagtgctctgtctttgactaaagccttcttaggtgtcctgaggggtgtgtgtgtgtgtgtgtgtgtgtgtgtgtgtgtgtgagagagagagagagagagagagtgagagagagagagaagaagcagcaagatgggaaacctattcctcacgcttccttagagatgtgaggaacacaggggaagggagctcctcccacatgtctgggacagtgagcgcagcttggggtacaaacatgggtgggcacatctcattcctgacatcacggctccagcccccacttgttctgagcagcaataagtctgtccctctccatgactgtctctcctccaaattacacaaaagccaagagttccaggttaaaagggtcagtcctgttttcaatggccaggtggagagggaggggaaggtgtgatgaggctcccaaggttgctgaaagccacactccccctccccaacactcctccccctacaggcctggtgggtgctcctgtcctgctgtggtcccatctctgtgggtcctttcatctgcactggctgcagtggacatgagtcctggatactgagggcccagcattgttagttcatactcacatgcttagccgtgttgcccaaagcccaagcaccacgctgggctggaaccagccctttgcagtcaccagactgtggtgctgaactttgggcagcaggccaaacagccccttccctctgaggacttagcctctggaccctggatgtccttcctgcaaatgaactcagattgcaacaccccggtttccagagaagcaccagcagcattgaagagaaaagcttgaggtctcacttcttcttatacttagaggttcatacactctattgcaaatttgcccagctcctcccacagggaggggatccatgcgctgagagaaatgggggtgcgggtggggtgcagtggggagggctgtcggtccgggaagcttccatgacatcctttgcagtacaatgggtgcctgattgccttacacacagtgacgcacacacaactcctgattccaaaaatctgctacaggaagcccgctgcctctgccattagaccagtttccttccccaggctccctggttatgttatgtaaatctcagtttcaattccaaaattttaatgtacatcttagaaaggtaggaaaatattcatatgagtatttctaattcagcaacagctcagaactggaaatactgagagagctctgcatcccgacatcccaggtagagccacgggctcaggaagtgtggccaagtttggtctaattgggagccttggcctgtctgcccagcgggtcagacctctgggttctgggactatgggctgcctctcgacacagcatgtgaaattcattacaaagcacatgtgggttgggaggagagcagagacccccagaacacctgtgtgaaggtgtcttagcctggtcccaggttgcccctggaatcctggtgcagaaggtgtgaagttggaggctgagttcttcaccctcatggccaggacctaatccgacctgggccccagccccttcttgctctctctcctggaggttggaaacatcaaagttaaatattcatattcccaatactggaagtttcttgcttcaaggaaaaattgcttgacaacctcttcaaaagttcatgctctttagtgtctcctaaaaaaaccaccaccctcaccctcggtaaccgattcgtatcagtccttccctcccaagcagctgtgagctatccatgaattgacttggtttagttacttttgctaacatctccctcccaccccaggctgttcctggccccgggggcgaggcgctggatcaacatagatggcaaaaccatggacatcacagtgaaggggctgaagcacccccaccgctatgtgctggacgccgcacaaacccacatttacatgctcatgaagaaggtaggtgggtccgtgctgtggatacggggtccagataggctttctgtcactaagtacccggaaaattctttagatataggaaaaagagagaggatacgtggatagagctttgccggttgtggcatgcagctaagcatgggggctcatgtctgtaatcccagctctttgggaagctgagatgggaggatatcttgagcccagaagtttgagaccagcctgggcaacacagtgagaccctgtctttatataaaaaagaaagagagagaaagagaaaaaccccagaattgtcaaccgtctcttccacctgtccactggggtggacttgccttgagcccctcacccacgggcctagaggaactcctgtagaagctgtgtgcatccttacgggccccactctgcagcagtagacaggtaggagtaatggcattagtaatgacaacattataataacagccatcattcgttgagggcttacaaggtgcagtcgctgtgcgaaacacagaactttatgctcaaagacagcccacaagttaggctttgctgctccagaatctagtggcttggtcaaggtctcaccagagatggggctgggattcatagccaggtctgcctgggtttcaaggccgagctcttagtttctgctgcagagtgatggcaattctcaccaccctggccccaggcaaatattacacatagaggcgtagtgtctaggagagacaaatttgtgtgtgtgtgattgtagtaagaccctgtgagaatttagatagccctctggattattaacaaagtgcgaatgcggtgggaatttaaaaaaaaatatgtgaagggtacctgagagaaaaatcaatcattttcttaagaaactagaatcggaggctcagagttagccttaaagaacttgtctagtttgattcttctttggtgccatccttgacaagactttctttgggtgcttcaacttctcattatggcaatgatttctttaagggcaaagtatctttataggatataggttatgtgatataggctatttgatataggttatgtgatataggttatatgagatagattatgtgatataggttatggatattggttatgtgatacaggttatgtgatatagaccatctgatataggttatatgagatagattatatgacataggttgcgtgatatagcttatatgagatagactatgtcatacaggttatatgatataggttatgtgatataggctatttgatataggttatatgatataggttatatgagattatatgacataggttacatgatgtaggttatatgatataggttataatgtgatataggctatctgatataggttatgtgatataggctatatgagatagattatatgatatgagttatatgttatagattgtaatgtgttataggctatctgatgtaggtcatgtgatataggttatatgatatacattatatgatataggttatgtgatatagattatgtaatataggttatatgatatagattatatgatataggttatgtgatattggttatgtgatatagattatgtggtatcagttatgtgatataggttatataatataggttgtgtgatataggctatctgatataggttatgtgatataggttatatgatatagattatatgatgtaggttacatgatgtgggttatatgagataggttatatgatgtggtttatatgatataggctatgtgatataggctgtgtgatataggttatgtgatataggttatatgatataggttatgtatataggtttgtgtgaatggtaaatgctgattagctttcctgatttatatttcttctatttagtcttttattgtatcatttaaaagtatttttactttgtttttaaagcatgtaataatttagaattgccgccaagccagattagccattttcatcattttttgaatcagtggggtgtttctgtgtgttttgaatcagtggctgtctctttgtttttgttactagacgattcacagcagggtttctttaataataatcctctttaatgtattttaaaacgttttggttcttaaaaatgtagttttcggctgggcgcagtggctcacgcctgtaatcccagtactttggaaggctgaggtgggcagatcacgaggtcgggagtttgagaccagcctggccaacatggtgaaaccccgtctctaccaaaaatacaaaaattagctgggcgtggtggtggatgcctgtaatcttgctacccaggaggctgaggcaggagaatcacttgaacctgggaggtggaggttgcagtgagttgagatcgtgccactgcaatccggcctgggcgaaagagtgaaactccgtctcaaaaaacaaacaaacaaacaaacaaaaaaacctgtagttttcatacggctttttaggggatgcccagggaggccagttactagccagaatggaacagtcattggtaactgcagaaaagaatggcatatatgcccactggactccctatatgccattacagctatgtcctatggtgaaacactcaacgtatcccagtggctccatggtccctattcctagactctatcctagttctcataacttttactgctcccacttagtctttagaatagtgccatttcaataaatttttaaaatacctcaatccctggtttgttgcagtggcctttgtcccatattgggtatgactagagttttccgctcgcttaaaagtaacgagcattcatgaagcttctctgaaattgcccagagtcccagtaaacagccccataactggactctacgcgttggttgtttttgtttttgctttggtattctcttgcctttacacccaaaacacagggcagaaagggatgtcaatggcttagaagtgggctccatactcctggctgctcatcttccttggaagaaagtcttggagaggagaggtcagatgtgctcttgtctcatgctggcttcactgaaccactccaaggtggatcttcatgtgtagggttacagactgtaattctcaaacttaaaggtgcagcagaattacctggagactgttcaggtagttgttaattgttaattgtttaggtgtcctcatgtgaacaaatgatgacaggcaatgtctccatacatgaccagctgtctcacctgtttggcatgtagcatgcagcatatgagaataagtgaaacaaattaagcagttctgggtctagtgtacttttaactgtagcagcttttatgcaactggctacatttacaacataggctgaatcacagacaatgttgataggatctgaagctgtgagctgtaaaacctgagactgttcaggctcagggtgaatcactcccagagtttctcatcaggacggctggggcaggcctgagaagttcccaggtgaaattgatgcttctggaggggaccacacttgagaaccactgctctcaacacctcccccaacacctttcacccaaggagacaaattctcataacttttccattctactgccaagggaggcttgaaaatggcaagggtattggtttgatttgactgcttttttctctcataattactgttgttttcttgttcccactaggattcttatgctcgctatttaaaatctccgatctataaggacatgctggccaaagctattgaacctcaggaaaccaccaagaaaaggcaagtggaattatctgtaattgctggctgcctgctgcttagtttacagagaagtgagggtctctttcagccaaatggctattatggagatatttgcttgatgaaaatattggggactgggaagtattgctcagggaatgagtgcctcatttgcttcataatgccctgaaatcactctagcaagatttccttagtaattaccaccactaagttttgtttcccctaaagctggcttgaaagagtttagaggatcagaccaataattacccttatcacaaatggaagcttctccttggttttttaactgctactcgttacctccaaactgatgtatgggaattaattaaggtacatccttgtatttaaattgttctaagaccttagagagaatagcagattgcaccccaagagaaaatgctcagtgaaggggaaacggacagtaacgggctaggtattcttgctgcctccggggaccatgttttagaagtccatgaacttgttcattctcacttttctcattggagatgtggatcatctcatctggtagagccattgggacaatggacgaaataatgtcctgaggggcagattgaactcttttccgggggaattcaatctacaaggattgaagatttaaaatataaattgaatggcagcttgaacaaaactgtaaggctttggcagaggtttttccactggcaatcgtgtgtcctgtcccccccaaagtgagtgactgttcccctgtttgctgggtcaacccacactgggctcctttccagcatcttccatcaattcaaaagggggatggccggaccagagcctttatcaaaggagaaaaaacaacaacaacaacaaaaaaaaccaacttggcttcattcttgaggataatggccctgttatgaaaaggagagaaagaaggtctttgtggtgctattcttctgggtttaccaagtaaggaagggagttcagtgcccctggggacttaaaagcttctactttaagccagaagaaaggcctgtaatagctccagtagttctgccagaaagtaatgaggggacaaaagaggagtctcatacctctctctccagatattttagaagttggggcagacgtgagaattctcactattgtgagtgagaattacacgtgaatgcattcgtaaagtgtgaagcctggtctgtgtccataccaggactacagtgggtgtgaattttgttccatgatcccaggtataagacaatgtattcaaactcaatttttgcatgacaagttacccctagctccaagccttcctcttggcagggctggtgagaaatccaatgtcagtgtcaggctttacatcctggtaggggagcccttcttctccttaagatagatataagagttcaaggggcttatgtagtcaaggggcttatgtagtccagaaatatggagtatgttgcaggtctttgtctcttattgctgctgaagttcttggctccaagcttacgtgggccctcaaaggcaggtgggctccactgctcactgcccactacatcacttggatacctagagctttgtcctggctcctaaggccatggcagggagagtttggttccaggaatccagtttggctttgaagaaggttctggcatgtgtcaagatattgcacatgagcagggtaccaccagcccaccagccctcttcaggcctcttccctctttctctgttcactggggcctagctattttggacagtccagctctttccttccttcccagaaccatagcttttgaaaacaaatgctccagccaggcgcagtgactcacgcctgtaatcccagcactttgggaggctgaggcggatggatcagttgaggtcaggagtttgagaccagcctggccaacgtggtgaaagcctgcctctactaaaaatataaaaattagcctggtgtggtagtacatgcctgtagtcccagctacttgggagtctgaagcatgagaatggcttgaacctgggagatggaggttgcagtgagccgaagtcgtgccactgcattccagcctcggtgattcagagagactctgtccccgctgcccaccccccaaccgccccaaaaaagaaaagaaaataaacaaatgctccaactctctccagtacccaagccttcattatccacttctttcatgaagatgttacaaaaagttaagataacaaattgatttctacatactgtagaagttcaatgcaacttcgccaacaaaagggtcttccttgtgcctgacctaaaatctgatggcagttggtactcactctggtctcatcctccaagtggggagaaaggagccaaggttggaccccactggaggttcactggaaaaaggagggaacaaaatatagattctggaccttccagccccagctcccatcaagtgtgacagggtcagtgttgggcaagctgtgtcattttcctccaaccaccaatctgtccttccttccagctccaccctcccttttatgcggcgtcacctgcgctccagcccaagccctgtcatcctgagacagctggaagaggaagccaaggcccgagaagcagccaacactgtggacatcacccaggtcatgagcaagctggaccgcaggagccaactccaaaaagagctgcctcctaaataaatctgtgattcctgggggtggggtcatgcacttgggagaggcaaatgaagaagggtagggtcagagtctagaaggttccattccccatttgtggaggtcatcaggttcatcccatactcctctaactttcttcatgggggacttcctaataccacagcaaccagagcttgttctcccaagcccactcatcaggggacagggtgggcgaaggcggtgggtgggagaggggatcacctgactcaattgctgtgtggctgcctattgtaccttagagagttcttaggggaactatgaactttttcagtaagagccagggggaaaaagctgtctcagtgagagccatagggaaaagtggtacacaaagctctcactgagagagagctttgtctaccactctctgctttggaaaattaaaaagaaggcctctccccatacccaaggcctagtgtttttcagggagatttgtttaaaatagctttatgaagctcctcatcctatctctctaatttagactattgtttccaaatcattctgaggatccgccgaggggctagttgcagggaagtactttctctgaactcccctgctatgcctgcctggaaagaccctgctgagacgtttctcctgttgagtttgttcttagtcataattactggagggttgatgggctctcttcttcccatctccccatccccttgtccatgctggggaaataagcggcttgcgggaatgaaggactcaaatggccctctgaggagcatctttttggctaaagaacaaaggcattgatgtcttcattcatgggaagaggatggtagacatcgagatgagtgaggatcagagatgatactctctaggacattttctagatgttgattcttccctcttctgtaggtgtagacgaggtcagccctgtggtcaggactgggggagaggacagttctaactgaccttggggggtttagaaggtcattctcgaagttaggctcactccttacacttgtgcaagaatgcaacagagatagagcacagaagtgagcaagagaccagcctgaccaagcaggaatactcactcattcagcacgtctattgagcacctactatgtgcaaacatcggtgaataaaacagacgtggttctctctcatggagcttcttctagtctaggactgagacaaaataattaaacaaactatcaggtagctattgctgtgtgacaatcaaccagaaaaatagagcaacattcagcaagtgttcattgttcatgcatgtggggtcatctgtgtggctctgtggatcttggctgggtccactcatctgtctaggagtgttgcagtggcctaggctgagatgagtgagatgagttttctctgcttcatgtacctctcttctcccagcagtcttgcctaggcagaatcccatgctgaagactgaattgcaagggagcaagtagaaacacacaaggcttcacatagtctcttctactttattttattggccaaagaaagtcataaagccagcctagattcaaggggcaaggaaatagactctacctctttagtgagagaaatttcaaagtctcatggcgaaagatggatgaaatttcaaagtctcgttgcaaaagacagggaaagttgaagaatgagggccattgttgtaattaacaacacaaatgcctgcccaaggattataaaggaaattaatgtggtactgggataggaaagatgggatgtgtgtaggctatgcccctgctagctggtgacagagaagcagggaatgagaaagagttggccataagagcatgtggaccaggcagggagaacgttctggggagagagggctgtgtgggcaaaggctcagagctgggaagtagctcagagtgaaccgaaaggccaggtgagtgaagcctgctgggtgagggggaaactgtgcaagatgagtttagagagtgggcaggggccagatcattgatgaccttcaaggctgttctaaggagtctgtggtcactggtttcatgttagcaaaatgattctagcccagaagagggacacttacactttccatttgcactggttgcagaccagtttccactctgaaagtgcatggagggatatgctttgctcatctctcttctggagaatcttggagtcttcccactctggaaggtaccccaagtagaaatgtaaaccattgtaaactgggtgacacgagaggagggactgtatttatctcattcattacttggagcctgattcctgacacccagggggttctgcaccaacatgaatgacatgagtggatgaatgaatgaaagaatgaatgaatgaatgaaaagagccctggatttggagaaagcctcctggttcctgttcctggctctagcactagtcatgtagccttggacaagtcacttaacctctctacatccttatttgtgaaatgaggtatcaggaccagctctaaacttctctaaacagactttgtgaattccgactgggaacccgggctggggcatccattttacttgaagatttggaatgggaggaaaattaggtaatttctaaaagtttcacattaaaataatcatgaaaatattatgaaatagaatgtaaaatgtacatgaatttttaaagatacaatttgagacatcaaaggcattttgtgcttggctgtggcaggctcaggccctgccctccaacttctgggggaacgtgttttcgggctctcctgctgtgtggcctacttttatgggaacatttgagaagcatgaaaccagagaatatttgctgtcccttttggttactccatatgagctgagatgacatacccagcagcctggtggtgagggtggtggtgagcatgttgttgagggtggtggtgagtgtggtggtgagggtggtggtgagtgtggtggtgagggtggtggtgtgggcatcgcatgcattgtggcttctacagggcacagattgtgtcttgttcatctttggctcaggtatctcttgtctcactcgccacaggtttgtgctccagttatctctcattctcccacaggctactatgtgctctgtgtcaggctcatacggggactccttgtgtattgatggaagcctgctcaagttgagacacacaggatctcacaatctaatgagagacacagcacgtaaacaaagcagatgagcattctttattaaatgaatgaggacatgagcgtctcaacactatctgtctagaggaaggaatataaatggcttcatggctaaatggcagcatttatgcttcatagatgtattttatttatgtatttatttattttttgtttgagacagggtcttgctctgttgcccaggctggagtgcagtggtgcaatcatggctcactgcagccttgacctcccaggctctagcaattcgctcatctcagcttcccaggtagctgggactataggtgtgcgccaccaggcttggctaattttttgtattttttgtacagattgggtttcgccatgttgaccaggctggtcttgatttcctgggctcaagtgatgcaccaacctcagcctcccaaagtgctgggattataggcatgaacaattgcacctgccccatagatatattttaaagaccttttttgtgtaagaatctgtggtgagtgctatggtggatacaaaaatgaacaaaatggtctctgccctcaaggggctgacaaggtgcatggatgcaaacagctgtagccggaggcaggatgcagtcgagactggatgatgatcaaggatgatgattgttgattgagaccacaagctggaggaacccagaggtgggagagaattgtttggctgggggatcatgataaggtttttggaggaggcgtgcttgaggtatgtctcaaaggagagtagggtgtcatcagatagagattgggaagtgggcactgcagggcatgtgggcagagcccaggcacggctactgctggcctctaggcagcttattgggtcaggaaaaggtgctccctccaagtaggtgtccttataacacctggctggatttcagtcccaccttgcccctcagccaggtgcccctgagcagcacacagcttgcataaccatttggtggccctgagcacagggtccaggaagcaaagctgggagggtgctaggttgaagatgtatcatggaaggctggaatgtggactcgttactgcagtctcataagcgccactccccatccacccctggctgatttagatgccccttctctggctctccttccattctgctcatacctctgtctgtgaatgctgcactgtatcgaaacattgtttatgtgtctttttctctcactgggctgtaaaactccttaaaaaggagagttagtgtcttgtggggttttgtgtctcagggctagacacagcatgggcttgcagttcgtatgctggatgtctgaagagcttcagcacactggaaatcaggagctgaggagtgaagacgagttaagaagtggttgctgtggtctctgtcaagaggaaggtgtggattaggagggtggtggtgggttcagaggaaagaagagagatgctggaggcaggtggataggacccgattgaaatggggtgatgtgggggaagaaattaaagaagacccagagattttgatcctcctaagacaagggtgatgttaagaaaggtattgattatgaaagaggactggattttgtgttagcagttggggaggcaccagggaggtttggagtcccagacgaaaatgtgtacaccattcatgtaatcaacatttacggagtttctctttctttctttctttctctatctttctttcgttctttcgttctttctttctttctttctttctttctttctttctttctttctttctttttttttgttttgagacagagtctcaggctggagtgcagtggcaccatcctggctcaatacaacctcagccttccaagttcaagccattcccctgcctcagcctcccaagttcaagccattcccctgcctcagcctccccagtagctgggattacaggcacccaccaccacgcctggctaatttttgtattttcagtagagacagggtttcaccatgttggccaggctggtctcgaacacctgacctcaagtgatccgctggcctcggcctcccaaagtgctgggattacaggtgtgagccactgcgcctggccttggagctcttatgtaccagacactgggagcctgcaaagcccctcaaggagttccagactaggaaagagacagacacactgtacaactcactgacacagagggtatcaggactcatagcggagcaagcagaacagaaggagaatgtcaaggaggaagtgatggatcctatctggaggcatcggggaaactggacctcaaagattgagtataattttccaagtggaaggcagagagctgtggttaataattatagttcccccttcttccagaagggatttgaggcagctcataatactataatactatatgatggaatgtctaaaatgatagattgaaaactaattttagacagtagtttgtacacagtgaaccgtggatgactgggttatcaaaactgaatgttacattttttttaagcattaaattttgctctgaaattcctgacaactaccaagcaaacagagagacagattggttttagaattttactgtgtctggttgggtgcagtggctcacgcctgtaatcccagcactttgggaggcggaggcgggctggtcatgaggtcaggaaatcgaagcatcctggctaacccagtgaaaccctgtctctactaaaaatacaaaaattagccgggcgtggtggcaggcgcctgtagtcccagctactcaggcggctgagacaggagaatcgcttgaacccgggaggcagaagttgcagcgagctgagatcgcgccactgcacttcagcctgggcaacgattttacagtgtcatgaagtcaagcattcaagtccttttttacctggatcctccccctactcctaagtcccaacacgaggttgaaaatgtgcttctggtgagggagatttctaatccattcctgttctaggcataacggatgcagaactgaataagatcatcaagtcttatttcatcgagtttgcattttagctgggggtgcggggacaggcagtagataataaataagtgctctgaaggaaaggaaagtaggttcgagtaactctgaattaaggaaggggagtaattttagatgggttcattgatccagaattgactgttgaagatgtgacagtggatggaacttgagggccagagagtggatggagagagaaaagaaggctaagagggaagcttggacgaggccacattttaaaggtgtaagaggagagagaagagttaagaacggagtggcagagctgttaggacgcctccctgagaagatgggtgggggatacgggtgggtggccagcagcgttgagcagagacagtgcctactggatagtccctgggcacccttccacttcccagccaccctgcaattagctggggccacatgtctagttgtggccaatagacatgggctctgctgaggtggatcagagcatggggctccacctccatctcatcccctgctgtggacctgggagtccctcctggcccacacaggactttatgtgaacaaaaaaccagacctttattataagaagtcacagagagtttggagttgctgtagcatagcccatcctgccgtgccgaatcaagaagttgagcatgtcaaggactggcagaggccactggatttagcagtaaggaaatcactggggattttgagtgggtgatttcagcagaatagtgaaggaagaagtcacttttgtgggaataaaggagaagatgttggaagtaaggagagtgagctgtgtgtgtagattaccatttcaagtagtttgggaggaaggcgagagatatagtggtaacttagataatggagggttgagaggaggcatttccaaaggacagcgtgaggtgggggtgtttgccaaatgaggggatgatcctggggaggtggggagataaaataaagaataattgataagagaaagcctggaaaaaattggaggggatcagaccaaagccaagattggttttggagaggaatagtttactctctgatgttgcaactcagagagatttggaagtggaagggaaggaagctgaaggctaagttaaggtaagatcaattttaatgattagggaatatttgaggcatttgctgagagcattgcaggaggagggcagtgtggctacagaagcaaggccatgtgactgcaggagaagtccctgaagtgttgaaccaaacaagtgcttgacaatcactgtgaggcagtgatgatggatgctgaaccaaacagttgagtagaaggttgtcaagctaggagagggaagaagtgtctcctctccttatatggaagtttctgtatgttcaaaggtggcatagagagagatgtacattccatgatactccttggtcagccaagcagccattcaggaaaactttggaattcccagcaactttgtcaatgggaaatgctgtgggatggccacgggaaagagggaggtgttgtcttccagcagtcattgactactttcgatgcagaactttaagaaacccgcttgctatcagcttccagtcagaacagcacttgtaaagggttgatccttaaacatcgctaaatgaacacatctctgtcttgtggttccaggaattttaatccttgaagctagatggtatgagaacagctttttttctgaagccaggcttgaatggtaggggaaggaatgtggactttggggttaggcagacatagttttgatattttagctgggtggctttgaccttcaacctgtctgaagttatcatttctcttagaatgttattgatagtagagagtgtctggcttagggtggatgctcagaaatagctctctctctctttcctccccctttctttctgtcctcttctctcactctctctttcttgctcactctcttgcttcttgtaatctgccaaggctgggatccagagttccagcttctgtgaatagaggggtcaggctctgataacagttttcctctatctgttatgaccactcaacattcaacagagatattcagcacctgttacatgcccagcatcctgctaagtgcttgggatcaccagtgagcaagagagacacccttgcggcatttgctgttcaacaggagagacaattaaaccaaatggtgtgatattatagggaagccacataatgttttgggaagggttggcaaggactgctagcctggtgaaggcagtggagacttggggagatcagcagaggctaaagcagaggggtgggcagggccaggcagggcagttcgttggtgatcaggaccagtggccaaccgggaccatccatcctggaaagctctatgcagctcctagggactcagggctgtgtgcatttgtgtggcttcaccatgatctcaactccaggtatcagctcttttccaccttgcacctccctctccccaacatcagtgtatgccagtgctctgctttccaaccctggagtccaccaggaaattctcatgtttggtagtgaagggactgcaggttctgagggcttgcaagcatctgtggctgctgctattgttccagcaggtggcagcttctcctgctaatgtttaaactatgtgtcccacagggcccgttgaaatcccaaatagcataaaaaataaacatttatttggacaatattaacgatatatttaaatcactatgaaaatctctattatgccgtgtccttagacacctttgaattccttaatgttatattttaaacaacttaacaaacccctctatccatggggtgcatagcttgtgctaggatataagttattctgtaagtacaaggatttcctttatagagttccattttccaacttgacttttagagaaaaggctgctttcattgtgaatattaagtaaaaatataagggccagggacaaaatatgagtaaagacctaagacaattcttggcctattataagccctcaacgaacactagctgctatcatcatcatcaccaccatcatcattgtcaccaccttcatcgccatcactatcaccattatcaccatcaccaccatcaccatcactatcaccatcataccatcatcaccatcatcatcatcactatcatcatcaccatcaccaccatatcattattattatcatcaccgccatcctcaccatcaccatcaccattaatacacaatcatcatcatcatcactatcatcatcaccatcaacatcaccaccactaccatcatcaccatcatcaccatatcattattattatcatcaccaccatcctcaccatcaccatcaccattaatacaccatcatcaccatcatcacctagtagcttcagtcttagagtaagcttgtgctttcttctagctgttggtgttgtccaatatagtaaatcattattctttatttaaggcatttcctgagagatatttaaaacattgtcatctcaaaccatctatcttctctgttctttgagaattttgcagtgcggtcctccagctctccagagaacgttaggatatatttgaggggaggagggggagaagttgatgtcatgtcctctgtctgcagcttctaggagaggactgaccagcaacagtgtagtgactggtcaatcctgtagtctggagtttcatggctgaagtaagggtcgttgctaactgagaaggtcttgtgctagactgtgtcaaatgggatgaccagtatggggtcatgccatgtgttcacccatggcagagttttccccatggggctaactttgcacatttgcttgggggcggtggggaaggggagagtgggaaggcactggaagaggggactttgcacactgcatgctgcacctaaatgtggccctctgctcacctttctgctcccaggaagtgggagttcaggtggccccaaggtctctttcaaattctcaaccacattccgaggacagaaaatgaatttcatctctatgcactacctgctttgccattcattaaaatgcctgtgattgtgttctcatgttaacatacctgtttcatttcatgctcctttactcccttctcttggttcccttgtacaataaaacagcagcatgaaacaaaacaatgctaagctctccttcactgtgtctctgtggtgtcacatttctttgccatgtgtcatgcatgccactgctttgctgcctcacaccaatggtaggtggggcatgggctggaggggctgggtctccaagcagagccccaggctccatgggagggaccaaggtggggaattgtgggaacgggtggaaaagacatctgcttagattgtccaggaccagtaaagctaatggtcatttgcccagaagaaaggaccatctcaggccaggtaagtggccatcttcctcgcctgtctgtcattcatcccagaaaagagaagatgctaggggaggagtggagccagagatggaccgagagaggtaggagggtgggaggagggcacagagttgggggagggcatatagagaggctgatctggtcacaaactttgagttttgtcaagttgcatcatatccatgaacctcagttgtcttatctgtatagtgggatgatagaagtttatcacaaattctgaggaagtggaatggaagttaattctgtatctctcttgacaaagccgagttcctagttttggtatttttggatggcaatgtgaatcagcaaggaaagcaaggccctttgggtcacacagacctggcctcaggttctcatttagtcactgcttcagttttctattgctgcataacaatgaccacaagcaccagccaggtatgagctcagttttccaggagacatttggctgatgtcttgttcaaggggctgtaagggaattccataaactagggaacttatcaacaacaaacacttcccgcggttctgaaggctgggatgtccacgatggaggccccaacagattcggggtctggtggagtcccactttgtggttcatagatggagtctcttcactgtgtcttcccacggtggaagggccaacctagtgccctggggtctatttcataaggatactgatccttttcacaagggctctgccctcatgactaatcacctcccaaagaccccgcttcctaatactatcacctgcaaggggaaggccttcaacatatacattttgtggaggacacaaatcttagacagcgcagctgggttctcagctcagggtctcacattcaaggtgtcagccaggctgacggggttctcatctggatgcttctaagaagaatctgcttccaagctcatttgggttgctggcaggattcagttcctcgtttaagactcaggtcactgtcttcttgctggccatcagctgggagctgctctcagcagctgggggccacctgcattccttgagatgtgccccctccatcttcaaagccagccatggagaccttctccccagttgaatccttgccaagcttccgatctctctgccttctgcctctggcctctagactcagatggaaagggctcctgtgaccagctggagctcacccagacactccccctttttaaaagtcagctatgcctcatcacatagcctgactgggagtgactaccccatcacatttatggttcacgtgtacactcaaggacaggggtgggaatcctacatgccacagtcactgtgattctacatgccacagtcactgactagtcatgagagctggtaaagggtaatgagcccctgtgggcctcaatgttctgttctctaaaatggggtggttatagataagcaaagtacctagcatgtagtagatacttgatacatctacgagccacccttttccacctaacagttgtctcccaagcccctaatcaaggcccagctttccctgctgtacattctttgcagaatgtgtcctaagtagagttgcacctccctatagaagggaaggggttagaagcttagtgcagagtcccttaagcttacagggcagaataatctcagatgtcagctagaaatgctttccttcagtcgcacccccctgatattctccttcagtggggctgtggtggggccaggttctgcctttgtactaagcaccctgagtgattctgatgtggccgatctgtagaccacaccgaggcatcccgcgagcgatgactgcgccgactccgagtcagccagttgggtttcaaagtctgagcccactgttcctggcagggtgtccctggaggaatggctggacttctcttagtgtcctcatctgtaaaatggggataataacagttgcctcactgggtggctctgtggagcatgcaataatccacaatagtggatttgcaattacagtaataattgcaattataatagttattgcaaatgcaataattcatgattattgagtaaagtgctcagtccagggcctcacatttgctgtgttctcactgtgaattaatgatgtgattgttattactataataaccccatggccctgggcgtgggcctggcttttgctctgccaccctgtgggattctgggcagtgagggggaatgatgggctctgagctgctgtttgggaacagaatctcgtttgaacttcagggagctggtgggaaggaatgagacaagccctccatgccctcctggccctgccctcagtggcccctggcctttcttcccccaccagagctgttcttgggtgcgcctgcccttccctgttcaggctgggacctgcccatgcaggtgatctgaaagccaggccaccctctgcaggagccacctgctcagggaccagggctacctccttcagcccgggggcagtgcccagatcccggggtcagccagctctcactgagcagggcaactatgtggctgtgctgtgtgttaggccttttgtgctctgactgtcctggagcccctcacctccttctcgaggaccagagcatccccagcttgttcatgccaggcttttttttttttttttaagatggagttttgctctgtcacccaggctggagtgcagtgacgcgatctcggctcactgcaatctatgcctcccgggttcaagtgatcctcctgcctcagcctcctgagtagctgggattacaggcacccaccaccacatccagctattttttttttttgtatttttagtagagatggggtttcttcatgttggccaggctggtctcgaactcctgacctcaggttatccacccgcctcagcttcccaaagtgctgggattacaggggtgagccaccatgctgggcttcatgccaggctttgatgtggcttgggccacagcaggcctttaggagggaatccagcaaacccaggcccatgggccagtgtgttccgccatgggaaaagtggtgatagcagacaggctcactgaaaattccgattttaatttccttttgtctgctttcaggcaactttgggctgtaaatgccagatttacccctcctggcctatgctctgggggctggggccatggtggcccaggaaggttgagatacttcccctttctccactgaacacctcctcgccatgtattcctgtttccttctccccagcctggcctggttccacattcaacctttcttcctgaccaccccggctctgcctgaggggagatctgggaaggtgctgggcctagaccaccccaaaagggtggtcactgtggatactgggcagggctcagagcaaggaggggcctcaggcccggagcagtcaggaaggcatgagctgggacttcttctgtcacctccacttatcagctaaaagtgttttaaatgcctccagacctgaggttggggcccaaggatggagaaggcagggcatgggctgtggcaggtactatgcattgctcatttggggactggagttgaggggtgatcgggaatgcagcctggccatactccagcatccttggcctggaagaaggtcagttcatgtcccgggatacaactgcttagccctgggactgtgaccagggctgggcgacaggcaggtccctggacaggaggcctctgtgtggctgtgccattgtcataggtagctttggacaccgttcccagctccctaggaggcagccatatcaggcccgcactcttgtcgctggaaggggactaagttagcagaggacagcccaggggccctgctggctggggccatgcaactcaccactgagctctctcctttccttctctacagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaagtaagaacccgaaggggacgtgccgtatgcatgggtggctgtgggtgtgcaggcctctgcatgtgaatatgcatgctttgggctggggactgggatgggtgagaacagataccccaggcagcccactcagatcccttggccactggaagatattcagaaactcagttttgtcctctgctgtcctcccgagggagaaggaacaggtgtccttctttttcatcttccaaatcttttccatttttccaaatctcttttccccttatatgttcttccactcacattgtcccatcccaagaccgttattagtctaagaaacccattgcatctgtaaagagcaggaaagattggtggcagcagtgggagctgcaggtgttgggatgccctgggcatgcttctgggtgctccagcccctccctcaccataagtgcccttgcctcccttcccccaccctaaggaaaccttcccaccctcctctgcatccattggcacagtctcttagagggactttcagggagccttgttctggcagtcatttctgtgaaaatgaaagtgcgtagcctttgcctgagggggggcccctctaaacttcattttgggtggtcctgcaagcctgatctctgagaacccccagttccctgagacaggccagagggggcagaactaaggctctgaggagtgctccataacgcctggatcagagcagaaagaaaacttgtgagcgatgcaacacagagaatcagctcctacacttactgagttttgggggagacagtcaggggcacccctgcaccaatcaacatgtgtttggcctcgtctgggcttggagaagaaagcaccatgcagaagtcttaggttgccagggatacccggggacagccaggcagaggttgttatccctcctgcctgtgtcgcttagggggagagggaggagcaggtgactctagttgccttaggagaagggtcagaatcctgtgtgagtgtgtctattgatttttcccaacaggccctgcagagggaatattccagctttggggccgctgctatgcctcatacatgggcttgggactttaaaaggctctcttctcaagggccactacttcctcagaaggcagttttttgtttgtctgggtgtttttttttttttgagatggagttttgctctgtagtccaagctggagtgcagtggtgtaatcttggctcactgcagtgtccgtctcccaggttccagcaattctcctgcctcagcctcccaggtagctgaaatcacaggcacatgccaccacgcccggctaatttttttgtatttttagtagagacggggtttcgccattttggccaggctggtctcgaactcctgacctcaggcgatccgcctgtctcagcctctcaaagtgctaagattacaggcatgagccacagtgcccagcacccatgaagtcagtttaaaggggttgatgactaagtcctggtatgtcctacagggacctcctgaatccatcaaaaccacagggatccgagcacctcaaaaatgaaaacaaagcaccttcagaattatttttcattcaaaatgaaaatatgaatccccaataaaaagattccaccaagccaatcactgcacacacaacctttgtagtcaaatgctctacccctgagctatacctgcccccaccacagtctttggcaaatgcacctggtatgttcatcttcaaggatgtcaggatgatttggggaggtgcagtccctcctgcccctgcccctacattactggctttcctcttgcacctgaagctttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaacttt

SEQ ID NO: 36873 - DNA, 50228 bp, Homo sapiens
ggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtgaggcctcaggtgggcggccggggacgctggggagcccggcggccccggcccaggcgggaagcgcaagccagcccgcccagaggggttgccgcggcctggcgtccagagctggggcgtctgagggaggttgcgtgagggtcttcggcttcggcgctggcttggggcgaggggccagggccttggcggcccaggcgaccaaaccctctcctggtccagggctgggtgagggcgaattacgaattgttccaggggcaggcagtcccccagcccgcacggccagcgagttctttctggttttgttctttctccctttcctccttccttccttcgccagtgcattctggtttggtttggatttttttctctctttctttcctttctttctttctttctctttctttttctttctttcttcctctttctttcattctccccttccttccttccttggccccctctctccctccctccttccttccttcctttgccaatgcattggtttgttttctttccttttctgctttccttcctttctttggaagttcactctggttttgctttctttctttccccatcccttcctttctttatccctccttcccttcctccttttctttctacgattccctttatttttccttcattcctccctctttttgtctcttctggaggaggtgaaggagggtcagcttcaggcgctgcgagtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccaggggcgctgggacccgcggtgcggaagactcggaacaggaagaaatagtggcgcgctgggtgggctgccccgccgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctggtgggtcctctgggcccaggagctgggagggctgcgccggcctctggagccccgggagccagtgccgaggtagggagacaacttccgccgcagggcgccggacggtcggggcagagcaggcgacaggtgtccctaggccgcagggcgcttccatagcgccatccccaccaggcactctactcgaaatcggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcggccgcggggcgctctcctctcgggcgcagcggtccttcagcccagggcaggttcctccctttcctactcggaacgtggcaaagataccccagtcccagcccctccagctgagagctgttgcccaaggtcgtcgctacttgtccgctcaatggtgaccccttggcagagaactagggatgattccactccggttgatgttttaggggaaattaaaagaacattcggttttctgagtctccttccggggaggcgtggtggtaactggtttgctgggaagagccgttccttaaccgcatgcaacaaagcaggtgtggaatccggacgagagggcactcactgccttctgccccctttggaaatagaaaaagccttcgaagcagcaatccaaagatcaaatgatttgcggtcaatgatttcaattaaaccagaaattagtaagggagggccgagaagacacggctgctcagaagctgttcgctgtttgagggatttcccggagagcctgttaaaagatgcgaagtggtgggtgtaccgctcagccacctttaaaccggctctgtgcgttctggctctggaaagcaagtctccaggcatttgggctcagaattgctgggccccgagtttgggcgggggtggtccttctgggggtcaggccttgagcagcttgcactggtggcaggtttgggagcagttgaggggcttcctgtgtgtcttttggagggggtgaccctggaagttggcactctggaagggagctgtttggccctagagttttggaaagggccctgaacctgttcggtccccctcggaaagggaagggagcagtggcttagtccctccctcctccattcgtgcaatgcctggggtaggggtagacctggagccggtggactcatatccttggaattcgtcaggacagctgctccggggccttggccctcagtcagtctggggctgaggagtagggaagctgggaacttggggcagaggaagaagatgcgtttagaaagacctccattatgcaaactggagtccatttatgcaaactggtcacccttccagtagctccaaagagtggcagtggagtggcatcttgattgatttaacctcttctcaggggacctgggtctgcgagggaggatatggctgcggggttggaataggatctgtctgagctgccagggtcagggtggtggccctagggaggttttagggccagggtggtcccgggctgtggcaggggctctcagatcgcctcgggctctcagctgcaaggtgaaaaataccatgaggaattgatctgccaagggcggtcttgtctcaaagcaagtggattgctggggtaaagaatctagagaccagcttaggactctgggaggaagaaaaaaaaaaaaagaatagcatagtcctaaggaactgcaaggatcaccagattaacccttcatacctggggaaattaaggccagacatgacacaggcctttcccaaggctctgtagcaagggcaatagcaggccagttgctgccactgcggtcctgtggggcatgttctcactccactgcacccaggaggctgccagcctctgttccttttaacatagatctcctcagttgttaagacagaaagaggaactcagaggggtccctgtgtgcaaggcagagggagaccaccagaaccagggtaagcaccccacttggtagccagttcaaggacttggggatgttttcaacatttacagcgaggtttgaggccccattgtcatgcagcgctactcggccttggtctccttatctgtaaaatgggcccattagcaatgcacagggttgctgtgatgaagggtgaggtcccacaagcaaaagctgtgcagtgaggggggaatcctaagcattgttcctatgccattcaccccttcctgtgagctccccatattccctggctcaaaggagtcttgaatggcagggatggaggactcactgcctggactttgaagacccctgctttctgggtgaccaccttttcttccctttgacagtgaactaatacattggaggtagatagtgctgggaagaggacaggagaccacggctgactttggacatgggctcgaaattgataacttgatgagtcttggagggtggttaagataagctcggggctggggcagcgctgaggtctgatggtcagccagccctccccaaagtgtggccctccgttctggagataggggctttggaaactgcaaaagcgtcctggcaggccagctctggttgctccctggccatagctgctctgactacaggcagcaggacgcaggtcggcctctgcccatcggaggtcagaggcagggcctccagcaccagactcagcagtgccactgcaaacctggcacaacaggctggtcccaggactcagctcagcagtgaagttggaaaccaaggttgagtctccccatctccctttccccaacccgaaagacccaagatgggtgtgggtgaaagagggagaaagaattgctactccagaaactgtcatttgcccacacgaaacgaggtggggttcaaggtctgaactcttccagtgcctgggtgcctttgggtttaaattcagctgcaggtgcccccatcaccacttccacctgagcacaccacgagaagccaggttatcttagaaactgtttcccggaatcaaagcgacttgatttggagagttgggtgaggagaaactcacccctatacccctcagggcgtcagagatgtgaggcaattctctacctccgctggaaaaaatgcagatttattaaaggtcgactgtttagcagaacaacgtagattttttacaacgctttccccgtctctgctttgaagcctgccaggctgcagctggggatccaggagggaaagcccgcaggcgcagaggggacaatccgggaagtggtaaaggggacacccgggcacagggcctgtgctttcgttgcaggcgaggaagtggagcgcgcgctgcagattcagcgcggggctagaggaggggacctggatccctgaaccccggggcggaaagggagcctccgggcggctgtgggtgccgcgctcctcggagccagcagctgctggggcggcgtccgaactccccaggtctgcgcacggcaatgggggcaccgggccttctgtctgtcctcagaatacgtaggatacccgcgggcgacaagccgggccaggctaggagcctccttccctgcccctccccatcggccgcgggaggctttcttggggcgtccccacgaccacccccttctcacccggtccccagtttggaaaaaggcgcaagaagcgggcttttcagggaccccggggagaacacgagggctccgacgcgggagaaggattgaagcgtgcagaggcgccccaaattgcgacaatttactgggatccttttgtggggaaaggaggcttagaggctcaagctataggctgtcctagagcaactaggcgagaacctggccccaaactccctccttacgccctggcacaggttcccggcgactggtgttcccaagggagccccctgagcctaccgcccttgcagggggtcgtgctgcggcttctgggtcataaacgccgaggtcgggggtggcggagctgtagaggctgcccgcgcagaaagctccaggatcccaatatgtgcttgcgtggagcagggagcggaagaggcagccggtcctcaccctcctctcccgccacgcacatatccttcttgacttcgaagtggtttgcaatccgaaagtgagaccttgagtcctcagatggccggcaacgcgccgaggtcacgctccccagaaacacccctctcccctcccctaccccagctccccctggggcgggtggtaattgggggaggagaggccgcaggcagggaaggggtgggaaagccagagagggaggcacaaagtgatggcagcccggcaaacactggggcttcgggctgggccgcgctcgtttaatcccacaaaaatcccattttggaggtgagaaatagaggttagaggtcgggcccttctggagatcagaccgaggagacgggcccagctggcgtcttaaagcaaggagggggagtcgggaggaggtgagacccctgcacccaggtggggctcccaaaccgttctggatttaccacactcccaggtccgattttccatggagggctggggttagggactggcaccttcttgttgttaaccgcatttgatattcacaagaaccctgtgaggagactttgtcaccgtttttagatgcctgaggttgccggaggggcagtgagagaatcgtctaacctggtgttcctaccacagtccaggccctgtgtcctgggctggacccacagcccctgccaccacccagaggaaggcgcgaagctggctgcctcctttacgggtctcccttaggtgccctcatgaagggggacggccacctcacagtgcaggaactatctccccgtttgctcccaaatagtcttcttggtgtggtgctgtctatggtctgtgacctgcatctggagttacccccaggaccagcttcggaagaggagggatcgcttggaggccgtgcagtgtgaggaacggcaggcagggtgtgggaccaacatgcacacactcgcaggtgctggggccagggaggaatgaggcgctggctccctttccctccatttctccctgggggtcccagcaacctggccatccctgacttccaacagcacagcgtccccacaggtcctgcagtgctctgcaggggtgcagggagctcccctccccccagccgcaacctcaccttcctcacccccacccctccggcaggaaaccacaggctgggttggggacccctggtgctccaagagagcagtgagtgctgggagccgctaaccccgaggcgcctagcacagactcttctcaccccttatttctgaaataaagcccttccttaggtccagatgaggaccacgtgctcagtgcctcactttcgtgggagtgtatatcactttacagtatcaagacaattttctttcgttacaaatctttatttagtctctgcgtttagaccaaagtagatttttatgggctgagtgaaaaaacctcgcccgcattggtttctgatggaacagctggcagcgccacggccccgggtggggtggcctagaggcaggggtgcttgggaggaacatctagcacccgaccacctccaccaggtgggaaagggacgtttgcaccaaatctccgccggcaaagcagaggctttggggaattacagaaaaactataatgatctaaaagagaacaagttatcttgaactgtgcgggtatttgaatcatacagaaaattgtcctgtgtgcccaatgcacttttgcatgtagagccagggccttcgaggaagctttcaggagatcccgggcagcggagtctggtctggagtttcatttccgtaggtgcagatttctccccaagtcttcccgccatgggctttgcaagaagccagggcccagaggccacgctcaccgttaacactgcacagggcaaaggtggctccaggacaactgcccaaccccaggaacgacccagcagcagagaaaaggacagctgccagggtgcctttgtcgctttttggaaatcagaattcctgggtccttagttaagtcttacttcaccaaatcccaggaccttcacattttggttcttgccattgctaacagttgtaaatgctgccgccacgaggcctgggaggaaggacccgctggtgagagcacagggagtgctgctgtgatcacggtggtgatgcggggtgagcgcgatttcccgggattaaaaagccaccgctgcccccgtggtggaggctgggggcccccgaataatgagctgtgattgtattcccgggatcgtgtatgtggaaattagccacctcctcagccaggataagcccctaattccttgagcccaggaggagaaattaaaggtcatccctttttaaattgaggaatagtggttttttttaacttttttttttttaggtttttagttgccgaatagggaagggtttgcgaagccgctgccctgggccgaggtgcattttacgcttccagaggtcgaggcctccagagaccgcgatgcccagggcgttcccggggaggctgagagacccagggtgctctgggtgactgcacggcgactcctcgggaacccactcgtggctgcccgcttggaagggctttgcggccccgggaacgatctccaggatctccacggctggtcaggttccccgtccctcgtatcccgcgctgcccgggggctcctgcctttggttcagtgctcgcggcaccaccgcactcaggacggcagtggggggctggggctggggctgggcctggcccagcgtgggttggggcgggggacgcgccagcagcgcccgcagctcgctccgcaggggtcgcagccaggggtcgggagctaggctcgtgggccgggagacgccgggcgcgttgtcctccggggaggttggggtgcaggcggtgcaccgaccctcgccatctggcgctgcagccaccagccacggcgcttagtggagggtctgcggccaggctcccggcggaaagattccggggagggctcgggggttgtcccagcccgcgctaagcgccgcagcctcgcccggctttcctgcttcctcggactgtgcaggggaagcctggggtctcgcggggcgcagcagtcaggtcgagggtgcagcaggaggggagtcctgacgggcaggtccctctttcccctggtgcgcaacactggttggtagcttttgcggaggtggtgaagaagggcaggaggcctgttgagcggaggagtccggggatccctaattatgtgacaggagaccctttccagttcggcctgtggcccatccctctctcaccgccggcagattggagtctgctctcggggagcccccaggtaaacccctcacagggagaaggtttcggattggaaggaggaccgcgctcgtggggcgcctgtgagagctgggaagcccaaggggtagcgtgtagggggttttttatgcgggaggagctgcctcctgggcggcggggactttctgtctcagcctgtctgcctttgggaaaacaaggagttgccggagaagcagggaaagaaaggagggagggaaggagggtccttgggggaatatttgcgggtcaaatcgatatccccgtttggccacgagaatggcgatttcaaagcagattagattactttgtggcatttcaaataaaacggcaatttcagggccatgagcacgtgggcgacccgcgggagctgtgggcctggcaggctcgcacaggcgcccgggctgccggccgctgcggggatttctcccccagccttttctttttaacagagggcaaaggggcgacggcgagagcacagatggcggctgcggagccggggaggcggcggggagacgcgcgggactcgtggggagggctggcagggtgcaggggttccgcgtgacctgcccggctcccaggcatcgggctgggcgctgcagtttaccgatttgctttcgtccctcgtccaggtttaggagacgcgtggggacagccgagccgcgccgggcccctggacggcgtcgccaaggagctgggatcgcacttgctgcaggtagagcggcctcgccgggggaggagcgcagccgccgcaggctcccttcccaccccgccaccccagcctccaggcgtcccttccccaggagcgccaggcagatccagaggctgccgggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctttccaatctcacttccctcagcaggttccacccagcgcttgctctgtgccaggcgccagggctggagcagcagaaatgattgggctgctctgagctctgaagcattcggccgctgtgtgtgtgcaaggggcgcaaggacggagagacagcatcaataatacaatattaacaggagcacttgtccagagcttactgcaagccacattcagttccggaccttattgacttccccctcccatctagagtggattctggtttttcaatttgttttgttttgttttttgtttgtttgtttgtttttgagacggagtctcactctgtggcccaggctagagtgcaatggcgcgatctcggctcactccaacctccgcctcccgggttcaagcgattctcccgcttcagcctcccgagtagccaggattgcaggcacccgccatcatgcctggctaatttttgtagagacagggtttcacccaggctggtctcgatctcctgacctccgatgatccgcccacctcagccttccaaagtgttgggattacaggcgtgagccaacgcgtcctgccttgattctgtttttaactccattttttagaggaggaaattgaggcacagagaggttaaataacatgtctaaggtcacacagcaaggggtggagcggagttagcccactggcctagctctagagcccacccggataaccagaacttggtgaggcctccgggctcttgcttggtttggagccaggtgcttagcgccccgagcccggggccattcaccctgcaggagctgcacgcgcccctgacctcggcttttccctggcagcagaggggctttgcgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgccatgacttaggtcagcgagtcagccgctagctctgcatttccaaaaagcagatcttttcacaactctcttgccccaagtgccctggtgtggtttattttttaaaatgcatgcctgcggaagagaagacccggggaatattcgaaaccccgagcttttacaacataaagcgcatggtgtggccgcggcgagtaatggcgctctgggagccctgcccaggcggcctctgctcgccctcctccacttccagctccgagctgggtgtgttgcaagtttcatactcctacatattataagtgacactaatatcagggacaactaagtgctggggaacttcaatgaaaacctggctggtaaagtcaacacccccagacttctctgtgctacatttctttaattaattccggagtggtgtgtggacgggcgtctttgcagttattatacacgtaagtgaattaggccatttgaagctacgaagtcatacccaacattttccattaagaatattatttttttagctactgctggcaacttttagaatttaattatgataattttcctcttttcctcattatcccagatatggctggttgtgagatactttttcactaaatgtgtctctttaatgattttggaattaagcaagcatgccaaatgcgccaagacatttataactttagaaattgctgtatagtatatatttttggaacaccacaggtttagttgggaaaatattttgcagctgagttagaaacttgaaagttaggcttataatcaagatgctgattttcaaccttagcatcggggaaggtaatgatagtttagttggcaaagactttttgcagcaaactgtatttgagacagcagaatccaaggatatctttcaagattcacttatactacattctttttagccccctctctaggggtggagggggtggcttagaaaaaccaaaggtaatctggtttcaattacatgctgtaaaaatagaatttgtggccagaaattaatttggaatattttttatgggggcaacattgtgggttgtatgagtctttcaccaactttattgcttttctttggttctggatctaaaatatgaatgagtaaataaaatacagtttcctttttcaaaaataatttagtctttttatccttgacacataaatataatcattacctttttatttgtcttaattacctcttatagttttactttatttttgagggttagccaacttaggaaaaatcagaatttcatttgggtagttttcatttttcagaagttgatacttttcctccttgaattttgcaaaggttatttgatctcttgcaaattctaaataattaattctgtagacatagtctggtaaaataaccaggtattttgttttattttctgggcagtggtagtgttcggaatttattattccaacggtacttagaggtaactagaaaattgtggcaaataaagcatatgtcctagtggtataaatgactgccaattatgacataaaatggtctatatagtggtagattttcccctaagtaccatagaactccggatttgtactaagtgctaaaataaccccaaacaataaagctactacgtttaacctgagcttgataggaattctcaaatgttttgcatgatttttgtgatgtggatgtatgattgtttctaaagtgctttaaaagcatttcagagcctggcctgggaactaaaccctgggtgctgtttcctacagtcctttttaagaccctgggcttcatttttgcatttagcaagtatgtgttgatggtcatatttgatgcatccctccatcccagtgactgtaccattgttagatttaactctaatgtagaatgatcatctcttattctgacactttatcttttacagactttggatggatttgtttttgtggtagcatctgatggcaaaatcatgtatatatccgagaccgcttctgtccatttaggcttatcccaggtgggtattgcctaattttatgtgcaaccaaaatattaaacgaagtgacagcagattttgacagcctcacccaacttgaaaatgagtctgtttaagtgtttgcttttgtgtaagaacataaccctaaattgcaaaatcctcttctcaggacatcctgcaggggttttcttctccatattacgttttacttttttactttctttttcccttggggtttcatgaccagtgtgtcttcaccccgtcagccttgttccgagattctgccaaaacccggactatctgcttatgtagtaatgctagatgccctgaaaagagctccacaaagggacatgtttcagtccacacttgctggtctgcacgttacggtattatgagttgctataaagcaagaggtaagctgatgtggaacatggattttatgcagaatgttctttggggagagagaatggggaggggtagatttatgagtgttcgcatggaattcggggtcatttttcctgactttttccagttcagtggtcgtttcagcaaagcattttatatgcttgtgatagaaactcataaaactcagtttactactgttttgaacagcaaggtttctttagaacatctgaatattaccaatttttctggaaagatggaatcatcttcttaaaaaagtccaccgtttccttagaggaaagagggggactcagctttgtctctccctggcaagccaagggtttgatgggggatttgggggctccctgggcccattgaatgtctgaaaggggatagtgtaactgatcattctcattcacatgcctgacttaacaaatgtggatcatgattttaaaagtcacattttaaactacatatagggactaaatatttcttcacattgtgtactatcagagtgatttttcaccgtgactgaagacacactagaattaatgatagatacagaggatgggttccagagaggcccatattgaatttgaattacacctgcctcctaatgtagttaagccaaaataaaacatgccgattaatgtggcttcagtttgctcattgaaaaacaaaatgaccacatttggcaaactgcatctggtgtattccttttatttttctgccaatacttttttttataagcttgctatttatttacatccttctcttctgatgtatggatatccttatccagatccacatgggtttatgtaactctgtgtttctcaggcaaaaccctttaaaatgaattacatattaaaatgatatggaagtttttctcttcctcttctctgcttttatcaaaccaagtctcccaaatacagtttactaaggcttggcacttgtgcctatgtgactcgtgggattagtgtacttgtagaatgggaactactgttgggaacaggaaatttactattttccataattattaggttgatgcaaaagtaaatgcggtctttccattacttttaatggcaatgaccgcaattacctttgcaccaacctactattattattctctgaatttttatcttgccctatttagaatcatgcagggcccttaagttgtacccagactagtttctacttctgacttggcccaattacttaccttttttagtcatttagaaaacctttcatagtcttacagtaatgtcacaaacacaacaaaacatttcacacacttttaaagatgactgatcaaaaatcttttaaaataggtaaagtcactgttatcaaatattaaatttagatctgagctccctagcagtcaaagcaaaaagggaaatgtattcagttatagagtttttattgtctgatagggcaggttctttaacctacttgaaccatgtaacttaaatagtaaaatcatgcctgctctatctgtctttaaggatcgtggtgagaaagggatcaaaatgcctatttcatgtgatttacaaactacagggggcaacacaaaatccaggcatacccacagtttcatttgagcaaacttgctttcagtagagtcctttgggggctcctattagggctgcttggtcatttggaatgtcctggcccatcaggaggtactgtgcacatcccaagagatccggtgcattcagtcaggccgtccaagttagcctctctgtgttatttttctctttttatgtggaaaatagaattgattgattataaacacaataattaagaaggaccaaaatattggataggtgacaaatctgcctccggttcgtgatcggctccacggaaggaaatccaggcagcctcacaagttgaagtactctatttcctcatgatcataatgcagcaggaaaactttgcatcataattttgagagaggagaggggttaggcactaccattttctaagtaaagttgtagagatacatacattgtctctttctctccagtagaagtgatagtttctaaaaagataagtcaaactgatcatttgcatagagcaactgattttttctgatttctctgcggggctgtgttagcatcagttcacagctacaaaaacactttagtgccaagtgccctctttgtcggtgtctagggagcgttccacggtgaactgtttaaataagcaacaacttttctctcaaatcttccccctgttcatgattaactccatagaaggaaatctaggcagaatcacaatgtgtatttttttctgtcttctttacttaaatagtaaaataaagtattgaataggatgtcaaatacccaactggtcttttaaacatttttgcaccttttagattattttttaaaagtcaggcaaatgtatcaagcatgagacctttattaaaatgggcttaaacattttttttaagtcatgagagataaaagtgttaataaaattttacccagtagtcagagtaaccttttaaaaagaatttctgatgaataacgatagtagtaatagctgatacatgctgctcttttgtgttccaaaaactttcaattaccttcaatgacattatcttattaagtaaagatgtctttcatgttgattcagtgttaaactttatgttaaaagatcatagagaatgtaagcccctagatctgctataattgtgtggaaattcactacaaagtgattttttgttttgttttgtttttggtctaacctctactaaatgactatccaaattctttatttgagggtatggaaatgattctttatgggttataagcccatccccattccaagtcttttattaagccttatttgaacaagtgttgaaataaatctgcttcgtatggcagagctaaaattttagttttttttttgtttacactagtaaacaagtgattgttgctgccaaactttggtactaaaacaatgacagagacaaccataaaatgccagttgtctcctcagcccagggtccaagtgttaggcagtagagaggcaggctttcagcctgaaaactcccgttggtgggcacactcgcacacgtgtccacacacaaagcatctagacaagtttctatctacgtggatgaggtagagttggggcagcaatgtttttccatgcgtgtttactaaatgatttagttccatgtgctgttttggttaatgcaattattttacttttatttagggaggaggaagaaaaatccccgtgtaaaaatgtagctgctgtatacatttttaagtatccttgggttaagtttcctcaccaacatttcacacagttatatagcatctaggtaactagtatacatgttcaaataaatatacgtatgtaagaaatagctatttatgagacacataaaagaatgtcttatttgagattgtggccagaaacaaccataaacatatcgatgatgttgtttggaggtacaagacctaatcctttcacttttgaaataaagacaaaagacaacataattatgtttgttgacataacttgaaccctgaaacccaaaccatcttgttttaaaatccttaatttaccatactcagcaaaacaccccagagtaacgtgcattttcagagtgccaaacaactctccccttccacacagaatatatgcatttagtgctgtatttatcatgtgtaggtttcttggcaagaagaaaagctattcagcaaaacataaaaaagctcttagtaggaaagctatccattttgtagttagcagggttttgcaaatactaaaatatcacatggaaggtctgttttaataaggctgatgcatgagacccagggagttttatagcgacaaccataattttttttttttttgtgaggtagtcacatttctctcagtgttcaaaagcgtggatagatacgtaaatacaggaaacaccatgtcaaccataattttgacttaaggtcaggactgttttatcattccaaaatttgttctgtaaagacatttccgttatttgaaggctgtttcacttcctagacagctctggagttttcccgttcgttttgtcacagactcgagccttcagaaaaccaagcctttcatctgtgcaacctcacccttctcattcttcaaaagcatgtgttgagaacgggaactctgaaaacataagaacctactctgggattaaaacgcaaatctaacccttaataagcacagatggaaggtctttctgcaaggaggtaaagttgtttcccgaaaacacatcagttacttttttccagaaaagaacttcgagcaaaccagaattattctttttccctgaaaacatggggaagggagaaacgataggccaatataacatttctctattttgttattttttcatttttaaaataaactgttgaaattgtgagtcactatatattttcttttctttctttcttttctttttttttttttttgagacagagtcttgctctgtcgcccaggctggagtgcagtggtgcgatgtcggcttactgcaaactgcgcctcccgggttcagacgattctcctgcctcggcttcccttgtagctgggatcacagccgcatgccaccacgcccggctaatttttgtatttttagtatgacatgatttcaccacgttggccaggctggtcttgaactcctgacctcaggtgatccgcctgcctcggcctaccaaagtgtcaatatatattttcttaagccaactctcttagtttttagcttctgccactccgcacctggacaggccttcccagggcatagtcattgccaccctgaggaaaaaaggaaatggtcctgtcccaaatggctggcttacctgttgccagtttatttaaactttttaaggattaacaggaatgactcgaaagaagaatatttagttttattatttttcttaaatgaaatcctgtaataaacttttcagggaggcgaatgtccgtctgggagatctgttgagaaagtgccaggcttgggaagtgggtgttaagtagagggtagggaggattcctctaataggattctctctgttgctctgtttgcataatattggaaggaaacattccatgaataatgtaaaacatagaactgtgagagccgttttagggacaagatgacttagcaggccagaagtgtaacttattctgaataagaaagcaactcgctcttcttaacaaattggaagaactggctcagaggagtgcgataaatcacttcacccctccacgaccccttggtcccaagtaaaagctgatggcctagatgctaatctggaactgcaactcccagaacttctccattaagcagctggctgggttgtcctgttgcgtgaggtggcaccgtcaggatggccactttgcagataatcatgttgtctctcctctgatggagagccacaggctcccagcgacacctgcagcaagacacacctaaaaataacaagggggtggctcgggacaagacacaccatgagcctccttttgttatcttgagttaccctctctccttccggcagggtcaagaaggaattctccagacctacccaagatccttcgccacccaaggacggtttcccacatgctttgagtttcttctcaggctgggcactgggactccccttggtggtggaggaagtcctaccactgcccctgggcctcccctgaacaatgctggggttcaccgactcactgtccttgtctgccaccctcagcactattgattatagctctaaaaataggatccacccaccactgctcagaaggctgctctgctagtcatttctagaacattctgtgccactgtccatcttaaggtgggtgggggcccaggtgttgagactctatcatatcctctcctggtgcttatgtttgagagaacattcgaaagattctcaagttcgggaatttgggcctccagggacctctgtgtaaaaattgtaactatgatgggtattttcctggggccatccattcctgcaaagtgacatggatgtgctgtcctctgtgggctgtgtctggaaataggtagcgtcggactgttgaggcagcaaccccaggacataatccccatataacgtggctctctggagcaggcccagaccctcccgcagggcacgcacagccccagccacacccctgggcgggagccacagaattagcacagtcatctcggactgggagggccagagactcattgctggtaatgtgagagaggcctggcagcgcctgaggggcacagctcagagtcgacgaagaaagggcctttgtctgagttcatgtcctcctcgggcgcagtggcgcccctgccgtggacggctggtcggcctcggagtggacaacacttccacagggagcactatgtggacaggacagctggccttctggccacccagtcccctcagatcgccagcaagggaaggacagagaccctggcctgggtctgtttcaagccctcttctgtatgaaggatgctgcccaggccagcagcgccgcccacctctggtgcccaccttttccaccctttgctttctggtccttcctgctaagggttctcttggctgcaagctcaagcctcagtgccatggcctttttagacagtgtgggagacagttcagagctctgagctctgttgagaaaagaaaactgtttctgcgtttggcaaaggtgtgggttgtcagcagagatcaaagttctgttcctggcagggtgagcacctgtgacacaccttgcccctccccctgcgccaatcccagagaggcggtggcatttctgacccttcccttccacggcaggtggagctcacgggcaacagtatttatgaatacatccatccttctgaccacgatgagatgaccgctgtcctcacggcccaccagccgctgcaccaccacctgctccaaggtattccatccagagggaaaaaaaaaaacagactaaaagcaaggcgacattcttaaatggaactcagggctttgcttcccacatctgccaagtggctgggcatgactaggactgcccagcccaggtctctccaatacacacacagcacccaccacgtggggatttgcattgatacctgtgtcttttaagccaatattcatcaagctcctattgttggccagaacccgtgttgagtgctaggtagaggacaaaagtggtgcaagcctgctcccctcgtgctcttgggtcagaattccagggattacagcatcacgggtctagaccaagcttctccttaaccaagatgccgtgcctaaaactcgggggtcgggggtggtccatgacatttcatggggaaaattacatatgtgtttcctccagttgaaatttggcatttcctttgcttctgatgatagatgataaaccatcttggggtccctagtacctgtggctttgccaacaatagaaatcacagatgttttccatatcataggaaagttttgcaggtttaaacatatcgcttatgcccacatgcctacttcaaaatttcaggagttctaagacctgctactgaatcttcttatttatgtattaataaagcagcacatttatatccgtatcactgtgttgaaatattttgataattattttccaatacagttgcttttttggtaatcttatatattttattttatgtatttaaaaatgttactccaagtagggatctgtaggttttgtgctgtggcacaaatcattaagaagccctggtcattacacaaatgactccttaaatttcaattgtgatgagtgctaggaagatacagaaggacttattccaggggccctggccttttaactccctccaaccatccagtgaggccaacaggcctcttgacaaatgggtcttatgtgtgctttggactatggcacccagcttggccagaataccccagtggaacaaaatgcaaaagaagaggctttaagggtgatgagaatggggtagctggctgcaggaaaaacatgagttgcattcttattgctgtcttctgggggttggtggggagaggtcattctcgggctgggaagagagaatacaaaatagcacacacagttgtaaaatcccttgcagacagttctgtggcccgcaagttccagctccagaaatagtcactggagtctaattattccttaccaaggagagagcctggcatgttggtttctgaaatgagatggggcacctagttgtagctaaggtctgattcttggatatgatatgtctgcagacatcaacatgaatcatggctctgaagaggtaatttctaaaaaatgagggctaggctagaacatcgcacctgaatcgaattctttcactgtggggttgtttaaagctggacaaagacaacaggtgtcagagaattgcagaacatagtgctgttactgtttttgaaaattgcacagtacggttttttgttttgttttgttttttggagttggagtttcattcttgttacccaggcaaggagtgcagtggtgtgatctcggctcactgcaacctccaccacctgggttcaagcgattctcctgcctcagccctcccaagtagctgggattacaggtgcctgccaccacgcctggctaatttttttgtatttttattagagacagggttttgccatgctggtcagactggtctcgaacctcaggcgatctgcccacctcagcctcccaaagtgctgggattacaggcgtgagccaccgtgcctggcctgaaaattgcacagtatgttaactgtatgggactgggctttctccccctacccccggtttcattttaccctgcctgggtcataacctcccaaagagggattataaatgagagcaaatgagtcttgggaatatcatgagaccctttcatgccctgtttctgtagcctttgagtctgaagcaacaagggctggaagcattgaggccgcacctgactcatttccacagccggccgaggggtgcaggggttgagattcccaagtgctcgattttctccccagctgctccattttctccccagctgctcccttgctgactttccgtgtctgaaatgacccccgttgttttatgataaacctgtgagaaatgggctctccccagaacttggtaattgatgaccagttgatgtatttttagacctgagcttccacccaccgtgcttgtctggaaatggctggggcaggcagccatgttagagggaagctttttgcccaaagacaccatctgcagggggaattgtgggtaaaatatggcagcctctccaactggggcagggggtgccctctgaggtgattcctgagcttccacagggcagtgacctcagggagggtggaagactttgcttccattcctagtggtaaccttcctttaaaaattcatgtattaacctccaccaaagggctgtttatttagagtggagtgacctcgccctcccttagaggtccttctctatttgtgtcttagagtgctggtgtcccttcctgaaacagagggtgtttccttaggggacacatttgcattgacaatagtgaggtcagagatttgcgtgggaggcctgcaaaagcaaagtgagtgagtgggaagggcagagccctggagagacagagacggggtggtccttctggggctagaaatgagggtgaaagcatggatctgccaagccttgggtcacacacactcaagtcctgctaccctgagggaggtcagaggcttctgggccttcctggagcccacggcccccaggagcgggcgacggcaggtggagctctgcagggcccatcaggggcctcaggggtggcctcgtttggctgccttcctttagagccaaggaagccacaccaggactgggctggtgtctccactgccccacccagatctcagccaaggccgaagatctctgagcagggtctgggcacactgagaaggcctctgggtgctgcatctggccctgggaacacattggtgcggttggaataaggatgggggaagcacggagggacagctgccaacctcatcttgctcctgcttgcagagtatgagatagagaggtcgttctttcttcgaatgaaatgtgtcttggcgaaaaggaacgcgggcctgacctgcagcggatacaaggtacggggagtcatgggtgcggggaggagctggctaagggtcttcaatgtgtgttttcaagagcgtctgcagaaaggaaggcacgggagcacaaactcgtcatccccactaatgtagagctctccagcaacgtggtgcacagtctcttggaggctcatgtgagagctggtgttttaggaggatgttccagctggctggaattcatcgcataagacccggaatcagtgtggcttagggcagattttattaataccttggcactttccatgtggaccagtcccagtggagccaccgcctctggagtttatagaggcccatcctcctgggcacagtgcagctggcagtggtatccagagcacggacactgcccttccccttgggatgctccaccaagttccctgccgccgatgacggtgtgcaccacaataatgctagcgccctttccaaggtccaaggcagagctttcatctgcggcaccacacctgggccactccctcaagcatctcagctgcccattggaatgagcagcactggcccagttttctagtcaaggaccagaggagggacggcagaaggggcttggtggcggagctgggactctgagcccagcccatgctcctccctggctccacgtctctgccagacaccaccgcttgttcttgttaattccagaatggaggagtaggtcatgtctcagggcacgagagtcagccgccccccagggaaaagtgggtcgggggaagtctgtgctgagtgccccccgccaacacttttgtcccctctctgggctccttaccctcctcccaggcatcttcactgccatctctccaacctcagaggacagacatcataacccatcaatatgaggctgaaagctgccagaaactttcttccaggaggatttgtctcttagaaaagaagggaggaggatggggtgagaggaaagggcacttttgtgcctttgtcctctctttctggaaggccccgccccagctcccctctttgaccccactctgagctcctcctttgacctatatctcactgtgctgttacagttcgggggacatgtttcttcctttttgtcccagatactaagcctctttgggccacggtggggccccaggagccaacagacattcttcagggcacttgggtctttttgttaagggacagggtcttgctctgtcacccaggctggagtccagtggtgcaatcacagctcactggagcctcaaactcctgggctcaaatgatcctcccacctcagccatctgtgtagctggggccacaggcgcacgccaccacacccagctaatttttaaaattttttgtggagatggggtcttgctgtgtttccaggctggtcttgagtccctagcctcagtcaatcctcctgccttggcctcccaaagtgtcaggattacagacaggagccaccgcgcctggatgggacttgggtcttgacttttttttgccacttattaactgtccgctgtccaatcttaagcaatacacaacaccatcttgttcttggtttcctcattagtaaaatgggagaatagactggaaggattttaagatttgttttagccctaaagatgatgaatgcattcagaaatcctggagaaagagttttggaacagagaacttaaggctaagattcttcactgttgtcatgatgatattgaccctgtcaagatttcacagactgcagcttgaataaatgcttccagtagtgacgctcgaggctgtacagatgtttctgtttgacaccgaaacactgcattcttgtctgtatggcttttggctatagcaattggaagggcttctgtagggccactctggcttattattatgaggaaataaaatcttgaattataaataaaggaaataaaaatacattaaaaatgaagacttcaaaaaattgtactggggcagggcacagtgattcatgcctgtaattccagtactttggaaggctaatgtgggaggattgcttgagcccaggggttcgagaccagtctgggcaacataatgagaccttgtctctacaaaaaattttttaaaaaattagccaggcacggtggcacatgcctgtggtcccagctactcaggaggctaaggtgggaggatcacttgagcctgggaggtcaaggctgcagtgagcctgattgcactactgcactccagcctgaatgacagtgagaccttgtctaaaaaaaaatctacggaaagaattgtttatttactggtacagcgtgtcgagtgatacagatgccaagttcaatcccattggaaggtggtaagcagcatcgtcagtgatgcaagcactgtggaacaaatggttggcctcccccagatgcctttattgtgttacctactcacagcttggcagtgagctcatatgtatatctccatcatatatgacagggccctaatttgtagttacttacagtacagtcaattggataagacaacccttatattttattatgatattttttgttgtcttgtgagtttgttttgttaccctggctggagtgcagtggcacaatctcggctcactgcaacccccgcctccagggctcaagtgatcctcccacctcagcctcccaagtagctggagactataggcatgcaccaccatgcccggataatttttgtattttttgtagagaaggggtttcgccatgtcaccaaggctggtctcgaactcctggactcaagcaatcccccgacctcggcctcccaaagtgctgagatggcaagactgagccactgcttccagctgttatgttgtttcctaagaagcacagctctccacttctcctaagcaatgaaccggtgcctgtcagcacattgggccgcacagtggagtagaggctgggctgggagatattctagcatgtttgagaaaatgagccaggaggagtgggctccagcccaaccccagtggccagtggctgaccctgccctctccactcccaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccaggtgagttcggcacctgccacagtggctgtggccttctggaagacaccggtggtggaaatgggtccctgaaagctgccatcttggccaaatcataacaaggaataagtcataataggaatgtggattaagcaaaaccaatttatgaactgaaagaacatatgtcagccttaggactcaagggcttgttttactttatttacttattgatttacttattttatttacttattgattacttattttatttacttattgattacttgttttattttatttacttatttgaatcactagagtttgaaatgaaaacatgggctgtgagcacaggttgggcttttttgaaggccatgatgtcagagctctgcctcctgcgtccaaggaggactttagaacaaacagaaaatttccaccctgtgtgcggtgtgtggggggccttggcactcaggctggtgtgaagccaccacagggctgaggctgggagcagagacgctatctaccctgggggatgctcttcccacagctcatgggtgccctgtctacatctgggctgggaggaggggattggatgaggtcatttctcctggccttggggagtacctctctccagacccgtgctggagtggccttcactctcccctagaaccggctgcagtcccagttttttaactgagtctgcagttaaagtctgagttttttaaaattgaagtgaattttaattttaattaattaatttttttgagacagagttccgctcttttgcccaggctggaatgcaatggtgcgatctcagctcactgcaacctctgcctcacaggttcaagcgattctgcctcagcctcccaagtagctgggattccaggcacccaccaccatgcccagttaatttttgtatttttagtagagatgcggtttcactatgttggccaggctggtcttgaactcctgacctcaggtgatccgcccgcctcagcctcccaaagtgctgggattccaggagtgaaccactgtgcccagcctaaaactgaattgaatttttaagtgacaaacgctaactgcgtttggttttcagggttttgtggtgtttgtggggtacattgtgatgctttgacacatgtccactctgtggaaccatcaaacccctcccaagtcttgaggccacgtgctagtcaggcctcttccatgttcttatttgtaaaacagcagcgcagcctgcccactcactgctaggaaagatgagattagataatagacggaagcattggaaacagtgaagcctctcttacctgcaaggccactttagctcttggcaggtaggttcctcagctgtgcagtcgggaataagccatcagagaccccgctcctggcgtggggtgtgtgtgtgcgatgagtctttggcggggggaggagagatacattttgctttctgtatgtccagaagccaggatttactgttttcttttctttttcactttttaaagttgtggtaaaatacacatcacataaaattgatcattttaaccatttattgatgttctatagagaaaaaacagatcttcctggttaggggcaagagataaagacaggagtcagtttggctccttgtcgacacccttcaggaccactcagaagcagggtgagtgtgtcagggtcaccagcatcttcccagaaactccaagcagacaggaaacagcgctctttggggaaagctgccagcacctctggggacggccaagagcgacaaatgccattttcctgccatgcagagggaggcgctgcagggagagaaggcagccaagctgccccagccagggtggacccctctgctccctcttttctgacttgggagccacttctgagaggtggctggaaggacatcagctgcccaaagtcattatcagagacatctaggaggatccaactggtttcccccttgtttcgtctcctagttttcctctgggccttctaggaaacccctgagactgatgaattctggagaacaggaaagaagtggtctccccagaggagagacctgagggcttttcaagccgttcaatccacattgcctggaaaggcagccaagggtagaggaggttgtgcctaaaggaggcctggacagggcctggatggggctttgcagcgccagagggggctcccgcgtctcagggtgtaggggctgcacccctggagtgaacagaaaagaaggctggtggtcttgaaggagacatcctgcctctcccagatctctggttgttcctgccatatcaggaaacttctagcaaagccttgaggccttttctgagctgcagtcacatgggaggggctgaaaggggtcagaagaatgctgcagaagccttcccagtcaccacagtcagtctgtgaccaaggggatggggcctgggctggcccagccctgggaggacagcagagtggccaagcagggtgggagatgtcccttctgagtccaaaccccagaagccagacgagggctttgcccgaagtccagcggccccaagtcacaggagcgagggtggtcgtgggcctgtctggcgccacaccccgcacaatcccagacacaactgaactcgccgtaacctgaaattgggtttgtcagggttttgtggtatttctctttgaaactggagctgatgcttttgctaaggatgggtgaacacagcgatgtttggggtttggcagattcctctgacaggtcttcagacactagaggcttggaaaaaaccgggagggcaccttgccaaacccctccatttccctttaatttttaaagccagtgtgtactttgatgagaaacttaatacatgtgtttctgattcatttacacgtttggggccgttgttctgtaactttgcatccaaagggtctgggaagcctctttcatccccacacggtagagatgcctggttttctttttgggggaaaacagacggctcaattttcctgccacacagagttagattctgatggggcttgaagttctaggtggcccttaggcaagttccctgagccccgaatggctctgggctctacaaggccccctccccgcatccctctcccccaccactgcaagccctgtctccttcctaccctagaaggacaccatggaaatgagtacaccaaacagggaacaattccagggaaacatgaggctctccgagatttacgacccaaagcttgagcagatcttaacagaaagggaagcgggttaaagaatgaaagtgaggtcaagtttttcagtttaatttacagctaacgtctcctatcctagcaaggagggcccccagccccagccctccctctttccccgacctcacccggcccccaggactgactgcaccatagcctcgcctgccttggaatcccttcatccctctctctttcatctgttcttgaaaatctatcaccaagatggtgaggaccacctccttcgaggacatggtgcccggccccattgcccaaagcctgggaaaccatcgttgccacgtgcagcttccacctacggccagagcgatcctgatgcgggtgatgatgtggtcttgggtactgagagccacttttcttcaaagagccgaagtgggaaattaatatgcccagggctcgatgagaacacaaaggggttgtgtcacataagccccaggaaaatgcttccatttctctagagagcttaaggctttccttttagtcacaatatcttagggcgttatcctgtcttctggggggtctgaaccaatcctcccctcataggagcctaaaggtccccagttattccgtaattcccaatagtgggaatcacccagcggcagcatcctgagaccatctgtgccaatcaacagtgtctagcgtgcaacagaggtttaaacactcgcacccgcagtagccaagatgtgcaaacaactgtccacagacagagggatggaggaaccaaatgtggtgtctacataaaacagaaacgtattcagtcctaagaaggaatgaagttcagacacatgcctcagcatggatagccttggaaacatcatgctgagtgaaagaagccacacaccaaaggccacatggtgtgccattgcacggatatgaactttctcgaagagaaaaattcctagagacagaaagtacaagggaggctactgggggctgggcaggggacagtggggagctggtgtttaatggggacagagtgtttgggatcatggaaagctctggacaggggcagtgatgcctgttacacaacactgtgagtgcaccaaataccactgaattgtacactagcgctggtaaccatggtgaattgtatatgtatattttaccacaatttataaaaaacattcacacaggaccgtccccccgaagccctccaagagtgggttctttctcaccgtagcagctttctcgcaatatcagtatcaaagtccacttgtaagcattccccgataagctgaacttggaaaaaggctacaattttaagccattccaaacattctcttagccggtggtttcagaagaacattcccattcatgaatagtgctacatcctgcaccgggctcgagttcaaagacttgcttcttgtaaaaaagatcattctcagtttccaaaatcaacatttcccgcctgagccttttagcacttgattagttggcaaaaccaatattagtttaaatgaaaggcagtctgcagagtggcgtaactcactgagctgccatgcccccacagggtgaccgaggtgacggggtacgagccgcaggacctgatcgagaagaccctataccatcacgtgcacggctgcgacgtgttccacctccgctacgcacaccacctccgtgagtagcacgcccaccccagccacgggaggtagctggtcagggaggaggcgctgaggacagagccgggggacgtgtcccttttgttggtgcaataatcatccatgatacacacttgaatctcaagccccaagtgtggcttcctccaccccgtgattaagtacggctgcctgttgtcggttctcaagcagccacgcgcaccctttcagggagactctagcaggtgtaggatcaggaagttgcctggattctagattgtggatgtggaacctaaactctgtgatctggacaccatttgcgaataacagcaacagtggaagactgctagttatggagctcttactgctgtcgggcactaagtttaagtgactaaatacattaccagcccagtgagggagggtctcactgtcatgatcctcattttaccagtgaggatgctgaggtccagataggttaagccgcttgcccaccttcatacagctggatggtagcggagttggaagctgaacccacgcagagccctgcctccgactgctataccccagccagctaggggaagcccagggaggccaccattccacgatgggagaggtcatcttgggacggggtgaacaaacaccaatttgatttgccaacggaggcggtttgggaacatcaggatatagaggcggatgctctagtcactgaaatgtttaaagaagtgacacttttcttttacttttttaaaatctaaaaaaaaaaatctttttgagacagagtcttgttctgttgcccaggctggagtgcagtggcatgaacttggctcactgcaacctccgcctcctgggttcaagcaattctcctgcttcagcctcccaagtagctgggattataggtgcatgccaccacgcctggctaatctttgtatttttagtagagacggggtttcaccatgttggccaggctgatctcgaactcctgacctcaggtgatccatttgtctccgcctcccaaagtgctgggattacaggcatgagccaccgcacccagccacacactttcagaatccaaatggaggcaaagactaatttggatggagtggaatgcctcatcctcctgctgtccagccctgccacgcccatggccagtcgggggtgctttataatggggtgcagacagttagaggagctgggtcttctgcagtgtggcccagatggcatgtcctctgttcttgctctgccttctgttggctcagggacgttagaggacaggttgccagtgtcgagtgggagggggacggcaggcccgcaggccgctaggtccacagatgcgtggtgtgctgggctccgtgtggactgggacccgggaactcgatactcccagggtgtcgctgttgctcttccctccccaaatctctatggacagaaacccgtgacaaccaggacttatggctgagcaggcacagacggcttcttccttgctccttgactcatgtggagacttggaggtgtgaacaacccttttgtgtcttttgttaaagaccaaatcatgatctcataaccatctctgtcattctggagaccaagcttggtagagaagcagctgcttagtgttcggatggaacttctccgtcggtgtcactaatatgggagctagaaagttttcttgagcaaactgggtatggtgtgtcaattctagaatcagatatccaggagacttgatcaggcgggtgtgaagagcagagtggaggggctctgcagtagcaagagcagttgggagacgggagaggcatttgcctcgagggcatagagctgtgctgtgccctagaacagtctgggacttggagagtgaaggtgagggctcatacctccacacgctccccctgccactgttggggcggaggggctgaccagctgttctaagggaaagccccagccctggggggtctggagcccccttccatggaggcaggagaatgctggggagtttaaagcatacccccgaattacagcaagagaagacttgctcttcacagcgggctgaaaggcaggaaattaggcctctaagcacagagacaaaactgagggaatcaaaaatctctttttttttaatgagatggagtctcgctctgttgcccaggctggagtgcagtggcatgatctcagctcactgcagcctctgcctcctgggttcaagcaattctcgtgtctcagcctcccaagtagctgggattacaggtgcccaccaccacgcctggctaatttttttagttttaatacagacagggttttgccatgttgagcaggctggtcttgaactcctgacctcaagtgggactacgggtgtgagccactgcacctagacaaaagtcttctttttaaataccatgtcttttatctcacactgcctggctaacccaggaagcagggatttttttttttttttttcagacagagtcttgctctgtcacccaagctggagtgcagtggtgcgatctcggctcactgcaagctcctcttcccgggttcatgccattgccctgcctcagcctcccaagtagctgggactacaggcgcccgccagcaagcctggctaattttttttgtatttttagtagagacggggtttcaccgtgttagccaggatggtctcaatctcctgacctcgtgatccgcccgcctcggcctcccatagtgctgggattacaggcgtgagccaccatgcccggcccgaagcagggatttttttccccatttgctttggaacagtcatgaagcccacagtggtgctcagtcagtgcctcctctgtgtccatcatgggtagatgctttcacttatagactctgacctgcgggcagtttggggagctgtgtccctctcgtgcccttttcccaggtgatcagggtgagactcaggggacacttgtccaagggcagcagtggagctggggcaggaccaaagtccagcccattggctgtcgtgctgtcagccgtcaccaccacaccacaccacaccacggggcttaaccttggagatgtgggctggtggctgttctgtaggatcccagccctcctgagcttgcctggctcaccagacccacaaggtgattttatttgaggggtcttctgtggtttatatgatgaagccactttatctcacaggaagtttccagatattgaagttgtccaaggggactctgaaagggcaagcaggcacaggctcaaaaaggtaggcgtgtttagaaattagacggggcatggctttcttttccaaatgagccagaattggtaattcaaagaaaacagaaaatagcaagattgacagtgattgctactgtcctgtgactctgaccttagctgtgctagagaaacaaccagaaaagactgcaccccagccaggccggtgggttggtgtggtcttggagttcaccatgagtgtgcctgcctcagtttcccctggcagctttgagagggaggggaagcaaggatagtctcagatgatggggagttctttggttccagcgtgggaaccacctgcagggctgagcagcagcctcccctcagagcactcaactggaatgtcacacgcctctccaaagctagaactctctgggaagacagtcaactcccaagcagggtcttcagagtcggggtcttcatggtatggagctttgtgattgtggaggcctcactctccttcccaggtacagaacctgggccagaggggccaaccccaggcctcctgttcctgcctctccatccccagggctgggtggcacctgtttgatttcctgaaactccagaagctgccccagagcctggagttgaagtgcaatggttgatttggacagtgactagacatggccaggggaggagtgagccagagaagagaaggagccacaaagggtgttgtccactggctacagccgagggaggctggcgctcaacgccggggataccccagagccagtgtcatcaagcagaggggagagtgagctgaggtattgatacccctgtgcctgtcagtcagtagctggagggcagctctcagggggccttgattgcctggcttacccccaacatggtcagggtgggccctgccaaagaaaggcctcagtgggggagaacaggtcaggccagtggatgtggctgggccagagcaaggctgatgtcttcacagcctgtcgtcagcttcctccctgctgggccttcatccaggctgtgttaagatgttttctgttctaaccttccacaagtttctcccttccgagccctgtctgtcatctttcccttgtccacagaggccacgcctctctctgggggtccctgttggctgacaggagcgtccttacacccacaccactgctgtgtgagggctgagggaagcccatcccccacactctccagctctgtctccactcctggctttgtaccaatagctgctgctctcctcttggggacatgtgccccactgctgcttggccccacagagtcccaaccaagggacctcaggtctggacgatgcttttgtcttgtggtgtttgggtcctgatggggacttggggactgtcttagtgtcccaggcacaattcagccctcaactaggtcattccttaatatgtccgtatcctcactcaagttgtggggagaggcccttcccatattatagctgcagaggccgacttggggaggacaggggagaagctgagaaggtgggaggccccattttgaaatgggacttgttagtcctgtcacacagtgctttggtggctgacagcccggctcagggcctggcttgagggaagggcagtgaggccagacttcctattcagcctcctgccctcccaggttccaccagggtccccactgtggccactgcagacctgagactcaagtctttcaactccatcagctagagctggccccgtggctgcccgagggatgcggggacacaggcagcctgccagcttcccttccatctgccacaaccgagtgtagctggaggtagccagcagtgacagcaacccccgcccgggcccctcaggactcctcacagtgagatgcccagacgcatctgtcgtgggcagtgggtgaggtcaccgagagcaggaacaaagcagacagctgccaacagccaggacccgagtgaggtcactgtcccctcttctggggcctcgctttccccacaccggtagccaaaagccaggaacctctggggtcagtgccaagggctctgcagaggcctgattggaggtaagaggtggtggtccgggagggccagacagcccgatggtttgcacacgttcttcagaatattatcttcactgggagcaagagtccacaggggctgaagaaatcgcagcccctaaagagaaagaactcccagcctccagaaacttgagctttgtgaggaagagcagggccagcagcacaggctttggggagcacaggtttgcagaggtcaggcgagggggcacctcggaccagagaagggggcatgcgggcgtcatgtcggtgtggtctgggtgtcaccaggtgagtctgtgaagtcagagctgtgccacaatattccccagaactaacttccttcccttccttccctccttcccttccctttcctttcctccctccctccctttcttctttctttcttttccttctttctttttctttctgtctttcctccctccctccctttcttctttctttctctttcttttctttctttctttttctttctttctttcttccttccttttctttttctttctttttctttcgttctttctctctctttcttcatttttattttttagagacagggtctcactctgtcacccagtctggaatacagtagcgtggtcggagctcactctaaccttgaacttctggcctgaagtgatcctcctgcctcagcctcctgagtagctgggactacaggcatgtaccaccatacccagcgaatttttaaatgtttttggtaaagatggggtcttgctatgttgcccaggctgggcttaagctcctgtgttcaagtgatcctcccatcttgacctcccaaagtgttgggattacaggcatgagccaccatacccggccccagaacattctgtaaagaaaagtgaacacgggatcatcataaatggaaccactgtgaccctcccaccccacgcctcacccaccacctgaggtggctgattaaaggcaccatgctccagcctggcctcaggaaagccgagctctgcctccccgctttctttgtttcatgtttgggagactttttcttgtatgtagggggagctggcaaaggcttgtgatctgttgacccagaccctcagggggggctgagcacagcctggtccataggtggagaagggatcagtgtcagtaaacctgacagtttgtgtcatgggacactgggctgtccatggtttggaagaaccgtgatgtccacatggctattcttccaaggttgttgagaatttcacccggctctctaggtaggctcctgcccagaatgggccaagcccagaccacaaagagaacacaggccatgtgcagctattaaaacatttcaatgtccactttgggaggccaaggcgggcgggtcacttggggtcaggagtttgagaccagcctggccaacatggtgaaaccccgtctctactaaacaatacaaaacttagccgggcgtggtggcattcgcctgtaatcccagctattcaggagtctgaggcagggagaatctcttgaacccaggagacggaggttgcagtgagccgagattgtaccactgcactccagcctgggcaaaagagcaagaccctgtctcaaaaaaaaaaaaaaaaaaaaagcaaaaaaaaagcaaaaagaaaaaagcatggggccatattcctaagggcttgaatagattttgaggttgaagagcttagcgagcactagtcctcttgaaatccgtggatggatcctcagtctgagcctgctgcatctcttggttattttggaccataaacaaattggccaagtctcccttaaaaggtgagcccacctcacccccatacgtattattcaatgtattactttgaaagtaatagcagccagatgcggtggctcacgcctgtaatcccagaactttgggaggccaaggcaggcagatcatgaggtcaggagttagagaccagcctggccaacatagtgaaaccccgtctctactaaactacaaaaaattagccgggtgtggtcgtgggtgcctgtaatcccagctactcgggaggctgaggcaggagaatcacttgaacctgggaggcggaggttgcagtgagctgagctcatgccactgcactccagcctgggtggcaaagccaagactccgtctccaaaaaaaaagtaatggcaaaaatcgcaagtacttctataccaacctaatagctatagagaactttccagaggccgctgctccctcctcccacagctgccactttgaggacacctgggctggactccagctgtgccctcaagctctgttggccccggtttcctggtgctgcccacctcccacctcccactgttgtagtgggggtagaatgaggcaatcctgtgaaatgagctggaagtagacaccatgtatcttttcattagagaagcaaacccccaaaggagaagcattgtcaggcttctctctttgccatggcctttgcctatacccttgagcagtgatctgagtcggctgagatgcagatgttaagcctgggcagaaaagcgctgctctctgcatggtccgggagagacccctctccagccggtggcatgctcgttacgcaacactgcctcatgtccccaggttcatcctgacggggtggtggggcttgatggagactggattcctgcctcccaacccccacaatcttctctcccatgtaaaaaacaaaaccatttcattctggttaaacctcctcctcgttggaaatttagaaagtcaaggaaagctgaaaagaagaaagtgaaaattatctgtcattttcagtcagataaaagttaatatgtattgagcccttcagctgtgtctgccagtgttctaaatcctcaaatagatcatctaatctttcaacaaccatatgaagtaaggactgattatcctttttttataaatgaggaaattgagtcacaggggggttggtagctagtctaggatcacacagtttgttggagggggtagtgtatgcacgtgcccactttttcataattagggttatactttacacatttctgaatcttgtcttttcttctgttaacattgtatcacacatttcccataatataacaatttcttattaatcatcattttaatggctgcatagtttgccataatgtatttactcttttccctaccgttgaagagttaagtctctccccaccccttttccctgaattttcagcaatattgcaatgaaaccctttgtaggtaagtctgtgtttgcacacacagacctgctcacaatttccataggatcaattcctagaagtgagatcagtgtgtcagagggtgtgagctatcagactgctttccaccaactcatccttccatcacacatgaaaatgcctctcactgggccaggcgccgtggctcacacctgcaatggctgcatagtttgccataatggcaaactatgggagggcaaggtaggcggaccacttgaggtcaggagtttgagaccagcctggccaacctggcaaaactggggaggctgaggcaggagaattgcttgaacccaggaggcaggtttcagtgagatcatgccactgcactccagcctgagcaacacagagagactctgtctcaaaaaaaaaaaaagagaaagaagagaagaaagaaagaaagagagaaagaaagaaagaaagaaagaaagaaagaaagaaagaaagaaagaaagagaaaatgccactcaccatagattagccggtgtcacctgttggcctttcatttttttttttttttagataaaattcacctttctcaccattttcagtgttttttagttatattcacagtgttgaacaactatcacctttaattccagaacgttttcatcatcccaaaaggagcctgtcaccccagtccccctcgtgcttcagcccctggcacccactcatttgtttttggactctgtggatgtgcctattctggaagtttcatgtaaagggaatcatacaatgtttgtttctattttaatgtctgttgatctgatggatggatctgcctttgagttaaacaagggagttgggcatttgttcatcattttgcccattatatttattctttgatctttgcctatattgcttttagggtctttgtgtttttatcaatctgtacgaaccccctatatattaaggtgaataactccgtgcagcattttcttttgcaccaaaatattttgatgtggatgagaaagagccatctgcaaggtgaaaaggaaccgtaaagggccacagacagcccaggagtgtttgggcagagactgggggctttgcccagcggtatgacaggaaggctgaatttttgttgcatatgagcctcaaaggctgaatttttgttggaaatgcaccttggggagtttccttcagccccagctggtacagtcacagactcagcccctttggccacctccccagatctctgctcaggcagctgctagttaggtccaggggccagtcctgccttgagaagcaggaatgttctggagctgaggacccagacatccaagggtgtctttctagacttgtgctatcctcctcttccctggagaagcttcacctctccactgcccacctgcgggttctggcactttcctcccccacctgcctcctggaaggcggtgaggtggaattgtggtttatgggtgcaccgagcctttggctgagctgcttagcggcctggagtttgcacccaagcatagaagacaggcccataggcccaattttcaggaactctgcagccaagtagaggtctttcctacataaacaacatagcaaattaatgggcccaaggaaaactgggattaatgggaagaaaatataaatggcaacaaacagtttcactgtgaataccctcatgttcctgaacagcaaacatcagcaacagcttgacacttggttgaatgcacttaactgactactttgtgtaaataactacatcactcaccccccctccccattaaggatttggggattaaaacataattgtggcattttgaaaactaaaaagcagattgaattttttcattctgccagatacaaactttggtggctaatgtttccctcaatgaaagcaatgactgttaaataagagttcttaatgggtgggaactccttgaagctgaaggcaaaattcctgtgtgcacatgtatatgcacgcgtgtgtgtgtgtgcacgcacgagacgcacacagacatgcaccctccagcggagaaagcccgccccctttgtcaagttctcagaggtgtccttgggacagaggtcaccgttgggggcagcatcccagaggtggggcctgcgaagcgtctgaggactcctgtcaccttgtgcttgcagtgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacgtaagtcacacgtatttgtttctctccttgctcttttctcttccctgtcccacatcggatggctccaataagcaccatctctctttctctctttctcaaactgttcatttgtcttctgttttttttcttttttttaattttttttttttaggaatctggtcattttggaaggtgcaaactatttctatgctcagcggtgaaagccaagtgctaggctgcagggggagccaggaggagggggcctgccctgggcatagcttcggatcccatcacagaacctagtgaggagcatgggggcggatggtgatgccccccatcctgaatagggtgcaaagagggtgcacaccccccatcaagaatataaacttgtgctatccatgcctataagcctttaggtcatcttagatgctcctgctgtttgagacaggaaatatcccattttttacctgtcttcttatagagcctgttacaaattaatcatggtgaatatttggtcctttaaacactccagaaggtcaagttcagtcgcaaatgcctttttttttttgtaaattaaaaaaaaatatgtttttgtagagacggggttttgctatgttgcccaggagctggtctcgaactcctggcttcaagtgatcctcccacctcggcctcccaaagtgctggaattacaggcatgagccacggtgcccagcctgcaaatacttttaaggccattagaagcaataggacagatgtctatctggggccatatattactttccacccaccatagctattgtacgttcaatcaccttgctccaggctgtgacccttgccatgccgccagccccatgatgaaaagagttctcgtttgcactttacatggggtgaggatttaggctctaggtttgttcatagaatgactgtgtcttagaagtcaagtgattctgacaaaactgtcagggagaaaacagtttagccctttagttattcttcctgagcaaatgtgtgggctggttctccaggtcgacctctccttgtgtgaacatgaccctgctgagttggttctttagggcagagatgggcccccgatgtgagaatgcacaaagctggtggtcaggctcccagacctgtgaagagtcccggactcttgcctcctggggtgctaactggagaggcagctgggccacaggtgtgcatgttggatgcaggtggacctgatcaatggtatttctgcctgtctctttttcccttggtggctttcctcatggcccacgacctccccgagcaatgtgtttggggttttattggactggagagagctctgacctggctcagcatttcctggggtggcccagcctggggctgcagatggcttttataatgagggtgagctggccttgtctcaaatcccatccacatccaatcccagtgaaaagacacactggagcactgagaacgccctgcccaagggctggggccagggaagctgctcggcctccagcgcctgctggacatgactcggcccactctcgccttccagggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacaggtaacacgcatgtcctgcagttttggggtgctgacatctatcctaggggttcgggacacctggacacattaaggaatggggagcctctcattgcacagcagggatctccctgccgtggagcaaggtccctctgggatgtcttgcctacacagtagtgacagcccggggaaggccgacatcccggtgggctagtcaagtttaggaaacagaagactaaattggaaaggcacttcagcccactagaatccatgggttagattctaatgggcttgacgggttggaatccacgggttagattctagactggtgggttagaataccagtccattgtatttctgcagcattttaaaaatgaaagccctccctctttttaaaaaagtagtttgtgagctctcagaaatagcaattgtcggttgggcgtggtggcccatgcctgtaataccagcactttgggaggccgaggcaggtggatcacctgaggtcaggagtttgagtccagcctggccaacatggtgatactccatctctattaaaaatacaaaacttcgcgcctgtagtcccagctactcaggaggctgagacagggaaatcgcttgaacccgggaggtggaggttgcagtgagctgagacagtgccactgcactccagcctgggtgacagagcaagactccatcacttgttctgtgccaagtgaactttggtaatgtggtcattagcagatagaccagttgaacgtcacggcctccacattatgacaaaaaaaaaaaaaaaaagaaagaaggaaaagaaaggaagggagggagggagggaaggaaagacggaaggaaggaaggaagggaaggaaggaagaaaagaaaaaagaaataaagaaagaaagaaaaacaaagaaagaaagagaaagaaggaaaaagagaaagaaagaaagaaagaaagagtccatgtgtgcctgatgtcttgttagcttggggtgggggatctctttccaccctgggagcaggtcactggggtatcgctcgctgtgtgcctgtccccagtgggaccttgcagtggtggcgagggtaggggcagcccttggatggggttgggccccgtcgggacggttcttgcagggccggaaggcagcttcctgccggcccctcgctggcccttcatccatcttctttgccatgcagcaatacagctcgttccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattacggacacttccctctggactctcacgtcttcagcagcaaaaagccaatgttgccggccaagttcgggcagccccaaggatccccttgtgaggtggcacgctttttcctgagcacactgccagccagcggtgaatgccagtggcattatgccaaccccctagtgcctagcagctcgtctccagctaaaaatcctccagagccaccggcgaacactgctaggcacagcctggtgccaagctacgaaggtgggtcaggtctgctcgtggggaaggtgggaggactgcgcacggccgggagccgaagcagccatggcggtgggtggcagatggagacagaaccctcacgctttgggcaaacttgccctctttctgcttctaagtagggcttgctgtgctttcttgctctcaatgcaggtgctcctcgagagtgagaaatggcagtctgcctgcctcggggacactagtgacagtataaagggcaaaggaaaaccgagtatctggccttcacgtaaatcctggccacattcaccaaccaaagggggacagtgattttcaaaaccagctcccatgtgctgagaacaccccagctgcatttcttttgcaagattcctttccactccaaccagaagtgaatatttgagacaaacggcctattggctattttcccatgccagttttggaagtggggaaaactatggtggaaatttgtgggcttggggacagaaatgccactcaccaacccagggcaaagaacacaaaccctccaggcctcagtttcttcacctgtaaaatggggtgaagctgtgatgtgcctactcccaaggacacgacacacagtagggacctgccctgtacatgctagttcaacagaaaggaatggcctttcaccttctcctggtggcaggcaagcagatgtcctctgcggagataccgccagctccccaggacgcagactgactcctgtttgctcgctggaccaaccccaggcagaaggtggaaggtgggaacagaggtttagctgcaggacatgtattcccattgcaccgagacctaactgccgctcagagtgtagaccgagatggtgcagatgcctgcagtgccactaaaatgtgggtgaaggtgacatcaggattatgtgccccaggccgggctcagtggctcacacctgtaatcccagcactttgggaggccaaggtgggcggatcacctgaggtcaggagtttgcgacaagcctgccaacaagctgaaaccccatctccactaaaaatacaaaaattagttgggcatggtggtgagcacctgtaatcccagctactctggaggctgagataggaggatcacttgaacccgggaggtggaggttgcagtgagctaagatcacatcactgcactccagcctgggtaacagagtgagactgtctcaaaaaaaaaaaagaaaaagaaaaaggatgatgtgcctcagaaaagcagcacaccagcccctgcttaagaagacagctcttggaagttcctccacgcctctctcgaggcaggtagggctctgctccttctgggcctcatcctgctttttctgcaaatcctaggaatctcttgctctgtattgtgacttgaggctgagataacatttcttcccaaatctgagaagagagatagattacgggagaatgccgcctttctggaaatcactaggacatgttttttcagaagtagctaacttagaaaagaccacattggtgaccagggccaggacccctgccttttgacctggcctgtcccaggagccacggatcccttagatttgcatctgccatacccgtgaacatcttgggcccctcatataaccaaggaagggatctccagaacatccaagcaaaggaagacaaagcaaagggttttgataacagctgaaagtattacccacttgagattgacttgaatttgtgtgtcggaagctggctaatgctgtcacatggtatttgacttttaccactattttaaaagtgaaagaggttaacaatctccttatcacacacttgataaaaagtggaccaaaggtgctaatttgaggcaatttgcgatcagcttcctagtctttttggtattaaaggaagacaaattttgccatatagtgtttaaaaacaaacaaacaaacaaagacaaaaaaaacccacaagccagggagctacttaatgtcaggcatcggactgagtagatgggagtggttatttttcattatgacacggcgaaaccgatcggggtggttaccacccctctccactaagggacgggcagaagaaatcagagcagacgggggccctccaacaccagggcccctggtggcctctagacctctgccgtccaatcaggtagccaccaaccccgtgtggtcttgaacatggaaatgtggccagtgcagtgaggcaggtgtgacctgcgctctgcatctcaggaccaaaaaaaaaaaaaagaaaatatcccaataattgtttcacacggattccattgagagagtattttggatatgctgcattaacgtgtattacttaacaggcattccacctgtttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttgggggtggggtggctgcggccgcgccccttgctgccctctaacgtgtcgcctgtccccgcagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccaccgcggaggccccgcgcgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtcccgctgggggattgaagcggtttcactccgcaaatatcctccactttcaggagggaaaacccaccctaccacagtccgctcttccaagtggacggcagacctgggaggggacgcctgtgtcacgagcccttttagatgcttaggtgaaggcagaagtgatgattgtaagtcccatgaatacacaactccactgtctttaaaagtcattcaagagtctcattatttttgtttttatttaaccctttcttcaatacaaaaagccaacaaaccaagactaagggggtgaccatgcaattccattttgtgtctgtgaacataggtgtgcttcccaaatacattaacaagctcttacttccccctaacccctatgaactcttgataacaccaagagtagcaccttcagaatatattgaataggcattaaatgcaaaaatatatatgtagccagacagtttatgagaatgaccctgtcaagcttcattattacgtggcaaaatccctctggcccacacagatctgtaattcactaggctcgtgtttgctacaaatagtgctaataaagttaaattgcacgtgcaatacggaacactgtcaatggactgcaccttgtgaaggaaaaacatgcttaagggggtgtaatgaaaatgatgtagacattttaagcattttctacacagcgagaaaacttcgtaagaacatgttacgtgtgcaacaggtaaacagaaatcctttcataaagcaccagcagtgtttaaaaaatgagcttccattaatttttactttttatgggttttgcttaaagatctcaacatggaaaaatcctgtcatggctctgaactgcacaatgcattgaaccgccgtccttcaattttcttcacactatcaacactgcagcattttgctgctttatcaaaatggtttattttaggaaactttttccacctttctgaatggaaagaggttttcacaaatgttttaaactcatcgttctaaaatcaagtgcacctacaccaactgctctcaaaatgtgaactgacttttttttttttttttttgccaaccctgtgtcacttagtgaggacctgacacaatccctacagggtgtctgtcagtgggcctcatggtaagagtcacaatttgcaaatttaggaccgtgggtcatgcagcgaaggggctggatggtaggaagggatgtgcccgcctctccacgcactcagctatacctcattcacagctccttgtgagtgtgtgcacaggaaataagccgagggtattatttttttatgttcatgagtcttgtaattaaaccgtgattcttgaaaggtgtaggtttgattactaggagataccaccgacatttttcaataaagtactgcaaaatgcttttgtgtctaccttgttattaacttttggggctgtatttagtaaaaataaatcaaggctatcggagcagttcaataacaaaggttactgttgagaaaaaagaccctatcatagatttacaag

SEQ ID NO: 36874 - DNA, 56780 bp, Homo sapiens
gtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggtaatcatctggggtggggttcacgataacgctgcgcttttactcattccccccaccaccaccgtgcacccccaaagtgctcgggcctctcctcatcgcacgcactcgccagggagtccagggagctagttttcctggcttacgaacctcgtccgctgtctccctaaaagggtcaagaacccgatagaaaggttgggggaactagtttcccaccttgttaaacacgtcccataaatgtcccttagtcgagctttttttttttttaaccgtcttttaaggtggaaacggcaaaatcctctttcagtgattcccatgtttttttttttttaattcttaattctactgggcctcttgttccaattagaacagtttccgatcgcctagttccttaaaaacctctcactacgttcagaggttgcctcttttttctggatgaatcattttcctgcactttagaggacgtacggatttcgtcactaccccctgaagaggcctttgaggctggttgcctcgttttataattaccgagagctttctctttccagcttttcacttcttcttgtagtcgcgacttggagttttgctaatgtctccctcctttcctaagtgacattgaatccgtagggatgttgatgccatcatcccctctttcccctgcaggaagtggcagtgaagctagaatctcagaaggccaggcatccccagttgctgtacgagagcaagctctataagattcttcaaggtggggttggcatcccccacatacggtaagaacccggtgcatataggcgatccgctgagggaagcacggaatggggaagtgggtagaggcaggtaatgagaccagctgaatccgggtcttggtgttttagttacctgggttccctatagctggtggtttcctgtaagtcagtcatctcaattactgagtaaatttcagtttgccaacttatttcattgtattacactgctccatttcgcttccgtcattctcactcttcccgaggctttcatttgcagttatgcgtgcaggtcatctttgatccctacgcggaagggttggctgctgccttttttacggcggcacttctgatgtacttaggtttgtccagtgaagtggatttgaaggtgccgaagcgacccggcagtgtcagttcgagttgctattggagctggcttgggaaatggctgctcttttgttgtgtttttgttccaacatgtcttcctcctccgcttagaaaatggcggaacgacgtgactcaaccccatattcctgcccttttctcagcttgagttcacaaattatgcttccttgattcctcctttagcagccccgagtggattaaacctttgaaaagccaagaataaagctgcaggaggcggtgtggaggttcgaggaaggagatggcatagtgacagtgtttgtgatctctgcagcagatgtgacacgaaattgttgaattacactatgtaaaatccttcgtagttcttttaaaagtgttaattactctttcttttcgtgaatggtcatatttggcacgtttcagtcgggactaaatttgtataggtagtggcaaaggcagtttgagcagcaccaactatgttaaaatttactcatatcagttgtatttaaaaaaatcttaatcacttagccacactttgataagtaattttaacctgttgagtttgtcagtaaatcttcacatcagagaaattggggcctttgttggtgtggaatattggtgagtgcaaatagcagtaacgaggataaaagatgacgagatagacattgttctgtcaaatggttaactttactttggagggttttaatgttttaacttttgggattaaagatcctcttcatggaatggagactaaaatatagtttaaagcccagctattttccagcaataatctaaaataacatttgcaaaattattcagaataggtaagaatggtacttactgtttactggagcctcttctttaagacggagttttcgctcttgtggtccaggctggagtgcaatgaatggcacgatcttggctcactgcaacctctgcctcccgggttcaagtgattctcgtgcctcagcctcctgagtagctgggattacaggcgcccgccaccacgcctagctaatttttgtattttagtttcaccacgttggccaggctgggctcgaactcctgacctcaggtgatctgcctgcctcggcctcccaaagtgctgggattacaggcatgagccactgtgcccggcttttttttcttttgaaacggagccttactctgttgcccaggctagagtgcagtggcgcaaccttggctaactgcagcctccgcctcccaggttcaagtgatcctcctgcctcagcctcccaagtagctggaattgcagagctgcactactacgcctggctaatttttgtatttttagtagagctgaggttttgccgtgttggccaggctggtctccacctcctgacctcaggtgatccacctgcctcagcctcccaaagtgctgggattataggcgtgagccaccgggcccagcctgttagcccctttttctattccagtttgtatttttcatgtcttgaattaaggactgggttgcatagtctttacatggaaacaactcaaataaaactgtccttaaaaagagttccagccaggcgtggtggctcacgcctgtaatccaagcactttgggaggccaaggcaggcaggttactttaagtcaggagttcaacaccagcctggccaacgtggtgaaacctcgtctctactaaaaatacaaaaattagctgagcatggtggcacgtgcctgtaatcccagctactcgggaggctgaagcaggagaatagcttgaacccgggagtcggaggttgcagtaagctgagatggcgccactgcactccagcctggtgacagagcgagacgccatctcaaaaaaacacaaaaaaacacaacaaaaaaaaaaacaaagttccaatgctgatttacagttttaatggagaattgagtgataaaatgtgctattggttgtaaatgagcaagtaaatcatttggaagaaagttgcaaatttatcttatgaggtgaagattaaatctgagatgatatagatttgaagtttttaaatcattcttgcctttaaaaaaaaaacctactatgtgggaaaataaggcccctcacccctgatttgctttccattactatagtttttcctagaatttcatataaatggaatcatacgatatgaggtcatttgtgtctggcacttttcacttaacataatgtttttgagattcatctatgttgggagattttataaatttcacaaatcaggttaaatttaatgtatttgaaatcagtttcaaaaagcattaagcattgtcatttttcagtgctaaacccaagtacagtacatgtccttttatctggtagcttttatttaagacctgatacagacccataagggcaatgagtaatgtactgaataagcacatgaataaattaacttctgagcagaattatagtaataggtgcctattataaggtggtgagtgcagagagagttatggtagttataagctgtctgtgggtgaggctaaacagattaacctgactttcaagttaaggcttcctgagagatgggatttcaggatctggctctaaggaagaaagcttggtgaactggtttggtaaggcatccaagaatagagtgtggcttctgggtgtagtctctaaaggagaacacagtaattggatgagagtgtggaaagggtaaatttgctttaggagtggtagggtcaggtacatggaaacaaaagtggttcattggttttaaagtgaaatgtaaaaaaaaaactgtttccactgaagcaaaaaggataaagatttatgtaaacattctttatttgggtagcagcatcttcccatccccctcagtttgttccccactatttctgtatcacctatacatggtacatacttaataaatatttactcggaaagtattgaattaagttgactatttagtgttagctagataaaagttatgtgttatctattgttttagaagtattgtcactaatttaaaaaatttagattttgctgcctttatccttcatatacaaatttgttcaatcccttccctatgttttctgttacaaaattccctataggatttgctttttttttttttgacatggagtctcactctgttaccaggctggagtgcagtggtacagtcttggctcactgcagcctccacctcctgggttcaagcaattctcctgccttagcctcctgagtagctgggactacaggcacgtgctgccacgcccagctaatttttgtatttttaatagagatggggctttaccattttggccaggatggtctccatctcttgacctcgtgatctgctcgcctcggcctctcaaagtgcttggattacaggcatgagccaccgcacccagccaggattttctttaagatactttggtatatcttacaacagagactgaaaattacctggcctgcgtagatgacctgctgaatcaggtccttcctgtgtaatttgagagacctattgttaagaagcatagcatcctgagtaaagagcaaggataagccgggcgccatggctcacgcctgtaatcccagcactttgggaggccgaggtgggcagattgcctgagcccaggagttggagaccagcctgggtagtagagacaggtgaaaccctgtctctactaaaatacaaaaaaaaaaaaaattagcctggtgtggtggcgtgcgcctgtagtgccagctactcaggaggctgaggcaggagaattgcttgaacatgggaggcggaggttgcagtgagccaagatcgtgccactgcactccagcctgggcgacagaatgaggctccgtatcaaaaaaaaaaaagcaaggataagagaatggcatccattttcttgatattttaagaaatgaagcttccggttctaggcacttggagagccgcggcttaaggtacagacatggccaagtccacgaaccacaccacacacaaccagtcctgaaaatggcacagaaatggtgggctccaggttcctgaggaacatgcactttgccaagaagcacaagaagggcctaaagaagatgcaggccaacaatgccaaggcaatgagtgcacttgctgaggctagcagggccctcgtaaagcccaaggaggttaagcccaagatcccaaagggtgtcagctgcgaactcgattgacttgcctacattgtccaccccaagcttgggaagtgtgcttgtgtccgcattgccaaggggctcagactgtgtgggccaaaggccaaggatcaaccaaggcccaggctgcagctccagcttcagttccagctcaggctcctcccaaaggctctcaggcccctacaaaggcttcggagtaggtatctctgtctgccaacgtgaggacagaaggactgatgcaacccccctgggctgccgtctttatggggctggggtcctcctgtgctattagtacaaataaacctgaggcaggggaaaaaaaaagaaagaaaattcttggaccttgtcaattaatatgtgagagctcacttaaaattacagttgacccttgaacagtgctggggttaggggcactgaaccccagcccactcccactgtgccccacagtcaggaatccaagtgtaactttttttttttttttgagatggagtcttgctctgtcacccaggctggagtgcaatggtgtgatcttggctcactgcaacctctgcctcccaggttcatgggattacaggcgcgccgccacacccagctaatttttgtatttttagtagagacggggtttcacagtgatggccaggctagtctcaaactcctgacctcagatgatccacccacctcggcccgccaaagtgctgggattacaggcatggaccactgcacctggccccaagtataacttgactccccaaaagcttaactactactagcctactgttcactggaagcttcaccaataacatgattggtcaataactatatatatatatatatatatatatataaagctctttaccctcatcatcctcactttgggctgaggaggaagaagaggggttgatcttgtttgggtagcagaggcagaaaaaaacctgtgtacaagtggacctgtgcatttcaagccccttttgttcaagggtcagctgtattgagtttctgttaaaacctttttttgtgtgttccattctaaattgaattaagttctccaaaggaacaatttaaaaatttttttaaattttttttatatagatgggctcttgctatattgcccagactggtcttgcattcctgagctcaagtacttctcctgcctcagcctcccaaagcgctgggattataggcatcagccaccgtgcaatgacccaagaaacaactatgacataccgaaaaattctttatctagataggttttggaggtttgagctgtagatctgccatgtgatattgactgggtcatctacagtcagtcagttccttaatgtgtgtaagcccatctgtttcctcatttagaacataaaaaaaggattgttctaatgggaaggagagtgctgaatagaaagatttagggctgcctacccttcttttgccagctaaatactcatttccatttgcctttgcatactgagcttttgggtagggttttgtttgaacaagggttccctacttaaaagtgtcactggcctcattgatcctaaggacttttagtcctggaattttaagacctattttcaaaggatagtagctagaaaaaaagcattccagcagtttgatattgtgtctactacttgccttcctttcttgtttttcctatttttctttcatcttttattatttttatttttagcggcaggttcttgctctgtcacccgggcggagtgcagtggctattcagaagtatgataatagcacactacagcctcaaactcctggactcaaatgatcctcctgcctcttagcctcctgagtagctaggactgcagatgaataccacctctcccagctgcctagtgtgttttaatcactatttttgccctctgtgtctgaaggtcaaatgttttagaacgtatttataaagcactagttaatccttactcttcacttttaaaagcagcttaatcttatctttggcactgagcatatatcctgtgaataacataatggctgttatcagagaataaagatgacgctgcattggatatgtcttcattaagatatattacagtgtccatgcttagcttggactaaaaaaaaaaaaccagaaaaacgtacgtcacagatcacgagaaatgtgctttttaacttgaagggaaactgaattcatggtatactagagctgctttatactggcttatgagataatgtaataatgctaggtagcattttaagctggacaaaatgttagagatgtatatagccctattcctactaatacaaattagactgttgaatctcaggggagttactggagtgtcctaacttccagttcttctgagaatcattatcacccttatgtcaaggtcaaatcatgccctctcacacactccacatcgtttcatttgatactggagagccatcctgtacttcttcacttgttggcattttgcctcatagacaagctgaagagctcttacataaatataagtaacctatttgtatttaattagatgcttacgattcagggtgttcttattctcccttttgaatctgtggattgcaggataaaaacttgctggaaattattaatttgtggccaggcgcagtggttcacacctgtaatcccagcactttgggaggccaagacgggcggatcacctgaggtcaggagttcgaaaccaggctggccaacatggtgaaaccccatctctactgaaatacaaaaattagccaagcatggtggtgtgtgcctgtagtcccagctacttgggaggctgagtcaggagaattgcttgagcccgggaggcagaggttgcagtgagctgagatcatgccactgcactccagcctgggtgacagagcgagcctctgtctcaaaaaaaaaaaaaaaaaaaaatatatatatatatatatatacatatatatatatatatatatatatatatatacatatatatatatatatatatatatatatatatatatatatatatataaatttgtatctcatttcggagtaaatgcttgaacccatgtaaagtatgtgggttattccttggctttagtcagtggtccccagcctttttggcaccagggacaggtttcgtggaagacagtttttccacagactggagcaagtagggggtggggtgggggtgggaatgattttgagatgattcaagtgcattacatttattgtgcactttatttctattattattacattgtaacatataatgaaataattatacaactcaccttgatgtagaatcaatgggagccctgggcttgctttcctgcaactacctgcttccatctgggggtcatgggagacagtaacagatcgtcaggcattagattctcataaggaatgcacaacctagatccctctgatgtgcagttcacagcagggtttgcgttcctatgagaatctaattctgttgatctgacaggaggctgagctcaggcggtaatgccagctttggggagtggctgtaaatacagatgaagcttcacttcgcttctatactggataccggtcagtggcccagggatcaaggatccttggctttagtcatttctggacctagatctttttttttttttttttttttttttgagatgcagtctttctctgttgcccaggctgggatgcaatggcgtgatcttgactcactgcaacctccacttcccaggttcaagtgattctcctgcctcagcctcctgagtagctaggactacaggcatataccaccatgcctggctaattttttttagtagagatgaggtttcaccatattggtcaggctggtctcgaactcctgacctcaagtgatccacctgcctcggcctcccaaagtgctgggattacaggcgtgagccaccgcacctggctagatcattttgttttaaagtatatttaagctgtacctaaaatatcattaagtcttggttttctcatgatctgtcactgttcaccagggatttttgctgtcaagaatgagtgtcttcataactttcatcatttaacttggtgttcagtgtatgcacacaggtaaaatgatgctttattgtgttactgtttttgtttctaatttcaatctcagatggctcttaaaattttggttgactggccgggtgtggtagctcatgccacacctgtaatcccagcactttgggaggccaaggcgggcggatcacttgaaatcaggagtttgacaccagcctggccaacatggtgaaatcctgtctctactaaaaatacaaaaattagctggccatggtggcaggtgcctgcaatcccagctactcgggaggctgagacaggagaattgcttgatcccaggagacggaggttgcagtgagctgagatcacgccactgcactctggcctgggtgacagatggagactccatctcaaaaaaaaaaaacaaaattggttgaccagtattaacatagcataaactaatgcatgttttagtgggatttttatttttaattttattttttgagatgcagtcttgctctgttgcccaggccagagtgcagtggcgcaatcttggctcactgcaacctccgcctcctgggttcaagtgattctccttgctcagcctctggagtagctgggactacaggtgcccgccaccatacccggctaattttttttgtatttttgtagaaatggggtttcaccgtattggccaggctggtcttggactcctgactttgtgatccgcccatctcgacctcccaaagtgctgggattacaggtgtgagccaccataccctgccggatcagttttgacaaatgcatatgttggtgtaacctacatctctgttgagataaggactatttgattttttttttgtatgcacacattgctcatccttggtaagttctattctgtgacagtgttagttttattttatttatttattttttaagtctgtcttttggattacagctaagccttatttttctccccagtccccagttaagcattattttggtgttggttttactatagattaatagtctgtttatcaccatgaggtacattataggatttatctgacaaaattatcagatggtggttgtgttgcaggtgatggtagtaaatatggtattcagtgataattgagatctttaccttgctctcctttgaagaactaaaatactgcctttttcttgtcggtgtgagcagtggggtatgttatggccctttaatggggattttggaagtgctacacaaaacggtttagctgaagagagtacatttcaatcctcaacataaagggaaatggaaagagcattgtattatgagtcagggttctgcctgtgatgccatctagatttgaacctattaatagaatgaattctataatttgtaaagtcagttcttacttgtaaaagggttttcgaaagcccaacaaggtcttaagggttttttaatgtgtagtatatattgatggaatcagtaggacaaaagatgcctcttgttctctgatgtaatgatttgttctaattttaaggtataattgccttttatttatttgtaatgttgataagtacttttgaaataagggaataattggttgaattcagtgtggctaaacattcttttttccctctgcatgcaacaaaaagagtccaatattatccaggcattgcatacggtctcatttaatcattacaccaatcttgtaagttggtgtttcttataaagtatgtgagtcaaagtggttaatttgcctaaagtcacacagctgatgtgtgatttgtacaggtcctactgcatctttcagctctaccagtggttctcaaattttgctgcaaatggaatcaaatggcaaagttaaaaaaaaaagacaactaatccctaactgcaagtattttgatttaattaaattgggatatgacgtaggtatcatgatttttaaaagctccccaggtgattctgatatgtaacaattaataattgttattaatccccaaaatatagtatattaataattaataacaataatttttgctttgctactcacccccatcaacccccatcttttcctagaattacaacctaataaggctatactcttttctttcttttttttttttttaagagttgggttcttgctcggccgcctaggcctggagtatagtggctcaatcatagcttactgcagccttgaactcctgggctccagtgatcctcctatctcagccttctaagtagctgagactacaggcatacaccaccatacttggctaatttttatttttattttttagaaatagagtctcactgtgttgctcaggctgtaaggctgtgttcttaatttatatatttcctcttagaattaattcaggaaatcctgtaataggcatcatgatactggaaagtaccagaaagtacatataatcccatgtaatcaaatgctttgatttctggaaagtgtctaaaatcgatgtatgaaaccatttacctcttcacatgtttcagatgcattcctacaataatgcattctagaaactccttgaaggagagaactgtcttactcatagaggtatcttgtgtttcttattgtgccaagtacaataatgaaattctacttttattatatatctatatacatttaattttttctttttctttttttttttttgagacggagtttcgctcttgttgcccaagctggagtgcaatggcacaatctcggctcaccgcaacatccgcctcctgggttcaagtgatcctcctgcctcagcctcctgagtagctgggattacaggcatgcgccatcacactcggctaattttgtatttttagtagagacggggtttctccttgttggccaggctggtctcgaactcctggtctcaagtgatccagctgccttggcctcccaaagtgctgggattacagatgtgagccgctgtgcccagccattcactgttaggttgagtttggttttgtgtttggctgtttgcccttgattgaaattattaccaccaagctgtacttacagaaatcctagtgttcccatttttgaacctccataatattattttttatccctcttagagaagtgagtgttgttagcttctattcttcaaacgagagctctgatagtttgagactctcttggtgaatttaacatacaacaccttgtacagtacgttgaagagaacaaccatttctttcattcagttgacattcacctgagggtacctaccctgtgccagtcacagtttaagaaactggacagccgggcgcggtggctcatgcctgtaatcccagcacattgggtggccgaggcgggcggatcacctgaggtcgggagttcgagaccagcctgaccaacatggagaaaccccgtctctactaaaaatacaaaattagctgggcgtggtggcacatgcctgtaatcccagctactagggaggctgaggcaggagaatcgcttgaacctgggaggcggaggttgcagtgagccaggatcgcgccattgcactccagcccgggcaacaagagcgaaactccgtctcaaaaaaaaaaaaaaaaaaaaaaaaactgggcacacttcattgaacagacaatgattttgtgaggcttgcattctttttgagcatctgctgtgagcctggcatgtaattgtgaatttgtctcctgctgaaaattaggaaggatgtctaaatctcaaactatgtgaggacataaatgtttacttaagagggtagcatattgagatgagccccaaacagtaccctgaaacatttagagattgccttagttaattgcaacagtaggaccccgttaagactattcatgtgtatccttctaagtcagcatttttccaacctcagctgtgtataaataattaccacttatagagtttgtaaaaaattcaggttacactgctctaccatcagatttttgtttgaccaattctggagtggggaccaagagttattttttttctttgttttgttttgtttgtttttaatgtaattaccacaaggaatttctactaaagaccagagaaccacactgagaaattctgtgctgaggttttggcactccattgtatcaagctgttgagggtagttagtgaattttgctgagtgctatggctgttgtaggaaatggtattgtcttggttgttggcattttatcattgttggtcaactgttttttgtttgtttttcactagagatggagtctcactctgtcgctcaggctggagtacagtggcacgatctcggctcactgcaacctctgcctcctgggttcaagcgattctcctgcctcagctccctgagtagctgggattacaggcgcccactactgcacccggctaatttttgtatttttagtagagatggggtttcaccatgttggccaggctggtctcaaactcctgacctcaagtgatccacctgcctcagcctcccaaagtactgggattacaggtgtgagccactgcacctggccaggcgactgctttttgtaataagaataataatcccttatttatgtaatgctttgtaatttatcaagtgcttttacataaactctcataattaccacaacaccttttgataaataaatagggttatattaagaatctttgaccagtgagcagaaatcacttacacagagtcacagagcaagaaaataacaagccaggactagaacctatgtttctggctgctggtccagtattcttggtactatgttacatatactgtcaacttagccagcttcccattcttaaacctaactgcagatttactggactactttttaatggtctggtcactgaaggacttacttttatgaatattacttagtgctgtattattcagggttgcacagacttgatagctattcatgtatttgaatagccatcttttctttctttgaggttgtatcattcctttctggtagcttgtgttgcttcttccattttccttttcccctttgctgtatgtttgcagcccaggcattgtgtcctttcttctgtatttgctacgtaaaacaaacatatcaaactttggaatgttcattgttttctttttgtattcattttctccactaatgaagataatttaattttgcctttttgtatcgtttttgtctacagtttcttatctagaatacttagctctatccatttaaagaggattttctaagcaaattaattaatgcaaagtagggggaagtgttcccttcatccagttatttgttctcttagtatcttcatacagaaacattgtctgtaatacaagtgctaacttatagtgcaaaaattaccctaaagaaaaccatttgaggctgggcacggtggctcactcctgtaatcctagcactttgggaggccgaggtgggcgaatcacctgaggttggttgttccagaccagcctgaccaacatggagaaaccccatatctactaaaaatacaaaattagtcaggcgtggtggcgcgtgcctgtgataccagctactcaggaggctgaggcaggagaatcacttgaacccagaaggcagagattgtggtgagctgagatcatgccattgtattccagcctgggcaacgagagcaaaactctgtctcaaaaaaagaaagaaagccatttggtggctgggtgtggtagctcacccctgtaatctcagcacgttgggaggctgaggcgggtggatcacttgaggtcaggagtttgagaccagtccccccaacatggcaaaaccctgtctctactcaaaacacacagaaaaattagctgagtgtggcagcatgtgcctgtaatcccagctactcaggaggctgaggcaggagaatcgcttgaatctgggaggcagagaggttgcagtgagccgagattgtgccagtgcattccagtctgggcaacagtgagactccatttcaaaacaaaaacaaagaaacaaacaaaaagaaagccatttggtctcttaatagtgtattaggagatattttataggagtgtgtttgatttctttttttctttctgaaactttttaatgtacatgttatccctttttaaggagtggaggtaagtcacttgagccttaagaatttgaggtttgaattagggagttaggaagggggcccaattttagtattttacaagtatggtgggtggtaatggctttggacatgttgaaattaaggtgaatggcatattgtgttttactcttgtgtagtaaagttagcagcaaatacagaactgagcctaggccagggaactgggattggggttagatctaagcaagatcagcatgtaagtgatagtggagaaagtaaattgagaggtgaggactcatccccttggtggaaattcggaattaataaagcaggaggagagtcaggataatgggctgttgaataaagaaagtaagtttttaggaagaggtaatgtgtatccaagaagtaggaaagaaatgagacttaaagcgtttggggtttggctgtgttagagctcagtacccaacaggtgctcagtaaagtaacttgactcaatgattgggtctgaggataatccgaagagggagttaagtatatagaattgaaaggataagcagaggccatatttaggaattttttgatatatgaaactcttgcttttttagtaggtaaggggcttttttttttttttttttgggagacaaggtctcagtgtcacccaggatggagtacagtggctagcctcaacagccgaggctcaagtgatcctcctgcctcagcttcctggggagtacaggcgcatgccaccacgcctggctaattttttatttttcatagagagaccggggtctttgttggcctaggctaatctcgaaccacctgagctcaagtgatcctcccatcttgacctcccaaagtgttgggattacaggtgtgagctatcgcatggctcctttagtttttataacagagaaatgacacagtaaaaccatagaggggtaactggaactaggagaatatttaagaagctaatacaataatccaggcatctttcaaaatttagcccaggtgctaacatttttaggaagccttcttttttttttttttttttttttttttgagacagagtctcgctctgtcgccaggctggagtgcaatggcgccatctcagctcactgcaacccccgcctcccgggttcaagcaattcttctgcctcagcctcccgagagtagctgggactacaggcgtgcgccaccacgcccagctaatttttgtgtttttagtagagacggggtttcaccatgttggccaggatggtctcgatctctcttgaccttgtgattcgcctgccttggcctcccaaggtgctgggattacaggtgtgagccaccgcgcctggccagaagccttcttttttatcttctaagtaaattgcttattcctgtattttgtatttatggttgcctttatattacacttgtcatctaccagttcttcatcagctttattgatataatttacccacataaaggttaacctatttaagctgtacagtttgtttcttagtatatgtacaaagttgtacaaccattaccataattcaaatttagaatattttcctcatgccaaaaataaatcttgaacccattgtcagtcactccatttcccgtcagccctaggcaactactaatctgcttttatatatttgcctattagaaaacatttgatcaagcttttgtaatttgtgttatgaagactataagtacattttccacttcccaatgaaaaagtgtattttaacatttgtatctccctggaccttccagttctccacatgctgtccctcaataccaccactatcaatgttggagcagtgatgacaagagctgacaaaagttaggtcatttgtgattttttttttttttgcaactacgtccccgctcaattatttgtgatctttgaaataacactttgggtattacggggaaaataactatgttactgggaaccaagaaaaaatgagagtaagatgcaaatataaaccaggttttcaaaaaattacctgaagaagaaaataaggtgatcttacacactataccaacctatgctgtcacttagtttcttgtgagcaccagacttcagcctggtgccaatccaccccttaacctgggtctctgccatctgtcctttgagaatcaaccttacttcctcagagaaactttccctgatgcctcccttaaaaaaaaagatcagatccccataatttgtgcccccacaatagcactcttctctccttcatcatggtgtttatcacccttccccactataagccacgaaagcagcaattattttgttttgtcttgttagctactctaaatattgaatggataaatgaatagtaactttgataatgaacagtggtaaagttttttttgtttgtttttataatttttggagttaaggaacatctacatatctttgaaggcaaagggcaaggaacaaaggtggagaatatgaaaatgtacggtaattcaaggatcttgggggtaatgttgtaagcaaaggattagtagtaacaaggcagcaagaagagggaaaacaaatcatcttagttgactacgttattgctgagcaaaacatacatgattttcaaatattagatcttattctacaggctatttatctcaaaagttggtttggaacaggggctcttaacctggttcataaccatatccaccccccatgagatctatgtatttagacaggtaaggaaaattacatttttattttcatgagcttctcactcaaatctagtatttctttttgattttaagtgtaagtaggaaacctcatgagttttagcagaacctttgactttgtcaccaatagaaatcactgatttttgtggggggtagatggagttttgctcttaccgccaggctggagtgcaatggcgtgatcttggctcactgcatctcctgcctcccaggttcaagtgattctccttagcctcctgagtagctgggattacaggcgcccaacgccacgcccggctgatatttgcatatttagtagagatggggtttcaccatgttggccagagtggtctcaaactcctgacctcaggtgatccatctgcctcgacctcccaaagtgctagaattgcaggtgtgagccactgcacccagctagaaatcgcagattttttttttttttagactaagtctcactctgtggcccaggctggagtgcaacagtatgatctcagcatgagccactccgcccggctgaaatcacaggtattttatatcacattattgttgcaggtatcttaaaatatagtttacactcattactacatcaaaattatagcatttattagacctgctcctatatttaatgcattaataagcagagtgtagggctgggcactgtggctcacaccagtaatcccaacattttaggaggccaaggcaggcggatcacgtgaggccaggagttcaaaatcagcctggccaacatggtgaaaccctgtctctactaaaaatacaaaaatcagccaggagtggtcgcatatgcctgtaatcccaacaggtggatgaggcatgagaatctcttgaacctgggaggcagagactgtagtgaaccaagatcacaccattgcactccagcctgggcgacacagtgagatcctgtctcaaaaaataataataataaggagagtatgtatattactatatcccaaattccttttttttttttttgagatggagtcttgctgtcacccaggcttgagtgcagtggcataagctcggcccactgcagcgtctgcctcctgagtagctgggattacaggtccccaccaccatgtgcggctaattttttgttttttgttttttttttttttgtatttttagtagagacagggttttgccatgttggctaggctggtctcgaactcctgacctccagcgatccacccacctcagcctcccaaagtgctgggattacaggcttgagccactgcacctggctcaaaattgattttttttctttttcttttctttctttcttttttttttgagacagagttttgttcttgttgcccaggcaggagtgcaatagcgtgatctcggctcactgcaacctcggcctcccgggttcaagcaattttcctgcctcagccttccaagtagctggattacaggcatgttaattttgtatttttattagagatgggatttctccatgttggttaggctggtctcgaattgccgacctcaggtgatccgccctccttggcctcccaaagtgctgggattacaggcatgagccactgtgcctggccccaaaattgattgtttagaagtaattttatgctagttcaatttcgctataattgattttctttataatgccttgtattttatgcatttaaaacattctgagaagagatgtatggggagaagaggtatctggttttgagaatacatctgtgtataatgaatggcaaatagctgttaagaatggcatatacaaatatgaatgtataggaaaattgaaaggattttagagaaaagggaacagagtagctgaaactttttttttttgtttatgtgttctttttttttttttgagacagagtctcgctttgtcatccaggctggagtgcaatggcgagatctcagctcatggcaacctctgctgcctgggttcaagcaattctcctgtctcagcctcctgagtaggtgggactataggcgcccaccaccatgcccagctaatttttgtatttttagtagagacggggtttcaccatattggtcagactggtctcgaactcctggcctcatgatccgcccgcctcggcttcccagagtgctgggattacaggcgtgagccaccgcgcctggcctgagtagctggaactgttagcagtagtatcctaaagagacaatttgagttagttcttacggttcagcaagatcttgctaggccaaattccttttctgctcccattaaaaaggagcataaaggttggataatgatgggctggcaagagactaagtttgagagacagtatcttcaggatatcttgtaggtgctattaaaattggatatattatagcactgattcagtgttgatactttttagttgttcactgaagactctgacattaataaccgaaagattggcaaacgactttttaacttttataattatttggcttatttgaactagggataaatagatgcttcctgatgtcttcacttggagtgcagggagtgtttttgcatttcttgttttgttttccttatctgccaaatcaagcactccctacactgttacagcttctaatatgagttttcattattttactcagcaaatgttttgagcatctcttgtgtatgctgggaatacagattgtgaacaagacaaatataatgattgcccctaattaagttaatagtctgaaggggaagatctacattaaatttttttttttactgttattttgtcctggtcatggtgatggaactaacatatatttgggtaaagtgcatattacaataattacactgatttattctggaatattctgggtctcatagtaatacttaaatatttttatatgaaaaatatgtattttttttctcaaatactcccattttcatgaagacatttttcagaaaaaagcaaacccctagcttgaaatctccggctatagtataacacttcctaattggtaaccatgtcattgtcattccttcccctggtcctccatttccatattgtatactgatgccaaggctaataattactgattttaattatgtctcagccacaaactgtagtaatagttcacccaattatttacagcatgtaaagctcataagccttgcactgaagaacctatactgcagcttcaatctatctgccaccttgactcttccctttatgacagcccatgccccaaaatggtttgcccctgcctggtaagcccttttctgccttacttatcaaaacactgttcatccttcaggatctgactggtagcagactattttcctaatacctctttagacagatttagttctcattgatcttttgtgtgaatcatgttagcattttttgtcagcctcattgacttttgcatgtattgtcttacatttgtgctttttgtgtatgtcttaatttttaaattggatttaatttggatatgcgtttagaggaaaggacataagagcagagagatagaccttgccttctcttggcattatcttcagaccttagatactttttttatgctgtaagtaagtaataatggttgtgtaaattatgaactcattcttcagcctagttttaggtaacactgaagtctaaaggtatagatttgaaacaaatggaaaatgagatccccgaacattttatctttttaaaattattattttcactttcacccattaaattacttgattttttttaatgtttcgtaacttaggaagaataaggtccaaatcaactggaatactttttttagtctcataattacctgagtacctgcaatatgcacatcactttaccactgtacacttagtagcaacacgtcttgtacttaaaaatgtctaaaggtaagacctgtgtttctagtttgaaggcctagaaagtaaatgagtgaggtttttgtgttggtgtttcagactataaacttaaatggcctcagagaatcgggttagtgcttgttcatgactcaggttctgtgaaaaggctattcaaataaaaataaagctgtaagctctatcctaccaggtatagagacaaacaccaaagttacagtagatgagtattgtcaaggggttaagactgtggacacaagcaatagttaatggctttgggaattctaggaaataggagaccaatgtgggataggtgacattaggaagatttctttggcatctgggttttaaggttgggattgaaggtagagaaaagctctcagaatagacgtgggaagcatggaggtgaaggtagaaactaagaataagtaagattggaataagcagaagaccatttctggttctgaatctgtgtgtgataatgtctgaatgagttagtccagatggaagagcacagatggagggtgtgacgttctagctttagagaattaagctatatattccttgagaccaaaggaagtgtgaaagatgtaaactcctgtctcttaggtttaaggagttatagtaccagtccatagaaaagaaagtcctagctgttttagaactgcatggttgctccacaaggtaaaatgcctttgagacgcttatttttttttagctattttcaaggaagtatttaatcctcctgactttgagaatagtgaatatgtcttgtgttcataaatttaagcaaggatgaagaatgcccaataatgtgtgtgtgttttaagtgtgcttctcaattcatctaattcttcccagtttctaactattaagggagttagaggcttacatgcaggtgattttgttagaggcttactttgcagatgatttctttatgaaatcatgttaattgcatgaaaatataaagtctgaatttgtgccttttacatttcaggtttgtgtttgggcttagatggatggttataacatttgcttgttttttgtagttttacatctgagccatcagtggaaacctgtctagagctgagacttggtcttataaataagagttgatttatgccttcccttttgcctatttgactttttgcgccttcttacttccttagctctttctggatttggtgttctcgttttcttaaaagcctaggtaaattatatttatattaaacaagtgttgaacgtttgtaatggtaggttcgtgacagatctctagtccagatttgcctatcacataaaaaggaagagggaaaataacaaaagaaaataaaatgaggaaaagggaaaggagaacccagcttatttgctttatcacttaccttttaatactgttatttatgtattacccaaagcatcactgtgagcttctttcaagtaaatgtttcagcgaatgtgaaaggtgttgaattcccatagggagaataaagagtggaagagggaaaataacagcagctttagtatgctgttttaagcaataaggacaaaactggctcttctggccgggtgtggtggctcaaacctgtaatcccaggactttgggaggccaagaggtggatcagctgaggtcaggaattcgagaccagcctggccaacattgtgaaacgccgtcactactaaaaatacaaaaattagctgggcgtggtggcaggcgcctataatcccagctacttgggaggctgaggcatgagaagcacttgaacctgggaggcagaggttgcagtgagccaagatcgcaccactgcactcgagcctgtcggacagagcaagagactgtgtctcaaaaaaaaaaaaatggctcttttgctgtcacgttgacacatttgtttcctagcctagtgggcaagacctctagaaagttaagcagaacttttcccttactgggttatctttttctgcaaagaggatgtggaaatggatttgattttgtgtgcttggcagttatccatgtgtcaggtttgggaagtagttctcaagaacaactgaagcaaaagtcgtaggaaggaactgaactttttggcttataatcctcttaggatctcttactctcaacataagattctagggagcatatttattatacctgactatgagacctatctgaatagatctgaaattaaagctgactgatttgaggctcccccccctttctcaggtgctatgcctgaaatttctgcagttttggtagatgccatcaagggttaatgggtgcccaggaccactagttagaatagactcttttcttaaagaagagccacaagagtagcacatctgtatagttatctttgcattttctagaaaaatattcttaaaagattaaatcctcatactctagttttaatattgattttcttgaatcattggcatttatcagcaaagcaggaaatggcactaaacagtttcctacttgactgatacttgttataattttgacacagattttagttttcttaaaaagctggtgaggtacagtggttcaacttgtaatcccagtgctttgggaggctgaggcaggaggatcgcttgagtccagaagttagagactagcctgggcaacgtagggagactctgcctttacaagaaatttgaaagaccatgtctctaccaaaaacttttttaaaatttagctgggcatgatggcacgcctgtggtcccagctacttgggaagctgaaataggaggattgcttgagaccagaaggtcaaaggctgcaggagttgtgatttgccactgcaccccagcctggcaacagagcgagaccttgtctaaaaataaatgaataaataaataaatagataaataaggaggaaggaagggaaaggaagaaaagcctgttctccccttttgaatatttttaaaacataagctttccagatatggtaaattttgggattggttcttattggagttaacaaagaaatgactgcagtttaagctttaaaataactttttaaacaaaattttaagtatcacctgattttcttagcagaatttaatatctagaaaagtttgaaagaaaagtggtagtgcttattttaaggaaagtactcttaccagaatcataggcatcaaaatttgaaataatttattgcagtgattttcagtccttgggataaatgaaattggcagttgatacttcttattagggacacattgtatacagtaatacagcccaggataattaaaacatgattccagttaaaagcaaataaatgtcattaccttgtgttatatgggttattttctgtgatctgaagccaaggaaaaatgtgactcctttttgaataaggacaagtaattattgattaaatgcaatttggtaggaactggaatcgaagttcagataaaagaaatctttgctttctgaaacattttggaatgactgatagagtcatcttcatttcttcagttacaaagtaaattcaggtgagattaaggaatttggtaaaggccataggaatcagtggccagtgggtataaaattcagctgccctggtaacaggagtgttaaggctactatgcatgtcctatctatataggagaatggagttgcatgacagggaaaaaaaaaagtctcattacccttgttttgtctttgggccttgtagttaattagtgggtttgtcttctgagtaggggaacattcgccttatataatacctagtcagtgaaagaaaactatattattcttagggttgatgatattaagtaatagctttttgtaatatcctctcttctccttttgtttcgttaggtggtatggtcaggaaaaagactacaatgtactagtcatggatcttctgggacctagcctcgaagacctcttcaatttctgttcaagaaggttcacaatgaaaactgtacttatgttagctgaccaggtatgtgaaattttgattagaatataaactgagactagtactgttgactggaatttcattattcataaatcagagtattaaaatcctgtgcatcactatttaaccttagcataggcagaaaaaaaataataatgtgacttgtagatattttcctatgggaataagacaaaacctggaattatcttggtttcttactcatctgtagactagtagttttcaatctgctccttcagatgaagttttagtgtcatatgtagcaggttattgtaagattttgtttggagagtttagagtgtatgtatgcatataattgttgataaatgtttattgacattttggttaaattaagcaaaattgaatattatgtattatgtgtgggactcttagaaaagctatatttttgaggataaaaaggtcctgaagtaatataaggaagaattttttgaccaagtagatgctgcttggagtaatggattctcaaccatttgtgttacttaagacctaggaaattttggtgatgtcatgaattagattgatgcattggctgtaggttagattaaatggtttttacagccaaagtttggatatttcgatcttaagaaatgagaaagatgagtaaggaacaaaccttaagggaaaagataatacattaaggtaatgattggtaaatatcaagacatgtataattttttgttttgatcagtatttgttacctttaagggcaggaaaatgctggaaatgctttaagttaaactcagtgtgcttataaaaatactatgaagagaatgacatttaaaaatataatggagggtttgtgacagctctctagtccagatttgcctatcacataaaaaggaagagggaaaataacagaagaaaataaaatgaggaaaagggaaaggagaacacaggttatttgttttatcacttacctttatttactttatcacttaccttttaatactattatttatgtattacccaaagcatcactgtgagcttctttcaagtaaatgtcataaagtaaaatgagataaacagacatggtatttgaggtggaattttagtaagtttgtaaattcagagggatgaagagaagtaggttaatgggcacaaaaatacagttaggaggaataagttctagtattacatagtatagtagggaaattatagttaacaatagcttatcgtttatttcaaaatagctagaagagtagaattgtaatgttcctaacacaaaatataaatgtttgaagtaatggatatcccaactaccctgatttgataattacacattgtatacatgtaacaaaatatcacacataccccataaatatatacaactattatagatcaatgaaaaaactttgtctataattccaaggattagaaagtagtgcccattttctgtaatcagcacctgatactccccaagcttcttaaccttaaaagtactcagtggctcaagcaaatgtgagcaaattgtgatatttgtggcacaaaacaaactcaagcattaaaaggttaaaagtggcgcggcacactggctcacgcctgtaatccagcactttgggagaccaagacacgaggatctcttgagcccaggagttccaggctacagtgagctataataatgccactgcactccagcctgagcaatagagcaaagaccccatctcttttatgttaacagcctttaatgtgggctgggtttggtggctcatgcctacagtcccagcacttttgagaggccaaggccggtaaatcacctgaggtcaggagttcgagaccagcctggccaacatagtgaaacccatctctactaaaagtacaaaaattagccaggcgtggtggctgacacctgtaatcccagctacccgggaggctgaggcatgagaatcacatgaacccaggaggtggagattgcagtgagccgagatcgcaccactgcactccagcctgggggatagaacgagactctgtctcaaaaaaaaaaaaagcctttaatatgttttaactaacatatatgagtgaatcctaataaaagagttatggcttatgtttttgtttgttcagtaacacgtaagcatccatacattgaacatgtattgagagcctaccactgtacttagtgctgggggttggggtggcaaaaaaataagaattagtctcttccctctagaaagaaacttagagtctaataaagaaagatggaaaaataagatgttccatccttgttgtagagttgtagaagtctctgttgggtacacgggtaacaaatgtgaaaaaatataattctgaggaagggagatacaagaaagctttcatttaaggtagttgacacctaagtcttgctctgtggttgacaggtaacaggtgtaagttgttcaagccagagattactagtttggcttcagaagacatttgtcaaggtagaagagtacaatttagaatctgtgtattcatgataataaaagctctggggaaaatggggacaaataaaaaatagaatcctaacagatactactgggtagagcaagaacatatggacagaaagataatgttggcagtctttggatatgtaatctatttaaaaatacaacttctaagtaagtgtcttatagaaaagatagaggctgggtgtgatggctcatgccagcaatcccagcactttgggaggcagaagcaggaggatcacttgagctcaggagttcgagagcagcctgggcaacataacgatacccccctttccacaaaaaatacaaaaattagctgggcatggtaacgcgcatgtccgtagttccagcttctcagggggctgagctgagaggatcacttgagccccggaagttgaagctgctgtgagccgtgatctcgtcactgcaccccagccagggtgacaaagtgagactctgtctcaaaaaaaacaaaaaaacacagaacttctattgtatacaagaaatgccataagcagtcaaaataaaaaataatttaaatttgtttacataatgacagataaaagattgtttgttttatgacgagaactcctaaaagctaacaagaagacaataggccgaaagaaaaataggcaaagagtggagcttgacagtacatagaagagtaaatcctcatagaagggccaggcgcagtggctcacgcctgtaatcccagctctttgggaggccgaggcaggtggatcattttaggccaggagctggaaaccaacatggtgaaaccctgtctctactaaaaataaaaaaaagtacccaggcatgtggcgggtgcctgtaatcccaactactcgggaggctgaggcaagagaatcgcttgaacccaggaggcagaggttgcagtgagccaaaattgcaccactgcactccagcctgggcagcagagtgagtgagactctgtctcaaaaaaaaaaaaaaatcctcatggaaggattacttctaaatcgaggccgggcatggtggttcacacctgtaatcctaccacattgggaggtcgaggcaggaggatctcctgaacccaggagttcaagagcagctgggcaacataacgatatcccgtctctaccaaaaattaaaaattagctgacacaaaaaaattagccaggtgtagtggcatgcaccttatagtttcagctactccagagggtgaagtgtgaggatcactggagcctggaaggttgaggcagcagtgagttatggttgcttcactgcacttcagcctaggtgacagtgagaccctgtctcaaaaaaaaaaaaaaaaaaagaagagtaaatccaaattgttacagcctattgtggaaggcagtgtgatattatctatcaaaatgaaaaatacacccttcaactcagcaactccccataattatatgggatttgaagcccatagaaataaaagcactagtgggtaaagatacatgtctattaatggcattatttatagtaggaaaaagtggaaaacaatgtgagaatactgtgagttggggaagacataacatctctaccacagaatatttgtagccattaaaaaggatatttgagctatagcgtttgactttgcataatttccaagaaattaaggaaagcttttaagaatggcatgtttaatatttaacttttggaatgagattatataagaattataacaactacttatagcttaatctgccaatctgtcaacatcctccactcccaagtatatgtgtatctgtttgtgtgcatatgtatatcttataacatggaattaggtctgggtaatacaaggccattttaacaggttactttagaaggcctaggattgagtgtggaaagtttttattttatttcctttattgtagcaactgaaactattatacaggtattccttttattatttgaaaatcacaaacaccaagtcttcctatggggttagaccctgccatggttttaattattaatactagaaggtaaagccaaaggacacagcaggtatatgcttagatatccattaacctagaaataaatggagaacttagttgtcctttccatttcattttctttagcgctgtctttgtgaactctaaataattgagatactgaaatacttaagaaatgtgttgattttcatttactacttaactcaattatctctcccttcttttttttccagatgatcagtagaattgaatatgtgcatacaaagaattttatacacagagacattaaaccagataacttcctaatgggtattgggcgtcactgtaataaggttagtcaaatgctctttgcatgaaagaacaaagagtaaagtttcgacaagaattgctttggtaaacttttcaatcttttaaaaagccatagtaagttgaatttgctgttgacagttgctttaaaagattgtgctatgaggataatcagctaactccattaacttagtaacttgaaataaattatcttcaacttacccaaccgaggttagttacctatatggaaatataaaattctaagggctgtataatgaactgtagttgtctaagttatttaactgttgaacagttgtatctatttttcattcacaaaaatagcaaaaacccccatattcttttcttcctgaatgcttaaaaccagattttaacctttggctctgaagtgtgggtttttataatatatgtgcttgtgccagtgtgggaacactgacttatctgtcaccatggtgttaacatttgctgactgagcatggttgataatgagaattcttcagtccttgaatttgtgtatttaaaagggtaacttttgggcctgcttcaaaagtagttgacagttttttacttgggtgccaaattgggtgagttctccacccctccctctccctttaaaggaaaatgtagacaagtgaaatgaacattcatacaacaaaactagtgttcatttggggtctctgagagtggttcaacttatggggtgattgggttttagctagtggcgcatgattgcagttagaaactaattgtgttgactttttttctgtaatgattagtcttactgagtgaattgctttctttatcgatactatgttgagctcgggcagacaggcagcattggcaatgcactaagcatgttgtgatctgatgatctatctgatagaaattctcaacttcaggacaacttgggggctttttttgtttttttgtggcttttttgttttgtttttggaaggaagatgcccatttgttttactaaactattaggaaatgtttggtgtttttaggtctagctataaatgtttacctttgtttgcctgtatgaatgccaactgggagacattaccattagaattggtgttatttgtcaatgtgagatactgatgttggtctgattaggttttaggaaattaaatttttttgttgagctttaaataatgaaaggtgtttaaatatacacataacttatcttgtcattcccaagttgcattaaaaaatattttatagcttttctctgaagtatccaggtttttattactgtaaagcctggtaattcaattgaaaaaaaaattactgttcttaagttttggggcagttttgtccatttgactccaatcttcttggccatttcccagccctctccttcctgttttcttaccccctaaaaacccattatcaccatgtgattcctattctgcatcgttgacattgcagtacgtggtttttgccttaaatttaaatgatgacctagatatcactttgccttccccccctcccccacaacccccttaagaatagcttgttaatcgcatagttgtcttaaggaagtgtaagttatctagtggtgaaaacctttttaggaggtttaggtctccttttctccttgagatattaaaaataattttgtggagctgcttgctgcttaacactgttttagagaggccatggggaagaagcaaagtgttttactcaactaagattcaaatgctaaatgttgctcttgaacattttagattagtgttttgtttatgtagttgatttttagtgttttctgtattgtagtttgaaaaatgccagttgtatgagactggattctttggtcagcttgttccagtagttttctattcatggggaaaaaaaggttttggggggcttttgaggacaatttttaaagttaaatttcttatttggaaaattgttctgaatttgatatttaggagtggccactccaatcttagtgaatttgctcatctcttccagtaatcagccctgcatgcttacgaaaataaattttaaggtgactaaatgccttctacctcttccttactgaagatttttttcccccgtacaatatttttttgggggggaagggcagattgtggtaccaaagattgcagatctaaattccccatttttgattaaaaatataaaagagccaaatgtcaccattgctatccctgtttcaggcagtgacacaaaatagtggcattaaaaacctgagtaatttccagaattcaaatgttcttgagcatgtgattcttatttggaaaactgagaagctacagtgcttggtggaagaaggatggcatttggctaccctgttctttctctaatgcctcggtgttgcctgtctgcgccggccattgttgcaatgtaagcaatactgtttgatgcactgccaccctctattgtctgtttagtgtttagaatctccagtggggaagaggaaaagaagcatgactgttagtacttctcaggacccatctttctcaggattaaaccaggtctgaaactgtctcctattccaacctcaatcccaaattcatgtgcttttcttttttattgttttattttgatgatttttgttttgttttaattctggagaatgtagatcttgctcaagcacctcttacgttggcattattcagacatacttggcaaacataacattactaagatatttctttgtggcttttgcttaaaacttataaagtttagaaaaaagctaaatgaaaataggatattatgtttagctctctaacatacatatgaggaaatgatgttggtctagtactgaaattgtttacctaatagtaaacttgagatagatcgttagtttttaaaaatttatttggagttacacaacttaatgcacgaaatatatttaaattcagttcattagtgctgtataatgaatatattctacctcacctctcttccccttccctaaggaacttcaggtaagtgtagatcagatttcagatctagtgtttctagaacttatttcctcagtctgtattctcaacttctagcaaatggatatttacagagcattataggctctggaactagaagatactgcattcttaacaatataacaataacatagcttaagcacttatcaagttatatggtagattaccattagtaatacattgaaatatattaaatttagtttttggcaggctggataaacaccctactaattttctaaatttgtaagtagaactcttcatattttgttacacttttgttgaagttaaatagcttttttatcacaaaatttaagttcataaatgttcatgctcctgagcaaatgaatcttaatcattcagtttagtatacagtgaagaggaagtattggcatgaataatcaaaaaacaaaaaacatgctttgtaataccttaaattatccacatgtatcatctggataatcatttaacccttttccatactgcccagctttattccaggaaccacctccagctattaaaaaaggtttcagaaattcagagttatttttattcaggcaaagaagtaccaagtattgtgactagttagataaggggtggggggaagacagtagatggtggatcattaggcatattataagaataaaactagttttatagtgcctcatttttacttacccattcacatattttgcttacatttcgtagcatcatttaataatttacaaagaaagttgtattacattgtttagattttgtacatacaggttagctaggtttttagtaaagtgaccttgtgaatgttttagaagggcaagggaaattatgacccctggttaggaaaaaaaaaaaaatgctgcaagtactaaacactaagattagccacagtgattttgaagaaaatgtgcctctattgaatggaattatggaattatccccctactttttttggtttttggttttattttttgttttttttggggggtttttttgttttgttttgagacggggtttcactctgttgcccaggcaggagtgtagagtgcagtggtgcgatcttggcccactgcaacttccacctcccaggttcaagcaattctgtctcagcctcccgaatagctgggattacaggtatgcgccaccatgcccggctaatttttgtatttttagtggagatggggttttaccatgttggccagactggtcttgaactcctgacctcaagtgatccacctgccttggcctcccaaaatgctggcgttataggcatgagccactgcacctggtcaaattatcccctatttatcaactcagttccctgtgcctttgaagaataggctgcattgtttaaaatgggcgcagattttactcataacatgtagttagtaaaaatccacagaaaaggagcttgattcactgaaggaagtgcctgtgtctttgcacataaaagcctatagtaaaaatgcattatcttacgcttatttgatactgacttttcctcatttggttctgcctttacatatttacagctttttggttgtatctttggcatcatgtggtttcatgtaaacatttccattatatgtttatatttattagttttaaacagcaaagcatacagagagagctactaaagaagcttgataggtacccgaaggtaatgaaccaccaatagttttatttccttttttaatttcaagtagttttcctttcagttgtttactgagaataggctatctttgttcagtactaacatttttttcctgatgtattttcagtttttataagaggagaacatttcaaattatttgctctttagatttttgtttttagattgagatgtttaagaagatcgtgtttacatatttgtagtttacttgataaataaggtttcctcctttagcgttgtgggaggaaagaactctccagcgaacactgaatttttataaagcagtcttttggttgtgagaaagtgtctggttattgagtcacaaatgaagctattgaatgtagatttagacatgaatgaaactgttagacatactcatgtcagagctcttcccttttgtccttcattttaaagtaccaaaggaagcaatcctagaaaatgtgaactggaggaaattctatgtactaatcactcttcattcaatgtctacatatttcttagagatattttttaaataccatgaagctgaatgtccttttgtgtttattttccccatgttttcttttcactatgaatctgcagaacttaatcatcacttttgttttgcttaacaaatgtattttgctcattttaatatttgtgtactgatctggttttcatatcaagagaaacttaaagtataagctttatttcttagtgttttacaacacaaattttcctgtaatgacttgattgcttaggaagggagtttaatctttttactttgagagtcttcatcatccagttaacatttactaataatttaatcttcattcttttatagtagactaagtaaaaatcagtatctcgttgacatggtgactgaagctcaactgtcagtgtctttactgtccaaagtataattgagaataggttataatgcttggctgaaatagatgttactcatgctcctaggagaggtactggtcagatctttataacctaaatcagtaacttgctttatttattgacatgaaatctgcaggttaggtgatcaagtttcccagcacatcacaaattataaactggcaaaagggacccagtagtctaatggagagaagaactacaaaatttaggagtaactagagaacaacagactagggctatatagtgtaagggcacatagacctgcctagcttaatatttgtagattaacttttattaaaatatagcataataggtgattttatgacaaaagccaaaattttaagtaaagattatttcttttcatatggtaggtaaatatgaatatgttttggatttctttttcataaaaatagttatttacttataaaaggcttaagttctggagtgtaaacttgaattacatacaacaattagctacattataaatgaataccttattccctgagtaccatatagacatgataacactaaacgttattttgttctaaacactagtttttgtttttagttagctcacttaaactgctaattgtaagccaccttgatttaaatgctaagcgctttttggggggatttttatatcaacttgttaaattttccagaagtttaacctgacccatttgtataatgtcagtgctaagtagtattttttattaataaaaagtcttggtttcattggcaatgtcagacttttagggtagataacaagtattctgttggcacatttaagaatggcctttgtaggagggaagagttcagatagtttatatctggattttttttttttttttaagaaagagttttgctctgtcacccaggctggagtgcagtgacgcggtcttggctcactgcaacctctgcctcccgggttcaagcgattctcctgcctcagcctcttgtgtagctgggactacaggcatgtgccaccatgcccggctatttttgtattttttgtagaggtgggactttgccatgtttggtcaggctggtcttgaactcctgacctcaagttatccgcctgcctcagcctcccaaagtgctgggattataggcgtgagctaccgcgctcggccattatatctagattttgaaacctcatgtttgtttaccagtagtaacaggtgtacagactatcaggtgtcattatgacagatagcacacttgttgcttctgctgtcaagcatgtatacatttctttctttataaagacaggttcctgagtatgtaatgaaatgggcctgtgaaatctgcaaacgacaaggataaactactagactttttttttttaacttgatttattgatgaagactagtaaaagcttatgggggggtgttaagtctgttcattatctgttctattaatacttaggatactttattttgatatatttgaatgcatagaatagataccatttaatgaataagacgcagtttaattgaacaaggttggaaacctaatgtttctgtatttctcttttaaagttattccttattgattttggtttggccaaaaagtacagagacaacaggacaaggcaacacataccatacagagaagataaaaacctcactggcactgcccgatatgctagcatcaatgcacatcttggtattgagcagaggtaagttcgaaaatggaatgtgcttatcatagccatagcagaagccatcaatgggtttttgaaatattttagtttcttacaatgtctaaggatgtttcttggctgaggatttgaaggatgcttattaatcattttacctgctgctttaaccagtgtagagaagaccgttaaatgaggtcttctggattttttgttgttgttgaaggttgtctcttggggggaaaatactgcgtgatagaaagttagaagcataagtgcaatgttgacgtttctttttgcagctgaagatagtacatatatttttagagctatttggggctttttatactttagtaattcacgctgagtttgggaagaatgcattatttatttttaaaaggaaaatgttatcagtgtcctaataaaccaaaagtgggttgatggaccatctcctgttatacttcactcaaatatataaattaataggatctagtttaaagtaaaaaaagtaacagtctctgctctcttcctatttcttcacatgagttctagagtttcgagttcctttcatcttttacagtcactttttgctccttaaaactagcatagaagtaataagtagaaaaaacaatgatatgcctccaggttaaagaacctcataccaagaatttcaggcttaagaaatatccatgaatatctgaatgatctaggttaaactgtaatgtcactttttctgtacgccaaggcattacctatccttaaatatatatatatctaaatatatatttgtatgtatgtgtatatagatatgtatgcatgaatacattcatatagatgttcaattagttttaagttgtaactccttttcagtacttctgaagtttttttttaatgagtttctgcaaaacatagaaatgtcatcctgcttggttcattaagctcatttagagggttgtttagccaaatcgtttctgttcttttaaaattaaattgtaagacagttgtttgtcagattttggattccatggaaaaagttttgtttagaggtaggtaacacatgaactttttaaaatcaccttaaataagtagcttcttgcgtaagacaccaaatagtgttccctcctcatttgggaacatttcttctgggtacttgactttctttcatatgttttttcataataatagttccagtttataaaattacgttctcttttctagtcgccgagatgacatggaatcattaggatatgttttgatgtattttaatagaaccagcctgccatggcaagggctaaaggtaaaccagactcacattatcagatttttctctctcttttttagaataaaaatatatattggagaagataagatttaaggtcccttctaagtctgagatttttctgagatataaagaattaaccttaatttactttttaccttttatctgggaaaatgaaaccagatcattttagtaagaacttagttcagctgaagaacagtgtcctctaagagacagtaagctggtacccactggtagccactagctctatctagatggaagtgggcatggactaagaaaggtggagactttctcattttgatgtgttgccattatgttgaaaatgtatgtttttatgtacagcaagacctgtttatccagcaatacatgtcctaacattttgtttctattagctaggagtttactgttacttttgtgagtgtatgttaatgataaatcaccgtatcctaattttgggtgggggtgggggcatggggaatggtcttgctctgttgcccaagccggaatgcctggctcactgcagcctgaacctcctgggctcaagcagtcctcctatctcagcctcctacctgtagctgggactacaggaacatgccaccatgcccagctaatttttaaattattttttgtagagacagtgcctcactgtgttgcccagactggtctcaaactcttgggctcaagtgattctcctgcttcagcatcccaaagaactgggattacaggtgtgagtcaccactgttggtgtgtcctaaattttaatggctattttggtaccttaccagttctttgaaggaatacctgtatttattgagtggctgtgagctagttgtagtgctcagtccttgggtgggtagctttatctaatatgagtatttttagtttagaaaaatattgtgacttatacagttaactccatttattaatgtcactaattgatgaacaaatttttttgtattaatctgatgcctttgcccttgtgttgaacatgggttaagaaaatgcttttcaggctgagcatggtggctcatgcctataatcttcaacactttgggaggcccagccaggcggatcacttgagcccaggagttcaagaccagcctggtcagtatggcaagacctcacctctactttaaaaaaaaaaaatagcagggtgtagtgtcacatgcctgtagccccaattactcaggaggctgagccgggaggattgctttgagcccaggagttcgaggctacagcgagctataatcgagccactgcactccagcctgggcaaccgagggagaccttgtctcaaaaaaacaaacaaacaaacaaaaaaacaaagaaaaggaaaaaggaaagaaaatgcttttcagctgggtatgatgatgcacacctgtagtcccagctacttgataggctgaatcaggaggattgcttgaggccaggagttggaggccacagggaattactgctgagcctgtgaatggctactgcactccagcctgggcaacatagtgagaccccatctccttaaaaaaatatatagaaagaaagaaaatgcttttcaattttggccccagccatttttacttaaatctaatatccatatattcctattagactcaccctttccctatagctaaaattaaattcttagagaagaaacttacatcagaagttaacagtttgggaaaaattttttttagatgtattatactttgattttttaaattctgggttaaaatttctcttgaatctcacaggtatatgtttatatgtctagtgcgttaaactaccatggttcttctcagtagcactgagtatatcttttttattttattcttttccacaggctgcaacaaagaaacaaaaatatgaaaagattagtgaaaagaagatgtccacgcctgttgaagttttatgtaaggtaagtatgcatgatgaatattaaaaaaatataaatgaagccaggcacaatggctcacacctgtaatcccagcactttgggaggccaaggcagtaggtcacatgagcccaggagttcaagaccagcctgggcaacatagggaaaccccatttctaccttaatagataaatgatccggctgggcacagtggctcaagcctgcaatcccagcactttagaaggccgaggtgggcggatcacttgagcccagaagttccacaagaccagcctgggcaacatggtgaaataccttatctaccaaaaatacaaaaattagctgggtgcagtgatacacgtctgtggtcccagctactcaggagcctgaggcaggaggatcacttgagcccgggaggctccaattgcagtggtgaatcttggctgtcttgcaaggatctgagattgtgccactgcactccagcctaggtaacagagtaagactctgtctcaaatgagtgaatgaatgaatgatccaggaagaaaaaggaacattttatttgccagctctggaacttgtaacattgaattaggtagctattcaccattttaaatttacatttttattattctaaatatctttaacaaggacttttaacataggggtctttttaaataagtgttttgctaggcacagtggctcacagttgaggagccacttggtaggctgaaggagggtggatcgcttgagcccgggagttccagaccagtctaggcaacatggtgaaaccccatcgctacaaaaaatgcaaaaattagcctggcatggtgacgcatgcctgtaatctcagcttcttggggatgctggggcaggatgcttgagcccaggaggtcgaggctgcagtgagccaagattgcaccactgcagtccagcttgggtgacagagtgagaccctgtctcaacaacaacaaaaataagtaaaataataaaaaataagttaaataaacgttttaagtaagtaaaataagtgttttatgtttctggtttgttagggctctctaatctgttgaaaactaggggtaaataaacagggcaggtaaacattttcaatagaacctcattaatctataagaaaaagtaagaaatattctccttaccctaaactagtgctggaaaagaaaggttatcaacaattagtacattaaggaacagggaaacatgcagacagattggagcaatccaaaatagcagctgtccaacaatacaggaatacagaagacagtttgaatcacactcattttttctgaaattttcaacttcatagaaaggcaattgagtttagaatagagaggtatttgtgtcatgatgaataaccatgatctcatccataaaaagaaggccatatggtctttcagacaagaaagaattgtatacctgaaattaagtacaaagcagtatacaaataaatagttgagggaagaaatcagtgagagttaaaatagtaattataaagtggtgagattgttttcagtctcattgtcatactgtttaccattaacacgggccataaatgtatataaatgttgagttttagaaagatgtataatatgtattattttacatcttttaacatatgtatatgtttcaagtggtcacccaatttatatcggtgcaatcaataaaaaatgttgcaagcatttccattctatccttcctaactccaggacatgagaaatttctcataaggttgtagaaagagattgtaactttaactctacaatcataaggttgtagaaagagactgcctcctttaactttaccactctccacattggcatttactctaggagaggagatatagaggtttgtgctcttttaatattttgtatttccacattgctgattggggaaatccttttggtgactgatacctagagccttgaaaatgtttatacattgttgagaatctttcctaaggagctaaatggaaaaattctatgcccacagatgtacttagcagtattattaataatagagaaaaattagaatacatccaaatgttcaattataaagaacaagttaatgatgtatatactaggtagaatatcatgcaaccatttagaaacttctgaaggctgggcatggtggctcacacctgtaatcccagcactgtgggagaccaaggaggccaaggggggcagatctcttgagctcgggaatttgagaccatccttggcaatctgacaaaaccctgtctctactaaaaaatacaaaaaattagctgggcgtggtagctcgtgtctgtagtcccagctactcaggaagctgaggttggaggatcgcttgaagcctgggaggtggaggttgcagtaagctgagattacactactgcactccagcctgggagacagattgagaccctgtctttaaaaaaaaaaaaagttcacgaagaggcgcgactttgataaaatgacaggttttaacaagtgggctatgtaagttatttaagaacatagtactgtataggaaaagcactatatgggaagaacatatgtatttcttctactaatattgtacataatagggtaggtagggtcatgaaattttatttaaatttatgaggagaccaagccatcattttagctctcatatcttcctatgaaatggtaaaatatcccgcccaaaaatatctttttgcttatacttaaatgcatttatttttctatcttgaaatgtttgtttttaactttgttttaacccttgaacctataggggtttcctgcagaatttgcgatgtacttaaactattgtcgtgggctacgctttgaggaagccccagattacatgtatctgaggcagctattccgcattcttttcaggtcagtttttaaggtattttaagattataaactctgtgagggaaattggttaaatttacctaacaaattcattctgataaatactaaagtaaagcagatctagctaacatgaataaaaggtttcagaaactgatttatttgggactaatttggcatttttctatttgtagtgtaaataggtgattttagtttggagtggatagagagttgaatcatactcaaagtagaatgtaacttttccagaatagttataattcatattagatataagtggctgtcagtgccttctggaactctccaactttgtacagtaccaaataaaaagcaattaaaatatcacatagtcatggagtctgatcaagtggtagcagtcctaaactagggtagggttccttaggcacaacccagaactggtcttgaaaaaggggggggaatagattacatgtggctcaaactcttagttggaagagagtaagaattgaggtaatccgcccaggtacggtggctcacgcctgtaatcccagcactttgggaggccgaggcgggcagatcgcttgaggtcaggagttagagaccagcctgcccgacatggtgaagccccatctttactaaaaatacaaaaattagccgggtgaggtggtgctcacctttaatcccagcgactcgggaggctgaggcaggagaatctcttgaacctgggaagcggaggttgcagtcagctgagatccccccagtgcactccaacctgggtgacaatgaggctctgtctcaaaagagaaaaacaaagaattcaagtaatctgccaggtgcaatggctcacacctataatcctagcactttgggaggccgatgggggtggatcacctgaggccaggagctcgagaccagcctggccaacatggtgaaaccccgtctctgctacaaatacaaaaattagctgggtatggtggcaggcgcctgtaatcccagctactcaggaggccgaggcaggagaattgcttgaacctgcgagacggaggttgcagtgagccgagattgcaccactgcactccagcctgggcaacaagagcaaaacatggtctcaaaaaaaaaaagagagaattcaggtaatcttttaaccccagaaaagtgtcttccccaggtaccagtcagacatcttattcccaaacttccagttgaatatttactcttacttgtttttaggaagtacctcctcttatgagtattcccctagataactgacagcttgatttcatgtttcagttttcatgctgcctttttcatctataataagaaatattttagaagctgccacacttgaggaaatattcgttgtgtaaagaaatgctgtcactgtcttaaaaagttagtaggttatataactggactctgttattaaaggattaacataaaatattttatgtgttccaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggttagtagccaagaaccaagtgacgttacagggaaaaaattgaatacaaaattgggtaattcatttctaacagtgttagatcaaggaggtggttttaaaatacataaaaatttggctctgcgttaaaaaaaaaaagacgtccttggaaaatttgactactaactttaaacccaaatgtccttgttcatatatatgtatatgtatttgtatatacatatatgtgtgtatatttatatcatttctcttgggattttgggtcatttttttaacaactgcatcttttttactcattcattaaccccctttccaaaaatttggtgttgggaatataatataatcaatcaatccaaaatcctagacctaacacttgttgatttctaataatgaatttggttagccatattttgactttatttcagactaacaatgttaagattttttattttgcatgttaatgctttagcatttaaaatggaaaattgtgaacatgttgtaatttcaagaggtgagtttggcattacccccaaagtgtctatcttctcagttgcagagcatctcattttctctcttaaatgctcaaataaatgcaaagctcagcacatcttttctagtcacaaaaataattcttttatttgcagtttacgtatgatcttaatttcaaaacgatttctttgtttttggcttgatttttcacaatgttgcaaatatcaggctcccagggtttaatgtggaattgaagtctgcagccaggccttgcaaattgaaggtaactggggcaaatgccattgaaaccgctagtcttatttcctttctacttttctttggcactcttactgcctgtaaggagtagaactgttagggcacactgttgctatacagtttaactcccattttcatgttttgtctttcttttcccatttctggggcttacctcctgatacctgcttactttctggaagtagtgggcaagtaagatttggctcttggtttctaatttttaaatttctgaatactgccctagtctgaacttggcctttatagattaatctttgcttcacatttttagtgttgtatttaaactattttataatttaaaaatagattctaatctgaagatacttttcaagaaatattattaactgatgtcatcctcatcccagcagctcatctgttaggaatgaagttgagatgcttctattccatgtttttgtatttgggaaggattcaaagttgaaggtttattgtcgttgggtttttcagatggtgacatgtaaactcaggatagcaaaccctaatgttcacacagtgctctgcctctgcatctcagttgggatagttgctccttttgagtgttttaatcatcgtataactaatcatagtgccaagaagttcataatgtgttatgtagctaatgtcactgaaaaacagtcctaccattttaggtaagaccaaacagagtctctaacccaaggacttgttacacctgacaacctatagtatatttgctttttctcacaaaatgaaaccaattttgccgaaagctagctgggataataggatcatcacaagttgcagtttctataactaaaattagattgaaatctcttctgacctagaacattttacttcaggcattcagcagatttcagaaagaattaccttattttaagttagtttctttgttagtttactgtgtgtctcttattcaataaacaagcagaatttgtgtcctgccctatccatgtcttaaagatgagaagttggatccactgagttagtttcattggggcgggggaaagaactgtaattaaacttgtttaatccttattttgtattgtagctattttttgtaaaagcaacttaaaatcttttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttctttttgctctttgacatcttgaaaacatctgtttttcttttttaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccactatagtggttctttatttaaggaataactcagctgggtgcagtggctcacgcctgttatcccagcactttgagaggctgaggcaagcagatcacttgaggccaggagttcgagagtctggccaacatggtggaaacccatctctacaaaaaatacaaaaattagccaggtgtggtggcgtgcacctatggtcccagctatttgggaggctgaggcaggagaattgcttgaacctgggaggtggaggttgcagtgagccaagattgtgccgctgcactccagcctgggtgacagagtgagactctgtctcaaaaaaaaaaaaaaaaggaactcatacagctcaatgattcattgatcccaataataaatcgttttaataatgatgaaaacatcctactggggttttcttgttaaaaactttaggacaggcgcagtggctcatgcctgttattccaacacatttgggaggctgaggtgggagaattgcttgaccctaggagttctagacttgcctgggccacatagtaagaccctgtcccagctccctccaacatcgtccccaacccccccccccccaaaaaaaaaaagcgccaggcgcagtagtgagtgcctgtgatcccagctgtgttgggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagcttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtattttaaaactccagaacgtcagaaatgtgtagcagaatgaattctgttataaggaagacaaaacaattcagtctgttttttaatgcagtttaggaatagtgtatacctcctatacttaaaattgtcatttatctttcccaactttaaatactcttttagtttctatagggaaggaagagttattacaggttttttttttttaattattctttaactttagatactgccaatctgatttaaaattctccaagcttaattctgtgcaacaaacagaaccacacaagcagccaggcactgtggctcactcctataatcccagcatttttgaggctagatgggaagatcacttgatctcaggattttgagaaccatccggacaacatagggagacctcatcgctattttaaataattttaaaaagaaaagaaaaaaaaaggccgggtgcggtggctcgcttctgtaatcccagcactttgggaggctgaggcgggcagatcgtgaggtcaggagattgagaccatcctggctgacacagtgaaaccctgtctttactaaaaatacaaaaaagtagctggggccgggcgcggtggctcatgcctgtaatcccagcagtttgggaggccgaggcgggcggatcacaaggtcaggatatccagaccatcttggctaacatggtgaaaccccgtctgtactaaaaatacaaaaaattagccgggcgtggtggcgggcgcctatagtcccagctacttgggaggctgaggcaggagaatggcgtgaacccaggaggcggagcttgcagtgagccaagatcgcgccactgcactccagcctgggcgacagagcaagactccatctcaaaaaaaaaaaaaaaaaaaattagctgggcgtagtggcgggtgcctgtagtcccagctacttgagaggctgaggcaggagaatggcgtgaacccaggagacggagcttgtagtgggcggagatcgcgccattgtactccagcctgggtgacagagcgagactccgtctcaaaaaaaaaaaaaaaaaaagaaaaaaagaaaaaaaaccccacaaccatgttataggaaaagttagtataaatgacatagcataattaatatattcaaaataacttttaaaaagttgtcttgtagcttgaagggatcctaaatatcaaaagcccatcacaaacttacaagccttactgctacgtaaatatccctttgaactagtttctggttctatttaaaaagtcgaaaactgttgaaattaatttacgaataagaacagatacacactttgtggggaggctgaggtggtaggatctcctgagcccaggagttttaagtccagcctgggcaacataacagcaagaccccatctcaaaaaaaaaaaagcatatcttttgtttatttttttaatagacaaagtctcactatgttgcccaggtttatttggaactcctggctttaagtgatcttcctgcctcagcctcccaaagtgttagcattatagatgtgagccacctcgtctgggccagagcatacattttagatttcagattgggtggcgggcagggatagaatatccttgttagttatataaaaataaacttttttttgctttttgcagatttgaaatttaattaagctattaacttcttaatcatcacatcctccaactctgttttaactcccccctccccctcccctttttttttaaggaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaacttttcctgtattttaaaattgaaatttggtcacagggtatagtcagatttttattaaggtttggtttgacaacctttaaaagaaaggtttacctcgctaatacttcttaataacatgcatcaaatgatattccctatggtgaagtatattctcaaagttatgttatctttcatttttggcatttggtgcttatggacttagtacccaggcaacaaagatctattatgcacctactctcttgtatgttcgctattatttcccaaaaaaaaaaaggggcatatatgcataagaaataaatattagaattattttgtttctcccacaaagcccatgggagatggcccaacaaatgtttaaaaagtaaaagaagctgggcacggtggctcccacctgtaacccccacactttgggaggccatggcgggtggatcacgaggtcaggagtttgagaccagcctggccaacacagtgaaactgtgtctctactataaatacaaaaattagccaggcatggtggcaggcacctatagtcccagctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccc

SEQ ID NO: 36875 - DNA, 6370 bp, Homo sapiens
gggcggggggcgcttcctggggccgcgcgtccagggagctgtgccgtccgcccgtccgtctgcccgcaggcattgcccgagccagccgagccgccagagccgcgggccgcgggggtgtcgcgggcccaagtgagtggctgtgaccgtccgtgggggagggcgtgggccggagtctcggccgagtccgcggcagcgtagcgcccacagaggcccgcgctcctcggccttcgccgcaggggcgcggggcgggggcggggtggccggggcgggtgggcctgggacccgggcctgggacctgggcctgtgaggagtcggcccccagccctgggaggccccgaggcccaagcacggtcctgagcgggcagtggcgggggctgggctcgggctcccggtacagggagttgaggtgccgcgggcagaggcccctgacccgtgtccaccatctcgcagccccaggatgctcccctgcgcctcctgcctacccgggtctctactgctctgggcgctgctactgttgctcttgggatcagcttctcctcaggattctgaagagcccgacagctacacggtggggacagtgagggccgctggcctgggacaggaagggtagggaggaagagaccgggacccagggtgactgctgccggggaagtcttcctcccctggctggtggagagctgggggccattgtttggagcaggccggagggtggccaggctcaggccctagtcttggcctggccagttggaggagatcttagggtgaccactggccacttctggttcccttccaggaatgcacagatggctatgagtgggacccagacagccagcactgccggggtgtgtgtgcctgggggaccaaacacccccaggaacccggaaagggattgatagctgctttccaagggacagccccacctccaagaactgccgtgggagcccagcagcccgttctatgcccagctctgctacacagaggccagctctggctctctggaggccagttgagctaggggtggcctcatcctctcccagaaacccaggaaaccttgtccctacccctcagaggagctggatcctgtacgccttctctgaaccactctcctgtcccagctctttgtctcatcacaacctgggagggtagcgtccccaggggtgggtaaggaggccccccatcttgggctgagctagggctagggccgtggggagggatagagacccacttgcaggccgagaatgagggcaacagtgggaacagctgccccatctccagccttggccaaccctggggaggggtcctgagcaggcagacttagcttgttgagcagagtgggaaggctttgctggggccacacatctcagagaaggccgagctgggttcctgcctccgctccctccagggccagcccaggagactggctgtgcccagcaggcccctctctgcagatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtgggtgagtggggactgctctggtgcctggcttccagtcctctcaccaggcgtcttaaactcagacctcatgttcctccccagctcaaaagggccactggtgatgtccacaccctcatccagacactcatgttgtttaggacctgccgcaggtggccccagcttgtgtgccactgctccagccagctccgggcccctcccctcggttgctgcagagacactgcaggaagtctgccttccagtgtctgtcccctgggagccacaggccttggaggaaggacagtccaggaatcagtgttgctggggatgtttggacaggaccttatttcctgtgcaacccccaacatgtggttttagaggttaggggtgcctttcctgatggctccaggctggtgaactcttacgcgtgctgttgagagaaccgaatacaagtgttggaactatctgtcatgttgggtggtgtgcgggatcccaggcaggggctgagtggtgtctctcgcagatgtggacgagtgtgcccaggccctgcacgactgtcgccccagccaggactgccataacttgcctggctcctatcagtgcacctgccctgatggttaccgcaagatcgggcccgagtgtgtgggtgagtccaggaagcagcttctgtagtcccggctttgtgtccctggtctggcccttgccctagcacctgacccccattcaagccaggcttcacccccggcccctgccacctcaccctccgtcatcagacacagaggactgtagcggggagtgtttgggaggtgtcctggctgaccctgcctaattcagctcctcggacacaggattatgggtggtgaagccttgagtcccagccggctcgagcccacctgccctctgccctctgccctccgccctccttctcctgcctctatccctagacatagacgagtgccgctaccgctactgccagcaccgctgcgtgaacctgcctggctccttccgctgccagtgcgagccgggcttccagctggggcctaacaaccgctcctgtgttggtgaggctgggctgggccaggctcctgggtcctgggcagggaggtgtgaggtgggggcgctcccttcttgaccagcccaggtagagtggaggctctgggctcctcctccgctttcatccctcctgtttttcctggcacccccagatgtgaacgagtgtgacatgggggccccatgcgagcagcgctgcttcaactcctatgggaccttcctgtgtcgctgccaccagggctatgagctgcatcgggatggcttctcctgcagtggtgagagctccatccctgctgtgtactcctctgtggacccccaggccctagctatgccgtgcctcctgccacacagttctccatttgaggcctccgcctcctgtcactgtgcacccagctgcctcctgggtactcgaccccggctggctgtggagcactcccaggctagtgggggaggcacaaggagaggcagctacgtccttactgaagcctactggtgagactgaggatgtgggtgccacctgtcccacatatcaggctcacctgcatttacctgcatttgaattttgcactaggacaagtcactcctctctgagcctgtttcttcttctataaaatgggttgtcttgaggattaggtgagagtgtgatagatgggctccagcaagtctcaagctgcagtgctttaaagtgaatgaactgccacttaatgagaacctgccctcgtagtgtattccctgacacacttggcctccttcctctcaagaatcctaggaggtatgattttctccttcctctacaaaatgaggacattcatatctccctccacgtttgttgggaggattacataaaaataatcacaaagtcctgggtaaatggtgactttcatgattcagctaagagaggttaagtgacccgcccaagctcatacagccaggatgagatggggccagggctggatcccagacttcttacaccctgtaaactggcatgtaccccctatgttatgctttgctgcgggatgaggcctcactgctacctggcagcatgaggggaacaagagaaaggaaatgttctgcctgtgaagctcacagttagttggaggtgaccactgggtgctcaggttgactgtgggttgcaggaattgggcgttacagcacaagccagacccataagactcatctagtctaacacactcattttactgattgggaaaatgagattcccctagatcagctggtgggattcacacccaagcctctagattcccagtaacttatttagtgtttcttccagttctgggcagagagaagtctgtgagctgcggcagcctgggcaaactttctttgaaccctccatctcccggctgaacttgtggcttgtctcatccccctctgtcttcctacattcagtctaacatggggctgggccttcttgggaaatgtttgtgggactgaatggtgaggaatgcccttgacccggggtccccatccccatgcttcctcagatattgatgagtgtagctactccagctacctctgtcagtaccgctgcatcaacgagccaggccgtttctcctgccactgcccacagggttaccagctgctggccacacgcctctgccaaggtacaggttgcccgggtgggatgggcaggacggtgtcaggagctggcagcctgacgcccccgattccagcccctctcccctggcacagacattgatgagtgtgagtctggtgcgcaccagtgctccgaggcccaaacctgtgtcaacttccatgggggctaccgctgcgtggacaccaaccgctgcgtggagccctacatccaggtctctgagaagtgagtcaattcgatgccaggcccccacagaaactacgtctcccagggggctttggggctgactggcatctattcagaccagcgagtgcccctgagggatgatgggaatcatagtccttcatgaaaaccagtcacaggggtagaagggtccttttgggattccctccctttgtagggtaggagaaattggggggacgggcaaggagctcatttgtgtcccccacctcggggtctctagccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattagggtaaggtttctgcaaccctcaactgacatgcacaatctaaaactgaactccaggacgccttaagggggaactcggccaggctgctatgccccacccctcccccaaagccccgcccccggaggcggggtttctgcaggaagacgggggtactctaaatgcaattctaacggttaaatgcaattctaacgaagcactcggacacgggagtttgagtcctggtactggttttccatattgatctcagtttcttcacccacaaaccaagggaatggcgtgtgcagggccctggggtcagaaagtccactccttgctagtggatctgttaggtgggagggggccaggggcggctcacagtgagctgctcacagtgactggcagccgcatgcatgggtctcagcaggagaaggggtttgtctagtaccagcccttctctttctttttgaaattgaatgctctgaagggagtctgctcactttgggtcaccaaaggtcccaccagtcccaagagccacatgtggccttgaatcgtcagttagcctgggtcagacagagcaggctggagagggtgagaagagccccagcaggagatttctgagggcaggagcctgggtggggaggagagacatcgagggtgtcaaagagctgcatgagaggctggggtggcagcctggccagggctgttcctctgcctcacggccacggggcagggaggtgacgctggggcaggggcctagcacacaggctgacacaatatatatgtccccccacccactgccctgcagcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgtgaggggcagaatgagaaaggcaataaagggagaaagaaagtcctggtggctgaggtgggcgggtcacactgcaggaagcctcaggctggggcagggtggcacttgggggggcaggccaagttcacctaaatgggggtctctatatgttcaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactggactgtt

SEQ ID NO: 36876 - DNA, 14208 bp, Homo sapiens
gccgccgtcggcgcgctgggtgcgggaagggggctctggatttcggtccctcccctttttcctctgagtctcggaacgctccggctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacggtaagtcactccctacgtttccacagcccggctctgctcagccttctcatgctctcccctgacgcctccaccctttccaccgccctacaaactttttgcaacttgtaaaaatatgtcctaatttgtaaagatctgtagccttccccactagtttcccctcctctttagcccacttccttatcctggcttatgggcgttgctaggctagagtttcttatacaataatacagaccgtccgaaagggagtcctgggcctcagctaagctagccaatctcctcatcctagccctgggcagtgtccctttctcgctgttgcctatcttggcttagtaattgagaaagaggcagccccttccaccttaggatggctgtcactgttccagcctgacgacctggagctgcagtttgctgccctgtacctctcatccactggtgctggttctccatgcttgccttctgttcctgccagggcaaaatgtagtacccaacccatagcattccagctgccattgaaaatggtcccagatgagaagggtccctgaagcagaagtttagagcatttgttatttgtcctaaaagtccaacaaacatctagtttataggtttcccaatttatatatttgaatgtaactctttgtggccatgaaagtttataaaaccataatgataactagaggaaatacttggaggaacatcttgctaagcatttgtaatatcttgcaaaacacgctcttaatgtcactgtcagaaatacacacaggtgtccttcagcttacagttatgcacttgatgagcacaaagccacaggcaggaatggctggtccctctcaggaagggaagagtggggctacctggggaactgaaggacaagagaccaagtcctggcatcgtgctgccttgatttggggcaactttagcagttatttgatgctaactaactgctaaatgatatgaggctgtgagttcaagtctcctcaagtgtaacgttttagctgagcctggaatatgtccgagaatgtgctggcctcttacgggggctaggaattgggagttgtggcaactccacttcctaatcttcagaagagcaagactgatgctgcagcatcaaagcagttaatagtgacttccacctgccacaatcttggagaaaagagatgggcagtgcctactattaacaggtctgacctgtaaaagctggaggagaagtaactttatcctatctcctgcctccattactgcttcttacatcttcatgtgctcatcctcagggatgggaagggacacagggtcccaaaggtctgaatatgattctctcctccccagcccagttaactcccttagctacgttctcttctccctggtccccactgtcctcacccttctaccccatcctctgtcagggcagaaactgttctgaattggttacactttgagggaatgagatagaatattcaaagacgccctcttataaaatgaagtcggactgtgggaggctgcatctcccataccactctgagcaggggagtttatgcaacagaaacgctgtgatgtagaaacccacatggcttatatgcttttgatttattttactggtaggagcttttgattatgttaggagctaaatcagcttttgaaggtcagcactaggatgcagaacatatatctatgaaagaaagcatttcaagttccaccaaacagctttgcattcagcttggggatcagaaactattcctgaaagactgtcttagggtgttgggaattaagataatcagttcttagggttttatctgtcatttgtgagtatatttataaaaatatcccccactatcagctacttaaatagcctgggaatgggtttggggtgataacacacttgtgaaacgatttttagtctctttcctacacgagcaagaggaaaaagttctcctctttgatcatgactgacccattgcataaactgtattttttttaaataaaggtagtggtttccaacaggttgccctgttttcatgtaaattggccttttaccatgagaattccatcgttgccttatgtttttgtaaattcaaatatatgtgtgtggatatagatatagatattgttttccctccctcagttaatattaggccaagggctgctccagagttgccagatagaaggggcttagccacagaaatctggctaaaaggtgttgagggagtaggagctttgctttgaagctgtgtttttatttcaatttcctgtttatggcttagggggagccagatggagactatgaaggggctttagctcccccaaaccacctctaagcattgacactatcagcaaactgcttttgcttctggcaaagattcccaaagagccggagaaaatcctagtgtgaacataatcagaaagccagcctccctgacttccattgttggagctaccatgacaccatattcagatgaactatacacaaaatggaaattggaagcattgtcacctcttagtaagaaaatttatattgaccactgatggattttattttgtcaatagattattgggaataattgctagtatctttcacttacatagcactttaagctttatgaaatgctgtactatcttgatttaagttatttcttgaagggcttatctgaaaattcaagctcatggctactgtttggttcatacattctgctgttcagaatccttggcatgtgcctccaggggaggttgctttttcctccaagtccttttattctacttggcccacactaaaattgtggtcagaagtggcctataccaatctcccacctgaagcaggaatcatttccacatgtcctaacagggggctctagaagcaaaggtttatggttgccttcagaaatgtttctgtttctctaacggagtgcacatgatctgatagaaatacagtgtgaaccacaaatgcaagccacaaacggaattttaaatgttctagtagtcatataacaaaaagtaaaaagaaacagagaaaattaattgaattacatattttatttaacccaatatatctaaaatattatcaattcaaaatattagttatgtaaaataattattaataagctattccaagtaagtttcttccttgtatcccagaaaatagtagcaatctactctatctcttcccactccttcctcaggataacaagctgctttctttgtccctcaaaagtggaccaaaccactggcaacaaggaggacagctgtacccagtgggacaccagtctattccacagcactccagtagtggacagaggagggaaatgggggaattcagaaacctagaactactaatgtcaggcattgtcccaaggtttgggcaggttggaattactgcttcctccaaagatgccagtctagggcttccaaaattttggaagtaaaactgtagttttttttaaaggcccagtcccttcaagtgaagtccaattcaacctcatatgtcattattatcgaccacaaaatcagacttttgaatgctaacttttgcattaacccattatcttcacagcaccgtaggaaatagtatgatgatttctatcgtacagacgaggcaaatgactcaccctgtgtcccacagctaatgggtggtggaactgggactcaaagctaggcaatttaagcactgagccaattaacctaaccacaacactatccaagagaaagtactcatttcaggggtaacagatgagaagattaatctaagatttcataaaagagctgtgagaatgttataaatatctggaccactttgcctcttaattccaactagttagctttaaaaataaaatggcaaagacctttttcttcatgtcagctcaagggagctgagccagggccaactatgtggttccctttcttttctccacagacctatgaaataaaaggctgagactcagattctaggagattggctaatgtaaatgctggtctaaattaagaaataatcagattatccctcacataaaatctttcatcagaacaaataaaacatctcttaagtgaccaaaaaccatgtggtgtttgggaaatgacattattttggctgcccagtatgaaattctgcatggaaccaacaacatattccaaactgtttattcactaaagggatattgtataaattaataaattcctccttatgttaatcagctttgccatcgttttacagagataaatagaaactttcttcctgaaatggaacagaacacaggaaatatatgagacctctattcttgcctcagatactgtttgtgtcttcatatccaactcatatcaagcccctttctcgccacttttctaattgtggatagcttctggccattttaaactgttttccacatgccatgaggataaagtgcttatgtatttttattcagttctaaaatttcaagagtaaaccattgactcatactaaaaagttctccatctttagaaattctttagggttataacttctaggtaaatctgattagtggaaatctgatcttggcaatacaaaacaaactccagtaaacagtactagagtttccttttcattcctggtactcattatgtaaaatataacatgaatgggggttgaaaagctgatatgacattggtagattatatacatgccaaatataacaattctggtaggaatgaaaaagaactccagacatctctacgtataaccacaatgaactttgcctggtgatagtttaagttaatgtccataaacaactggaaggccctttatcatttaagcatcattaaccatgtgtttggggatcgatgagacagttttaatacacatgatgttttaagagaaagttcctctatatgagtgttttcacttgacgtcttttctcctttgccatttgatattatgaatgctgatttgaataaagacacaattacactggttttaaaaatgtaaacagaaagaaccttagttcttttcccaaaagagaatttgtgcattatgtccacacctttggtcaagtgggtcctcactgctatctcagatggtttagaccaggtcctcagcttaaagagaaacaccttctggagatggtatatttcttctttggcatatcaaaaaccaatcacagtattaagtttaaaaaaagaatagaaatggtgagaccgtgtttcaggaaggcaatgaacaggtctctttccagctagaggcttaagacccagttcatctgcaactcagtctgctcagttggcttctcctgtcctgttttgaaatttctgaccctctactccctgtccttatcttgagctcaagtccattgtacctcagtttatattatcaaggtgtaccaagctccatttttctgagaatattttgctgcctaaaactgcccctaacagaaaactaaacctaagaaccttgcagctgggacatacatgtgatggaaagggccagggatcggataagcacatttagaaaggctgaaagttcctctagagcagggtccataacctgtgctgcatggaaagtgcctggattttctgcctgaattcatttgcaaaaacgtttatatgagtttatgtttatatgtttgtatgagttgtgggtagatggttcatagtgtccatcagtttgtcaaagagttaagagccaccatcttggaataaataggcccagaggtctaaaccttagcatttgctctttttttgtttccagttctgagaagcacaagacaaaggacactagtcctggagccacatggatccagtttttcctattgcaggaaaataggcttctgtttccctctaccacaaagcacctgtgattcaggcaaagggacttctttaaagcatcatatacctgaaaaataatctccccccaaaatgtttttttttaaagaatgaattaggcaaagtctatagtcaggacaccttagtgtctttcagaaggcaggtaaacatataacaatctatgcttgcaatttagctgtggaaaagtgtggaggaaaaacaagtcccagagaaagctaagtagctacttagaaatagccatggtttttcagtccataaacaggaaccatgatatccataaacttttgaagagaaatctttgaagagaaatctcctccaaacccataatgtggtcagacatttgtgaatttcatgctaagctttacattacaggctttttatatagatggcagcagagtgtctagtggctaaaagccaagtttggtgtcccatggattcagtttgactccacattttctctacttacccagactgtaattctatgcaaagtaactgatcttctaaaccttcatttccttctaacataggaataataatacttcgtaggtttatgtaaatattaaacaaaatatgccttataaattgcttggcaccatgcctaacacacagtaggtgtttaataaatgttagctgctatctctaggggattccatttcaagggaaaatcagattgtatattaatggtcaggaaatgaattctgaaagctcaaagtcatttgtttgattgacctaagtgggccttttgtttttaagtgtgataaatgaataattttaaactattccaggttttagataaggttctaaagggatgtctcacaccctggctgcatattaaaattacttggagcactttgcaaaccttgatgcccatggctcagcctagactaattaagttggagtctctgggtatcgggggaactcacccccaatatttcaacttaggttctttctattttccataagtgttggccggctgagaaagagaaagagtacgaagagaggaattatacagctgggccgctgggggtgacatcacatatctgtaggaccatgatgcccacctgagctgcaaaatcagcacgtttttattaaggatttcaaaaggggagggggtgtaagcagggagtaggtcacaaagatcacatgcttcaaaggggaaaaaggagaacaaagatcacatgcttctgaggaaacaggacaagggcaaaatcagaaactcctgataagagtccaacaaagatcacaaggcaaagggcaaaagcaaagatcacaaggcaaagggcaaaagcagaattactgataagggtctatgttcagtggtgcacgtattgtcttgataaacatcttaaacaacagaaaacagggttcgagagcagagaaccagtctgacctcaaattaaccagggtgggtttttttccccaccctagtaagcctgagggtactgcaggagaccagggcgtatttcagtccttatctcaaccgcataagacagacactcccagagcggccgtttatagacctccccccaggaatgcattccttctccagggtattaattattaatattctttgctaggaaaagaatttaacaatatcttccctacatgcatgtcagtttataggctctctgcaagaagaaaaatacggctctattttgcccgaccccacagccagtcagaccttgtggttttcttcccttgttccctgaaaatcgctgttattctgttctttttcaaggtgcactgatttcatattgttcaaacacatatgttttacaatcaatttgtacagttaacacaaatatcatagtggtcctgaggtgacgtacatcctcagcttacgaagataacaggattaagagattaaagtaagacaggcgtaagaaattataagagtattatttgggaacggataaatgtccatgaaatcttcacaatttatattcctctgccgcggctccaaccagtccttccatttggggtccctgacttcctgcaacatctggggaagggagaaatgcctcagaatatttttatgcatgtatgtatgtatgtatgtgtgtatgtatgtatgtatttattttgagacagagactcactctgtcacccaggctgaaatgcagtggtgtgatctcagcttactacaacctctgcctcctaggttcaagcaatccttcccctcagccttccaagtagctgggattacaggtgcccaccaacacgcctgggtaatttttgtattttttagtagagatgtagtttcaccatgttggccaggctggtctcaaacttctcacctcaggtgacctgcctgcctcggcctcccaaagtgctaggattacaggcgtgagccaccgcacccaacctatttttaaagctcctcaggtgatttcaatgatcggccaaataaagccctcatttgctctaaaattctgaacccactttgtaattgcattaaagatagaaaagtagcgcaaaagaatagtacctggtcagtgccaaaatgaagttttctatgggaggctgcttctatacatgacaatgctaaaatagcactaattctcatctgtgccactttgtaaatgtcacaacaaggctttaccttcttaacaaagccctgtagagacagcctgccctgaggaattaaaattcacttgactcattgggattagcacttggtatttttctcataacaaatacattggtagtgcacacaaaaagatggataacttctaccaacctctgaaactgaattgccgaatatcactgacatattattaattaattatcttatatcctttgtgacatcctttaactaaaaactcaggactggccggagggagaggagaatgggcagttattgtttaatgggtacagagtttcaatttgggatgatgaaaataattctggagatggtagtgatggttgctgttctttgttcttttacgtggatgcagtcaagtgcatccacaagaagagacacaggagatgttcaggaaaacacagacatggtggaccactcagggccacatgaaaaagcatcggtttcagtcaggaggcagagaggcaggagggtggggaggacctgggccaagcctttattggagtttccacaagaaaggcagagcagggtaaacagtttaggattggttaggttgaataatttcagcaggctctaagctataggggtggtccctagttgcctggtacctggcattggaatgataaaagcagaggaataaatatttccttgatagaagagttctggccctggataggttagtctgtatatcaaagacatgctcccagcctaactctttgctatctctacaaattagctagccccggaggggcattctctcccagccaagaagaatttaagatgtcaaagcataatatgcagaaaagtgaaaatataaacaatatgattgccccacaatgtaaatgtatttaatgtatagctgaaaatggcaaaatggtaaattttatgttatatttattttaccacaattttttaaaatcccagtatccataagatcaaaaatatagtaatctaggcaaaagacaagaaccaaaagaaaaaaatggggaggtagaagacaaaacttacatcaagaatttcgagggtcactgaagtatgtctcttctccaagtataaaagaaggaactggctgggcgcagtggctcacacctgtaatcccagcacttcgggaggccaaggcaggcagatcacttgaggtcaggagttcaagaccagcctgtccaacatggtgaaaccccatctctactaaaaatacaaaaattagccaggcgtggtggcgggtgcctgtaatcccagctactcaggaggctgcagcaggagaatcacttgaacgcaggaggcagaggttgcagtgagtggagatcacgccactgcactctatcctgggcgacagagtgagactccatctcaaaaaaaaagccgtcttctacaaaatattggtcacctccaaagtgcaaattttaagcaattctcaaaattacccagcatagtagatgataaaggaaaggaaacagtacagaattgcttcatcctctacaaccaattttcacttctcattattctgtcacgctctaaagacattcaggaactctgatgtgggttattctcccctgaaaacctgactcatcttaatgtgtgaagctgcaacaccagaggctatgccttttctgcacttcttggctggccaattcagtgtgaatatgttctctggttaaactagatcatcaactcagctgcaggccctttctacaggagtgctcagttatgcatcatgtgcacacgtgtgtgtgcatatgtaatcactaatatgtgttttaatctgtagacctatgtgcatcattatcctgaatttcttacctccaaatcactcttttaacacaccagcctgtgtagttttcatccaaaatagtttaactgacaagaaagctattgctccattgcacctcctcacctagctttcctctactctctgggaaacccaccatcaattcttctttttccttactcatctgccaaatcttttctccattccctatgccaagattctccggcataaacacctatggctgccaaaccttcctgctcttgtcccaacataagcaaactgaagatgactaccctttgcgctctctgcaatttgctttgtatatccagttgccagatgcctgcagagtaagtactcagagaagggaaacaagctgctccttcttctgcagaaggcgagtgaagaaaagaggggctaggtgtctaaagccattggtaagaaagaccctggagccttataaagcactggttttaaatgactaggtgtgatctacctttgttttcctcttttctgtgaattttgtagaagtgtgatctttatcaagatgcattattccattccttccaacctgcccaaacatttatgttgctccctaaataactaagaaatcgtttgagggctggtagagcagtttggtccatatgtaaagatgtgtcagctttccagtgttcaggacattgttctgaggcctttgctctaatacaggcctgcacgtagcacacagtgagcactgcactggcatcaggagagttggaatttgcatcctgatttggccactaaccagctctgggtacttgagcaaattatctaattttctataccccagtgtctgcatttgtaaaatggatataataacaatgaacactgtggagcacttaggatgtgagcactgatctaagtagcttacacatatcacttcctatcatcctttcagcaactctatgaagtgggtatgttattattatcacccattttaaagatgtcaaaactgaggcacaaaggttcattattaatatcttgccattgatctcaaactatatacagaggtaggattcaaacccagtccaatggccagaactcatactcccactcagggtgttccattgcagaccctgtctcgctgaattgtgatcattagatttagtatttggaagtaaatgtaacatgttattagttttcctgaagttcacttccctatctgttaaaaagagacaatctctaagtttcagagtttctataaggagtagagataaagcggggttagtacccagaacaattcatgacacatatattaggttattgatacactggagctactaatattatcattattatttatattgttaaaagattctattctagatgacaagaaaagtttatttctctccactcccaatgacaccaagacattgtgcatggtgttaatgttaattgcattccacagaaaacatgctttcattgagttcaaggggaaaaaatacattcattatgttacagtttacataaggaagaaaggtaagattcccaacccccacctttcgttccccaccactaccacagacaaaacatggttttgcttttaaatctcaagacataacatagggtctaagcctgtctactgctacgatgtaaaactaacatcatttttcccctttgcttcttacagatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccttggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcagtgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactctttatttatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttagggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaacaaaaatttg

SEQ ID NO: 36877 - DNA, 14750 bp, Homo sapiens
gggggaggagggcggtcgtccggggttaggttgagggggggcgtcggtccgttctgggcgggggatgactcacagcccatcccatctcccagacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcaggtgcggggccgcctggggctgggagtgccgactggggctcccaggggcctgatctcgggggcagcgggggccccggactgggattggaggccctcggcctagccttggaggacgtcggggcgcccgtcttgggggggcacctaaggaatccggcagtggcctgcttggattgtggctttattaaaggagtcgtgggagtgcattaagcggggtctgggtcaggtttggggagcccttgactgcgtctagcggggcctattctggagtatccagaaactggtctgagatagctgaacttggtagacagggtctctgattagaggctgaattcggggattttcagtcggacatgaggggaatgaatttgaggggacactgtcaggtgaggcactggttttaagggaatcctagaatcttttttccctcagtgtgggagaaggggtcctgagggacagaagtgctgtcttgggagcttggtgcctctcagtgactggttgctgtgtttggggataacatgaatctggagggatttggaggtatctcagatatgctgcctgggaccagccttgtgagtgcgtgtgaatgaacaagagaagcaacattcagcaagacttgaccagaataatcctttcccctctgcccgcctacccagctggggcagatcccaaggatagtggaaaagccctcttcccacacctgttaagggcctgaatggaagatagacagccaggcagagggcgatgatgttacctcttagctcagaggcctcagaccttgtttgggaacccagaggaggctcttgttcatgctgctactcgctctagcctctcagcccttcccactccctagccccacaccccttttctttttatcttcttttcgatctccgagctcctgggggtaatcttgaatctgtccatagagctggaacgagtacagattgcaccatccctgcctgggtggatcccctctggcctcttctcatccttactttcatcaatgggctttggagccccagccctccctgctcaccccagtgcccatctcttccaacttctgtgcaatgggtgtgtgagccctgggtggggggggtctttgcctcctttgtgcctgggattgtgctgagctcagtggcttgcccgagcttcctcttcccaacttcctgggtggttttagggctccatctgagggtgaggagaggaaggaagacagatccttggggaggggagaggattcttgtcaagtgaagtcaccagcaatctctcagcattctaaatgtttagctaaattgaaggatgcatattcatccacgtgtgtgttaactgtcccttgctctctggggctgagcagagcctttctgtatatcgattcaccatcttctaattcctctgtaacaacctagatcatcgcagtagtggacatagttaaagggatgggtgtatatggcttcttattttgtgcgccagtgggtgttagtgttgggggtgtgtgtgtgttttgatctatccaaaaaaacaggagaaggctgggcaggctcctccggtaagaaaagaatgcttgtataaagtggatcaaccacccaaattctccctcttgtaaatccagtctgttggagcgaggggagcctttgatatttctattttatatttaggcatgtgttggcatcccatgaactctggctggggctgggagaaactcatttgtgaaatggtagatctttacgtcaagtgaattatttccagttctctttgtgatgcattcagtttgtgttacaagggactgttatgctgagggatgcccctacttgctctgtgtgtgtgtgtgtgtacacacatatacctgggctcacattcagctgtaaagaaaatagcagggggttggccgggcgcagtggctcacacctgtaatcccagcactttgggaggccgaggcaagcggatcttgaggtcaggagatcgagaccatcctggctaatatggtgaaaccccgtctctactaaaaatacaaaaattagccggacgtggtggcgtgtgcctgtaatcccagctactcgggaggctgaggcgtgagaatcacttgaacccaggaggcagagcttgcagtgagctgagatcgcaccactgtactccagcctggtgacagagcgatactctgtctcaaaaaaaaaaaaaaagtagggggtatgggggctgggagaactctgaataggaagtcaggaatccttctataaagtgaattgttattcctaaattctgttttcctcaaacccaggttgttacagtgtgggggttgggatgcaggcgttcttattattctgactcctaagggactatgagtaacacagtggggaagggaaagggggatgggggaaggaggtgggaattcatggtggtgtggtacccagcaaggtggccaaatatgaggggcttgtaccctcctcttcgttctcccccgctctctgtctctttctctgtctcaggggagggctggggaataaggtccttcattcaatcactgaccaccactccacctccccctcagcctgaactctttgcttccggaatccgggattgttgctgacatagaattagaaaacgtccttgatcctgacagcttctacgagctcaaaagccaacccttaccccttcgctcaaggtatgtatgacttgtctatctgattcccctcccaattcctcagccctcctctcccctcttgatgggcagaggccctcagtaccagcccaacccattctttcaccagcctgcgttttctagtggtggtaaaattagggaccagaaagagcatgtcacacaggaaagtaggtggccaagctaggattccagtatctctgtcaagacctcccctgcctgcccccagcccacctgcacacccattcatatgcaagtgtttcagcctcaggtgttccagccggcctggagtgctcagagatagggcgtggcctgcttaaactcatgtccccgggtgggcggggacatgcctctagccccaactcagtcccttcccacactaccaactcacccaccctcagcccttgaggagcccctgctggtctcttctttccccaagcttggaagtctaaatgtgctgagtcatcggcccgggctctgagagaggggaggggagggggaagaggggcaggaagagagtattgtgaaatctccgaggttttcaagactgactagctcctgggaccagaggcccaggcaggggaagaagaggaacctggggcttctcctatcacctgacgcccacccccaggagctcagagagcttctctagcctcacattgggcttaggagccctctgtatccacattctgctgccaaagcctcaattctgcttcttctgctctcctgtaaataggacaaacccccccttgcagagctgaacaatagcatctccacttaatatgtgaacaggctcaaatctaggcttcaccataaggaccaaaggctaaaactcccccaccagactgacctccagtgtgtcccccatcagactgtgacccctgagagccatcaccaagcctggttcctgtgtctctgcttctacattgtggcctcggaaggcagagaacaggcctggttcctgtgtctgctccgtcacgctaagaccctttaggcttgggatgagacttttagcttacctaaaatatggccccatatttcccattccacagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtaaggtgagatccagaggccctgggagggggctcctggtgactgaggagtgatcctaggagctagggatggcctcgatgcactggtgatttgggggcaaggtcttaggggctctaaggaaggtccctggtactgtttaaattatctgtgttcatgtctcatgtgttttgggtttctgagatgatcttgtgaaattgcgaggagttcgtgggggccatgaggatgtcttggtggaccatggaggctcatgagtgccccaagtgggccctggctttgtaggaagagcttcatgtgtgtgggatacattagttctttggccattagggggtcttgggaagcattgtatggttcccaggtctattaggtggtgtcagagactaggtggggaatcttggggactgtgacagggttttccagaaactacgagggatcctgtcagtcatgggtggatcttggcagctgtgaaggatttctgagaaagagagtttgggtcctgggggagactcgctaatatttttggggtgttctcagattctgggcccagcttgtctgcgtgagtctaggcaccaatgagttaggagggtcaggctggggctcagaattcacccctttgagtcctgttctgccttgtcccctctctttccttgtctaccttatttcacaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggaggtaagaggctacagccaaacctcctcccacattcccctcccaaattcttctaaacctgtataatatttacttcttcccctagattgatgatgtcattgatgagatcatcagcctggagtccagttacaatgatgaaatgctcagctatctgcccggaggcaccacaggactgcagctccccagcacggtgaggccctgagatgggaggttggtctgaaaattagggcatttctgtatcaccaagaccatactcagtctggctgtgtgtataggagacccttgccttgattgtgctaagatagagagggaggccttatgacgagaacagggtatgtcaacaatgcctttggaccttgttggactgtgttgagaggtggaccatgtagactgtgagagatacaggtggggagttcactgagacagtagggcatatcaaagtgcttgggctttgctgtgagaagtaccaagagatgataatcttttttttttttttttttcgagacggagtctcgctctgtcacccaggctagagtgcagtggcgcggtctcagctcactgcaacctctgcctcccaggtccaagcgattctcctacctcagcctcctgagtagctgggattataggcacgtgccaccataccaagctaatttttctatttttagtagagacggggtttcatcacgttggtcaggcgggtcttgaactcctgacttcgtgatctgcctgcctcggcctcccaaagtactgggattacaggcgtgagccaccacacccggccgagatgagcatcttatagcaacttgaatgtaccaagggattcaggtcatcgggacatatacaccagaccatgtaatgattggagcattttgttttattttatttttaccttttttttcttttaagacagagtctcactctgtcaccctggctggagtgcagcggtgcgatcttggctcactgcagcctctgggttcaagcgattttcgtgcctcagcctctcacgtagctgggattacaggtgtacgccactacgcttggctaatttttgtatttttagtagagaccgggtttcaccctgtgagccaggctggtcttgaactcctgacttcaagtgatccacctgccttggcctcccaaagtgctggaattacaggtgtgagccaccacacctggccttgaagcataacaaaagttttcaaacttgctgtgggttataacaagtagttggatctcgtagtgattggaatataccaagtgaactgtgccaggaggcagagtccttctagtcagtagataaaactttctagagcaagggatataccattgtaacattctggttttgaacactccaagagtctcataacttgctttattatatttatttatttattttttgagacaaagtcttgctctgtcacccaggctggagcgcaatggtgctatctcggctcactggaacctccgcctaccaagttcaagcgattctcttgcctcagcctcctgagtaactgggactacaggcgcgtgcccccatgcccggctaatttttgtatttttagtagagacggggtttcaccgtgttacccaggttatctcaatctcctgactttgtgatctgcctgcctcggcctcccaaagtgctgggattacaggcatgagccaccatgcctggcctaacttgctttatttatttatttttttttttttattgaatttttttttttttttttgagatggagtttcactctccttgtccaggctggaatgcaatggtgcgatctctgctcattgcaccctctgcctcctgggttcaagcaattctcctgcctcagcctcccaagtagccgagattacaggtgcccgccagcacgcctggctaatttttgtattttagtagagacggggtttcactatgttggtcaggctggtctcgaactcctgacctcaggtgatccacctgcctcggcctcccaaagttctcggattacaggcttgagccactgcgcccggcctatttatttatttttgagacaggatcttgctctgtcacccaggctggagtgcagtggtgtaatcctggctcactgcagcctccaccttccgggctcaagtgatcctcccacctcagcctcccaagtaactgggaccataggcttgtgtcaccatgcctggctaattttttgcatttttagtagagacagggtctcactgtgttgcccaggctggtctcgaactcctgagctcaagccatctgcccacctcggcctcccaaagtgctgggattacagacatagccaccatgcctggtctcataacttgctttagagcataccaagtggctgtagttttgcttttttccaacttatcaataggatggaagcatgtataaaaatgggactaatttatcagaactttttattgatttggacacaactagagaatgggaccttatatccaccagactggaagtgggttcaagagattaaagctcagccaggcacggtggctcacacctgtaatcccagcactttgggaggctgaggcgggcagatcacaaggtcaggagatccagaccatcctggctaacacagtgaaaccccgtctctactaaaaatacgaaaaaattagctgggcgtggtggcgggtgcctgtagtcccagctactcgggaggctgaggcaggagaatggcgtgaacccgggaggcagagcttgcagtgagccgagattgcgccactgccctccagcctgggtgacagaacgatactccgtctcaaaaaaaaaaaaaaaaaaaaaaagagattaaaactcatgaagaagtgggatttggatatactttattttatttgtatttatttatttatttatttatttatttatttattttgagatagagtcttgctctgttgcccaggctggagtgcagtggtgtgatcttggctcactgcaacctctacctcctgggttcaagcaactctcctgtttcagcctctcaagtagctgggactacaagtgcaggccaccatgctcggctaattttttttgttgttttgtatttttagtagagacggagtttcaccatgttggccaggctggtcacgaactcctgacctcaagtgatccgcccgcctcggcctcccaaagtgctgggattacaggcgtgagccactgcacctggccctgggtatacttaagattgacgtgctcctctggagtatatccaggaaagtgtgaaggagaggaaaaaaaaaaaaactaggctgacataaagcagtgctaattgaatagttggataagaatctcctgagagaacagaatgtgcaggaagatactggagtcaggaccttggtccacagcagcaggagaccctgatgtggaagatggtacaacttgatcagagtggaagatggtacaacttgatcagagtgaaagactggagattaggttggaattctccagaaggccagattttggatagaatgttgtcatgacaatttaccaaggtcggagaagattgggttggagtgttccaagaatgctggattggaatgttgtgctgggaggagctaacggactggaatgtcccatcagagccgacaaagacctgagaagggtggttttccagcatttcttctcagagccagccccggggtttgggaaaggggctttagaggtcactgagggatatgagggactggaggaagtgataagcaggccaggcaggctccagtctcccagcgaagcaaggtaggtccagtttgctctgtcctcccctgtttggtcgccatgtgaatttgccttgaaggagaagcaagggttctggtgctgagtcagccagtccttgcattagagggtgccccatctttgggatatgtggaagctcaggaacctggttctgaggaggagccaagcctgggtttgttcccaactggtggttctctgccctctctgcccccagctgcctgtgtcagggaatctgcttgatgtgtacagtagtcaaggcgtggccacaccagccatcactgtcagcaactcctgcccagctgagctgcccaacatcaaacgggagatctctggtaggtgatagggtcttggccccatggccctacactttaccccaggtgagccctgtgcctaccaggtctagagatgggcctgattctgaggggaatggtttggacatatggaaatggaggctgtttgtcccctttccccctatggcttgtggtcttgctttcaccccacttcagttcctctcgtcttggatttaacaaccagcctatcaccatggcttaaaatagtaaaaagaaggcactttttaaaaaaggcatttcccctgcttttggctaccaaaccctaccttagtatctgcatgtgtttcttgccttcctgtgctcagaggccctgatcactccactcttttccagagaccgaggcaaaggcccttttgaaggaacggcagaagaaagacaatcacaacctaagtaagccagagagcgtgtgcattgcccgggtgctgtgcaggcctgcctcaccccgagtcctggccccccatggggaactccttccctgcaacagcctcccaactccctactttctgtctcttccatttttggctaattgacaactctttctcccactctttcttcctctcctcccctctccaaagttgagcgtcgcaggcgattcaacattaacgacaggatcaaggaactgggcactctcatccctaagtccagtgacccgtgagtctgggctgggaccctcaggccagcgggaggtggggcaggcgtcccatgctactaaaattgtgccttggtgggctcaccaggcagtctcggcccaggcatttctcctctgtctggttctttctcagcctgagcagggttgcagaccctcactatgtcagcacctaaaattttaggcacataatgttatggtctgtgtgccccatctggtccccgtaggatatatgcacctacttttctgttcacttagtacttcctttttttttttcttttttttgagatggagtctcacgctgtcacccaggctggagtgcagtggtgcaatggtacttcctttatttattcaagatttatttattggccgggtgtggtggctcatgcctgtaatcccagcactttgggaggccaaggcggggtcgatcacctaaggtcaggagtttcagactagcctggccaacatgatgaaaccccgtctctactaaaaaatacaaaaattagccaggtgcagtggctcacacttgtaatcctggcactttgggaggccaaggcaggcggatcacgaggtcaggaggtgaaggccaacatggtgaaaccctgtctccactaaaaataaaaaaaatttagctgggcgtggtggcacgcacctgtaatccccgctactcgggatgctgaggcaggagaatcacttgaacccgggaggtggaggttgcagtgagccaatatggtgccactgcactccagcctgggtgacagagcaagactttgtctcaaaaacaaacaaaaaaaaagatggccgggcgcagtggctcacgcctgtaatcccagcactttgggaggctgaggcgggtggatcacaaggtcaggagattgagaccattctggccaacatggtgaaaccccatttctattaaaaatataaaaattagcggggcgtggtggtgggcacctgtaatcccagcacttggggaggccgagacgggtggatcacctgaggtcaggagtttgagaccagcctggccaacatggtgaaaccccatctctacaaaaaatacaaaaaaaattagctgggcgtggtggcgtaggcctgtcatctcagctactcagaaggctgaggcaggagaatcgcttgaacccaagaagtggaggttgtagtgagccgagattgtgccactgctctccagcctgggtgacagagcgagactccatcccccaccgccccgcaaaaaaaaaggaaaagagaaagatttattttttgaacctctggtttgtgccaggtaccatattaggccctaaagataccagagggaacaaaacagacctcatgaaactgatgttttagtgggggcagacaaatagtaaataagtaaacatccatgagatccattatgatgagtgttatgagaagaataaagactggaaggaaaatgggagaatgttggggagggttagtttgggataaggaaggtgaggacagggcaggccccaactgacaaggaaacgtttgaataaagagcctaaggaggcaaggcggggagccgcatgggtgtctgggggtaagagtattcaaggcagagggcacggctgggattgatgccctgagatgggagtggttttccatattctaggagcactgagagaccaatgtggctgtagtgagatcaatcggagggacatagggaagagaggaatcctaaggggtcaggtcagagacggcttccagggtttggagtgtgatggggcaccattgtaagattccaggcgggaagttttcctctggatactccatacctttgaaagaccccagcctcaagttctaagcatgtggtgggaggctcccacctggtgcaatccccgcctcagctcctgagaaactcctcatgtggcatttcctgcttgcctcccacttgggccccacagggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggtttgaaaagaggagatggtggtgggggaagagggggagagcttcctgcaggtggaggcagagagagagcaggccagggtttcccttcctggcatacttgggggatccctgggcttcccagatcacacgatgatgatagtgataatgataaataataatcataatattaacaaggataataatattgctaatgtacatagcatttatcttgtgctctgtactgtgacaagagctttatatccactaacttattcaatcctcagaattctatgagataggggccattattttatttatttatttatttatttatttttgagatggagtttcgctcgttgcccaggctggagtgcaatggcgcaatctcggctcaccgcaacctccgcctcccgggttcaagcaattctcctgtctcagcctcctgagtagctaggattataggcatgcaccaccacacccagctaatttttgtatttttagtagagatggggtttctccatgttggtcaagctggtctcgaactcctgacctcaggtgatccacctgcctcggcctcccaaagtgattacaggcgtgagccaccgcgcccagcctaggggccattattatatacccactttacagtttgcgactctgaagcttcagagatgttaagcaccttgcctaaagttttggaactagtgagtagcagaagctgaattccaacccagggaacctacccttttcaacctttatactcctctgcctctgagggactctgaaccctacttatcctgcacccaacccctattttttacaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttg

SEQ ID NO: 36878 - DNA, 2520 bp, Homo sapiens
accacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcggcggaactgctacgaaggcgcctactacaacgaggcgcccagcggtgggtattccgggcctctccctgctcgctcctcctccttcatggagctgtcctggcctctatctaggacgctcccacccccactcacacacgcctatgtcctgggaagtggtgcaggagatgaaatactaagcaagtagctccctgtcttttggattgtcccggactctaactaaagtcctcagtttccaatctgtctcaaagtactgggcccgggggtgggaggcttgtcgcggccccacccctgcttactaaccgagccctccccgcgcagaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttata

SEQ ID NO: 36879 - DNA, 9854 bp, Homo sapiens
gatcaacacatttcatctgggcttcttaaatctaaatctttaaaatgactaagttttcttccttttctctgtttttcctaatagttggggcttatatgactcatgtgtgtaagtatctcctatatctacatgtaaacattaaatgaatttctactgactatattgttatattatagatgaaaattattttcacaatcattcctatctttctgaactgtaatgtattatacaaatttttcatcagtaaaattattgtagcttttaggtagggttattgttgttttttaagctttgaaaataatatagtgactgtcattggaagaattacatgaaacagtagtttagatcttttgtgtgaaaccttttggtctacttttgtaggtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtgagtcctccacacttttccagacatgtgttttttctgaaagttattataggtacaagagaagcttacctctcctgaatgagaatttgatctactgttagcttctgtggttactgaccaactggtggcgtttatttaccttcttccacatccacgctttctgtcttgggttttccttttcagagagaactgagctgcttttcccaggcaagacattagacaaattcaagtcctctgtataatgcagggaacacagcaacagtaatacttgaagcagcagtactcttgaccttgttagatcacactgctcaaaaggaaatcagacaacctgagcttgctctgtgctctgagcttccccattttacaaaggggtaataatcatatcatacctgctttgtgggttttgagaattaaatagtatctgtttaagtattttagcatgcttggcacatttagtaagcacaaaaaaattgcagctattatcattagtattatacgcatgagaagcctactttgccactcctaacagtagctacctaacagtagctactcaccacttacaactttcctaggtggaaaaaaacaagttattgatgacttctagaaagagaaagataatgagagagttattttctaggatacttagaatgaaagcttttctgaagacagagtaaaaccttccaaagtccatttcagcctaggattctcttacttcagctaataaagcacaaaacccctcttgggatgctgcaaccatcacaaaaggaaatgccagtagaaaactaatttggtatttgttgttttgtttgtttgcttgggtttttggttttgttttttgtttgtatatatgtttccttatgtttcttacctaataagctgaaatggagccttctccttttctttcacttaaagatctctcttagctgtaatggtttgctctccaggcattgtctatatctaaacagaacaattgaattgatttgcttttctatgctttgggggttttgtctgattaccccatttaaatggaactgtttgatcacaaattggaagttttgaagcctgcaaactgggagatcttctgctatctctaaatagcaagccactgatttccaatttaatatggttacttcatttacacagggttcttgccctcatagaaatcacactctcatccccatcacttctctcttctccagggcatttgccccctcgagatcagagagacagagtggggaactgtcagcgaatgttcatttgatgcaaaatatgcacatcttcaaatatgctcataatacacattcaaatggtctataacctccccagacacagagcttgacttctaaatgttcaacaaactttggatggaaagaaagaaatacactgaaagatctttctttctttctttctttctttggctaggcctgaaacatggtgtatgaaaaagtgcttcactagccataaagtgttataggaaattaaataatatcactaagttgaattttaaattttgtcaagtggatttaactcacgagaagcggattcccaaattggggaaagagattattgacaaaagactggagagaggtcttggagttttttgtgttttgttttttttttcttaaaacaaactattgctaaatatcattttaaatggctggggtataaagaactgcaaaatatgtagatcaaatttcctctacaggacacttgggtgtaaaaagtaggcagatcggtggttggaaaaatattaagctttatgaaattcaaaatatttacaaaatagctcaatggtggcttcccacaaatgtactccccagtatcctgtgggaatagtttgccccaagcctctctctcagcaaaattttgaagagggccaaacctgggagtgctcccttctcaccagccatccacacatctcctccctcaatattctggcccctttattagttgccatgtcaaatataaaaggaaattgataaaaaatgtcctgtacaaacttattttcagcattttaacttaccagaagcaaaactctcaccagctgttgtaccctgttctcctgattctctcccaggcccctctcacagagcacttcctcctgccccaacctgcctagcaagttgttagatggaaccttccacagccccttccacatggcctcactccatctcaaatgctcaaggctcctggaacaaaatggttcaatgttcaggctctagattcaagccaactgagctttaatcctgcccgaatttgcctcctggaggcaaaggtcctcaagtttattcgtttacctgaacctcaatttcttcatctataaaatggggattgtcataatacctatctcaccacgctgttgtgcggtttaaatgagggaagctttgtaaaatgcttagcacagaacacaaagaacttaatagatgttatcgagtattgttatacaattatctgtgccttccatggtaataaccaaggaactaatctgatgttgacgagataagactgggaagacctccctctctgacagccaagttcttctccctctctcttaggcaagagaaatctccaagacatagggaccctgcctttgctgccagacctcaaggggcgggtctaagcagaaccactgttgagtgtccaggcgcgctggcagagaaaagaagaggcttgaagggggttggcacggggttcaaagagggattgaggaaagagcactggactgggagtcaccaaaagccaaatttgggtcctgattcccctatttatgaggtgtgtcaccttggaccagtcagagaacaatcttttactggtaaggaatacacagcccgtcagctttaccagccttgaaaaaggttattgttaggctcaatggagacaatgtttacagatgtcttcagcagacccactataagccgcactgtagttctgctccatatatgaatctcttccaggaaagctcagggtgggactccggaaaccacattttaaaccaacacctccaggtgattctgaagcaagtctgaagactgcatttggggaaatcctgtgctgtgcaactgaaaaacactggcattattacttcctctttgtgtgaattcagacttcagtttagctaaggaggtggcatcccagaactcaagtaattccaggtaccctgtgggcagaaaatttgacctgagtagcacagattacagttgaaggatatctagaaattgaaaggtcagaaggaataatggtctgcttgggttgtttttggtcttaacatgtcccagtggagacaaaaataaccaaaacatttcaaaggcaataactagccgagtaaattagtaaaagacgaaagaaacccagacattttttcagcatccctcccttagtgagaatccaccctccatacctctcatttgtacctcatagccttctttgtgtgagtcatttaggcacgtgcccacctttctgttagagcattcatcctgaagatttttatgtcatccttctcctacaaagttttgggtttagtgggtatgttgaatttgaattcaaatcaatcctaggaaatccagtccacatcctatgagaaatttccacccggtcctgattttgcaataggcaaacttttcaacaaatagagctggaattcccaaaataaataaaaataaactcttttggtagaaaccaaaaagtggtcattccaggcagtcacagctctgccataagcaaacccactctaccacaggcatttgccattttcaaatctgaaacaatcatgtcttcctttttctgtatgtttctgtgctctttgtaacttttattaatctttattaatctatatgcatgagtatgtgtgtttttactgcaatctactttggtagcttttccaagtagcaaagaaatagttacatgtaaacaaacaaatacaattaaaagatctgaggtggacttcataaagatagacactgtaatggaatgtatctgtagtatacaaatggctctacggttctgccaaaatctccaaaaaattatttctactttatcactgctgtaaatgtaattttatccaacaaagagtaaatcagatcaattgtggcactgttgaaacactggtactagaactgtgtatgaccagagatttaaaaagcaaaccttgccaggcacagagactcacgcctgtaatcccagcactttgggaggctgaggccagtagatcacctgaggtcaggagattgagaccaccctggccaacatgatgaaattccgtctttactaaaaatacaaaaattagccaggtgtggcggcacaagcctgtagtcccagcctctcgggaggctgaggcaggagaatcgcttgatcctgggaggcggaggttgctgtgagccgagatggcgccactgaactccagcctgggaaacagagcaagactccttctcaaaaaaaaaaacgttaaaaaagaaagccaaaaaacaaacctatttcttcacctcactcaccagttcgtatcctctaaatctccccgatggaatggctactaaccttaaagtatcttcattttaaattagcactgttttcttaccttgaggaaagttttcctttcttgtccaaatctttgttctaattgaggggacaggacatatggacatatctgactgtcatgtaataggccttacttccccacattgacctgagatgaagtctaggcatgtgggtgagcaagtgtagggtggggatctttgtggtttttgtttgtttgtttgtttgtttgtttgtttgtttttaagagatggggccttgttctgtcacccaggctgtgacacttcagcctccagctccaggactcaagcaatccctcctgcttcagcctctcaaacagctgggactgtaggcatgcaccaccatgcccagcatgcaccagtgtgccccttaatgtttttttagagatgggggtctcactgtattgcccaggtttctctcaaactcctggcctcaaatgatcctcccacctcagtctcccaagtggctgggattacaggcatgagccaccacacctggctaccttaattattaaaacacttaatgttgggaagataaaaaaagttctggggttctggagatgatagtggtggatgaacaacaatatacatgtccttcataccaccaaactgtacattaaagaatggttaaaatggtaaattttaccattcttataccattatgtatactttaccacaataaacaaattttaatggtagttggtgtaaatctcaaactacaaactcaaggaatataatttgctttatttttacataaatgaacataattttgttttaaacttgatctaagtcaattaggatttcactcctttttcttcccccagttggatacaagttctgatattcttttgcaatgccagggaattggtttagggtgggattaagggcaagtcatttggcccttaatatcaattcatgctgggctccactaagacctttgtcactccacctaatcttaggcaggttaccttggagatagcccttgtttctctgtgtatacaaccctctcgaccatcaccactccccactgggggatttggaaatcattctgctgctttcattgtctttgctttttttaggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaaggtaggtagtagcattgtcttccttctattttgtcaacatttttatacaggatggctcaattagttaaatcacctacaaaatgcattttgctagcaccctccccatgtttgaggtgattatgatatattttataagggcccatgttattccatatactgtcttgaaagaaacaagaatttatcacaaatgcaccagggctgtgtttatacaaggaaaagcaactctgatactcaacatatgtaggaggggaacatcttaacaggcccaaggatccacactgaaagcttttctcccaaatgcttttctcattagcaagtaaaaaaatacaacagttgtttatacaacagagccaaccaagtgacttcgggggctcagcagtgagttacagcttagtctagaccacacttaatttagtccgaacttggtctagaccatactcaagggtcctatccggcaggaagcagcccagccctcaaagtcatgacctatggatgttattccacacaaaaccatccaatgcagggcaaaggccagtttgctcgagactgaacaaattcctgctctctataagctcccgccccaagcctcagtgagctcctcggggagtagagagcatggtcagaaaagcaacaaccacaaatgcagctgcaggccaccaccaaagtagatcccagaacagggacgcccgcctaagacagagggaccacacatacgacgcacaggctagcatcagaatactactgggaaagaaataattccatcttttttcaatctgtcagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaaggtaagaatctctctttcaaacaggcatcttggagcgctgtacagtagccaagcctctattgctcactgacactgaggaggagggaggggcatggagaatacaaaaccacaattctaaacactttctcttcattcctgcacagcattctctattctttttcatctaccaatgtggatggattgtaaaaacttccccaatactttataagcacccactaaatgtttgttaatcaggataatagaccatatctgacaacttttacaggcttcctatgagaggtgttatcctccttacaaagtctaccaaccctgaagtcactagtggtgattagaagataacttatttaaagaaccaccttgcagattaatcaataaggaggccttaaagactcaaatgcaaaaagctcaaatatacagtatgtgtttcataagtaatgctgactgactgtcttcgtctgtttgggctgctaccacaaaataccataaactcggtggcttataaataacagaactttattctgttcaagatcaagatcaaggcaccagcacatttggtgtctggggagggcctactttctggttcataaacagcttcttttcactctaatctcacatggtagatggggtgaggggtctctcttaggcctctttaataagggaactaatctcattcatgaagccttcacctccatgacctaatcacttcccaaaatcaccacctcctaatactctcaccttgggagtgaggattgcaacatatgaattcggaggaatcagactttcagaccataccactgactaacaaaaaggaacaaaaggccgggcatggtggctcacacctgtaatcccagcactttgggaggccaaggtggatggatctgttgaactcaggagtttgagaccagcctgggcgatatggtgaaaacccgtttctacaaaaaatacaaaaattagccaggtgtggtggcacacgcctgtagtcccacctactcaggaggctgaggggggaggatcacctgagcccaggaggttgaggctgaagtgagccgagatcttgccactgcattccagtctgggtgacaaaatgagaccctgtcttaaaagaaaaaaaggaacaagagtcattatgtttttcaaaatcatttgtttattgagatggtaaggaaaaaaataggtgttcatgtttgtatgaactatactaatatatagcacaaatgaattactaattttttaaaaattagaatacagtattcatctcatactatattaagtataattgggggagaggatatgatgacttcaaatgtcttgtgcatctgcagtacccaagaccatcaccctcctaaacatcggttatcatggttgaccaaagtataaggcactgcagtttgcaatgtgaacattagcaaagagaaaggctggtcttcaaatgtagaagccagctcttcatcaaaaggccatgccatcccctctatagctctttcccttcacttgatagaatttagttacatgctttgctgttagagtgtcttcaaaaatcatttcattcactaagtatttactaagtatggtacatatacataacactatgtccaaccatgtgaggatgcaaaaaataaataaataacagagaacatataattcctgccatgaagacatttactacaatacattgctcttttctgctagcctcaataacaactcgattttaggtctgtgagcatcaaaatgaaatctacaattttaaaagattattttatttcagtggattatttaaaactttatccattctttaataaatagtcaatagtcattgattcccagaggaatgtagacatagatagggacaaaacagagatatagacatggacactgagacagaggcagaggcatagtcatagtcatagatagagacataaacagagaagcaagtaggcagaaacatagtccttgacagagacaggcacatggacaacctataacgagtaagaggcagtgtcagacactcttctggacataaagaaagcaaagacccagatgataatcccttgagcaatcagcagttggtggttaaaaaacaaaaatatcccaacagcttcttaccacgtatttgccctttttcttccttccagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactc

SEQ ID NO: 36880 - DNA, 171546 bp, Homo sapiens
gggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgtgagttcccagacccttcccacccccactggggcgccggcctgcgcgcgagttgaggcgagggcgcgccctgttcccgccggccccggggagtagttggcccgtgggtcgcgcccgggccggccgaggcgcacccagcgcccagcgcgctcggctccccgccctgacccgccccgcgcggcgcctccctccattcagctcgggaaggaggagaacccgagggctaggctgggccccgggagagtttacttttttttctgttttaaacaaagtgctttccgccggttcttccctccgggcgtgtttgctgggaccccggcaggtggcacgctttgctgagcttcacgtgtgtgtttggggctggggtggcgttcagggtcaccgcagcgctgctgtgggtttgcagggagcgtagttccaggatggtctaggcctttcccaaactcacggtgcaccccgtctcccccgcagactggcgcgccccgcacaagttggaaagccactttccatgtgtcctgcatgactttctcagcaaggcgggggcgctccttaggagatacttttacatgcctttgaaaaaaaaaaaaaaaaagatgggggtgggggcgggaattaaccaaacacctgttcgctggactagatcagctgagaaaacaagtctgagtgatgtgcccagcccccaaagtactcggccgcacccgagacccgctcggctcctgcgttgggcgggcacagccaaggggttaaagcaaaatgtccgatctgagcctggactttgcaaacaaggtttgtaagggacaaccccccaccgtagcggtaaacctcccaggagaaagaggagaccggcactactggcctctccttttatttcttaaacagtgtttggttcccacatgatcggctatttaagccggagagggtattttggcgcttagtcgccttaatcgctatggggttgcattcttcatctgtgctactgaaaaataggctgtagcaacaaaaggtctcccctccccacccaggccttgagttgaactaaggaccttccaggaccaacagaccggagaaagcaaagtgcagccacagtgaagagattttgtgtttaggagaggcgaatgggattttagaactggaggaaacctcttgatttcagcggttaacaactttggaattcgtgaatgttgcagcccctgaattttagtcagtttttttttttttctgataacacctgctaggtgaagcacagaaattagctgggggtggggaggctctaggagggtggtctgaggctatatgcctggccagctgcttatactctgctttctctcagaaataattgttgttaagctgtaaatctgaaatgaaaggttcctgttaactcagttaatagatgacgtttattgtctcggaatacttggtgtgtagaatttgagcttgttagtgcagaaatgattgtgggccagcagagggaattcattctcctgggcattctctctctgcaccagagccccactgaaaccggtggcttccttgaaatacttgttcaagcaaaaagtgtgaagggaaagtactgggacaagaaatatcctggcagtggagatttgcgaaacgtgactttgccaggaatctgtgtcgtgaaggttagcagcatgcttgctaaaacttgttactgctgctgggcttctctggtattagagctgaggcaactcctcccgaggtaaggataagcctgcaatggggtctgatgccttctaggaaagctcttcttagcagctgacagaggggagaggccccgtataaggagactgtatgtttcctagagtccaaaggcagtgaccacactttaaagaggctgtggtttatgtcacgtgctgcccacctccatgcttttgtaaagctttattccagcttcaggaatagcattggtcttcccaggagaaccagcacacacaggccatagcacaggtcagttgtcaacctttgacagtaaagaatgtgggtgtaaatggcagagccagtaagactgagaaaacttctggaccagcttcctaaactctatggaaaaactcagtgggggtctttcagggacctggtgggagagagacctaagctgagattccttctcggccttttattagcagctgttaatttactttgagctttaatttctttatctgtaaaatggagatattactgcttactggggttattatgaggattaagagataatatgcaaagtgcttaatgcctgtctggcatgggtacttgctgactaaatggtagctgttaatgatcatttaaaaagcagtaattgtgtacctactgtgtgtcaggtaccttacaaggtgtcttaaacattctgtgattctaagattgcctgagagtaaagccaaaggtggttgtttttgggtaatgatattttaaactcagtcatatttatgaaacccatgttcaaagcaacttaactttaataggtcttaattagacttataacaaaagtgagtttaatgaacagaggactttgaggaaggagaagtaaaatatcagatgcatgggacggtcagataaaagcacgatcatagaagacctatcataaatgtttgtagttcaaattttctatagtgcctttaactattcagtcacattttaaactccagttatgacttttgcagaataatattgtgtcagagagccccaaaacatgtcgggtgttcctaaagctttggagactataaaattgaagtagataccataaacttcatccaggttttcaggctgtatattaaagaagtttcggactccaaaagattactcaatggtcagccaagttggtccgccgagtgactgaggtcagggtctgagcaccttggactctttaatttctcttaggtagttaagattgagtcattcccagaggtggaaggtatgtgatgatgactgtgggtatatccagcctatgaatcatcactcttagctcttctgggaagagatggatctatatatgatcacagggaagaacctagaagaaggagatctataagagatagtctcatgaagtcattttggatttctgccaaccctcattttcttctttatggggtctctctctctgaccaccactgtcttccagaaatgctccaggcccgcggtctgttctgttctgacccttactaggtttgttcttgacttttctcagacttgtcatgttccatctcttaaaatcatattttctgaactagagatcatctagtccaactgcctctttttacagatgaagaaactgaagctgaaagttcagcttgagcagaatcttaacagaatgtggatttgaatctctgacccatgctcatgccatttttaaatggaaaagccagaaatgttcttcagacctagagaaatcggcaagcatctgaattttggaagtgtactatattgtgttgatttatcaaactgcttcccatatgcataggtcagggctatctatttaaatattggtgcctggactcttactattgactctattccagctggccttggaacaagttctgggtccgtccttctttgcctgcctccaccccattcccttctgaaaaagcccagtgaagtgtggctgtagctagccaagaatcagagctgtattcaggatgtgtacctaagcacttgcttccttgcatttattcactcggagtgccatgtggcccagggccatcttccagggattgctgggtcaccttgaatgctaagagtagagaaaaagccaaaacgggcagcgagacttacaggaagtcttaggactctgcaagaaagcagaaataggcaagtttaattttaacacaggctggtgtgagaccaagtaatgacagggttggggaaaaaaagggtcaaagtatttatatggtataaataatttgttggggaagtcaggataaatgcttatataaaaggattcctttattataaagaagtggttattctgtgttctcagttatatagactctcttagcataacaatatattgagatttaatttaagctttcataaccaaatagtaccagaattatggcgcatggtttcctgaagacctcggctcaacatattactgtggacagtgaggccagtgaattatttggtattttcaagagggacagtgagacaaaacagaaaatactgttgtaagcttagatgacagggtcaattgtgcctgaaacactgatttagtgctgaatcagcccattttaagaatataatcatagcttaagaaccagtttaaaatttccccatcctacactaaagcaatgtctttaactcctttggatgtctgtagcacattgtgtctgacaattctgatgttttgtgctaaactgtgatccactatctttaggacatgatctaatctctcccaactggattgtaggttatgtgagggcaggggtcttacattcatttctttgcctgctagcacctagcatatgccttgcaaatacaatagagactgatattatacactcagtttaacctgtgacatcaactcttcctgctgagggtggagagagggagaaatccctttctttaaccctttgcccttccttgctcaggccttggtgtcttctgcctctgaggaaacggaatctgtaagcttagcaaagaaacgcacaagacgttaattcttggtttttgatttttcaaaggcggggggttccagctaagggattttcatgagtgtttgtaaatttcacctggcttttgccctaaaggcagactttagaacctaaccccagaaatacaggctgacctacactgcagtgggtactcgggacttgctgaggtggttggttgttatgaggctggacagagaaggatgactgtggaatagagatctttctgaaagcaacttgacaggggtgtgggggtcaaatggaagtgtgcagtacacgtgtgaagtcacttgtgaattgatagcggcaggtttatttcttcaaggatagtaagggaatcttggatatatttaactctttcggtaggatggtgggaaggctgcttacctgctccgggggtgagcctaggagccatagcatgggatctggggatctgtgtagcacccccgctggctcctgggaggatggtaaagattacgtactgcagcagtgggaagtggacgtagtctcagcccccggtgcccatcttccctttctgggcttgggtacaactctggaatcaaataactttatatctggaaggaagcttaggggttctgaaacctggctggtcttcagggtaactacttgggcaaccttttataaaagtgtgattctcagcccagcctagatctgttacgtcagtttccataagtgtgctccaagaagctgttcttaaagtcttcttcgtttgagtcagactagcttttctcctttacacagaaggcagagtgtaatgtagtgactaagagcagagcctagagccaggtaggatcaaacccttttctgccattgactagctatgattttgtgcaggattcctaaccttcctaggccttcctgccttcagctgtgaagctagtatcctcgcacattagaatagtcctggtccagagtgagcattttgtgtttgttaaatagatgaggaaaccaaggctgtaagaggtgcagtggtggcggcatgtctagcaaacttggtcttcaatctgcatcttccctgcttcccggcctgtgctgtgtatgtgctttctccttttaggtttggttttcatcacgtttaaaggtttggttttcatcacattctccctttcttccattccactctccagttgaaaagtgcatctcagaagagccatgccttctacttagcagcccttcgtagctactaagccatagataaatcccagtgaggtctcagtgttcagagatgagtggacagatgggtgcatagacatgacggggcagtgactgtgagctggatacccatggagggtgggtggtgcagttataggttgggcttactgctaaggaataccacctgtctggtttccaggccttcttagacctctatgaccttgaaagcacccccacacctccatccctaggaggctggataacttgcacaacacccagggcaggtttgaaaacgatttatttttcttagttttttgcttggcactaatgtttgctaggaaggagcttgtggattattgatgacaaaactgcctaaggttggaaagtatgtgggcaaatatggaagtagtgtttccttcacaggtttgttaaactggcatttagatttgcaaacactgatctcttggaattaagttaaaaggctaattgttaattagccctgaactggggcaggtagatgggcctctcaccagtgcaggtccctgtcaactaataacagggtttgataaccaccatcaaatctgctatctggcttttctgcttagataaacaaggcaagacgatctcaaaccagcataccgattccgaggttggcatgtttgtagaagactgttctcaggccgcagtgtggcagcagaccctccccagttcagccccatgccagattccaacgttggatcccactgtcgcttcatctcatcctaaattggcagaaagactgtttagaaaactaagtctctaaaaccaattaaatggtaaagaagactgttctgaattagggggaatgggatgaagtaccactaaacgcaagtcacaaagggcaaaaactcatgacatggagccgtgggtatctgcttgcatgtttatttgccaagcggctagtatattttgcatgtcatacaatctgaaacttacttttttgaaaagccatttcagatatagtataagaaaagcctttgagagaaacatgctttctaagcctgggagtacagaaataaaaataaactttgcaataatttgaaaggggcacactggttagttgaagagtaaggaagcacccagtaatgcctctttacccaagagctctgtttgctttgctcggtgatatcaatgtcactgtggtttcttcattttgaaaaggaagttcatttgtactgaggtggttttaagtgtgtgtgtgtgtgtgtgtgtgtgtgtgtgtatgatgcaaatgataataaacatttcagacccagagggcagaatgtcactgaacctaagccctcctgagccaaataactcctttgtccttgcagaatcaggagcccttctcttcaggatatgctgccattatgataaagcattgtgatgtaaagttaacgagaggatccttatccaagtgaatcacagccaaggggtggaatggttggcctctggtagggatgccccattcagcagcactgagagtttggagttgttctgttctctttccttcttgctgagggtagtaagaaatcctccctaggccccattcccctgatatatcttgcgggtgatggcctcttactggcagtgtgattatgtatgtccctttagaacaaaggtatcgaaacaataaaagttgtgaaatggaaatgtttacaattctacaaggctccagagagattagagataggtaggaaaaaggccattgttttccaatcaaaggtgctgagaacctgttgattggacctaaggaatccagctttgccacgacacaaaacccaagagttttgtttcttttttttttttttttttttttttgttgagacagagtctcactctgtttgcccaagctggagtgtagcgatgcgatttcagctcactgcagccttgacctccttgggcttaggcaatcctcccacctctgcctccccagtagctgggactgcaagtgtgcagcaccacacccagcaatttttttgtgtttttagtagagtcagaatgctaccatgttggccaggctggtctcgaactcctggattcaggcaatcagcctggcttggcctcccaaagtgttgagattacaagcgtgagccaccatgcccagccccaagagttttcaaaaaaggaagagttcaaagaggctcagaaatgatcaagtggacatacagagacataattttaggaaagggatattattaatatttgccagtgagtcctcgttactgctggtgagactaggcccaggtaccgacttaaggcgatactttgaaaaagttgagaggtggcttaaagacctgggtgatgaatgaagaagacctccatgactttacaagtgcaaagagagatgggtctgggcactgctgggccttttagaggctcaaggacagtggccttggggaaggctgaaggagacacctattgaattagatggtgccaaggctgagggaggactttcgggaatcccagactagagaagtgttttaatgccaagaacatgggaaacccatttcagatactgtatcagataagccagcttagaaaagcaccttctaaggcttgccctatatttagaaagggctgctacagaggttaactgagaaggggttgtaggaatgtggagaggcgttgtgaggatcctcattcaggatgatctgggaggtaagctctgagagacaatgatacctctccccaagcttagcagccatgccagaagccagctgagaaggtttttcaatatcatagaatatgtaagctctgtaagctcatttatttctctctgtgtgtgtacatgttttaacccaaaagaaatagggatttttgtctgtattcgaacatgcagggaatgtggtctggacctgccagagaaaccgtggccagctttttggggttttcctatagaaattgttcattcaacagatattcactgagtatttactatgtatttggcactgttctagtgctggggctacagcagcaaacaaaatagacaaaatccctgcctatgttctgatcggggagacaaaccataaacaaaaaggtgtattatgttagatagtaataattaatgcagaagtgttaatgcaagagaggggagaatggttgatgtgatctgcaaaaatataaagtagagagggaacagggagtgcagatggggagggaagtggtcagcagtagggctgcctgggaagactttgctgagaaggtgaagctgcattcctggcagagagaatggcaaacacaaaggccctgaggcagaagcatgttcaggcaaagcagtgagtctccttggaggcagattgtatagggccttatggatcatcgaatgactggcttttactcatgaatgagatggggagcatttgtaggttctgagaagagtaggacatgtcctcacttggattttaaatggatttctctggcctgcagccttgagagtagactgtatgaggacaaagatagaagtaatgatactgactaggaggctcctgtaataaacagataagagatggtgatttggaccaatgtggcagcaatgaatatagtaaaaagtgcttggattcaggatatgtcttgaaagtagagtcaacaggatttcctggggactaggtatcagttgggacagacagagtagagaagaatgtgtccaaagtttttgacctgagcagctggaaggatggagttgtattatggtttggggagagatgtgagagtaatagattttgggggcagggcaggagtatggttttagatatgtcaggtttggagtgtctagacagccaagtgagttatttaggcagttgagtaagcagctgagtcaattaaaaaaattgaatttaaaagcctgaagttcagttggaaaggtttgattggtgatgcaagtagaggagcctctaggttgtgtttagaatgatgaactgatgagggcaccaaggacggggatggaggcctgagccctatggtgttcttacacatggaggttagggagagccctggagactgacacccatggcaggaggagagggagggagtgtgtggtcctggaaaccacatgatggggtttcaaagaggaagtgaaagatcagttatatcaaatgacacttactgagatttgatcgctagattggcaatgtagaagccactggtgaccttgtgagagcactgatggggaggagtgggagcaatgcctaattggagtgggtttgtgagagaacaggagagaaggaattggagaccataggaactcttgaggggttttgctgtagaggggagcagagccatggcaacaactgtaaggggaaatagtgggtttttgtttcgttttgtttaagatgggagaagattatagtgagctggtttgatgaagatgattcagtcaaaaaggaaaagttaatgcaagagaggggagaactgttggtgtgacctcaccaactgagtaggtgagaggacgtaccgtgggggaggtggcctgatgactggagcaagggtagctcatcacagttatgaggaagaaaggtcggatgaggggcacagatgcaggtaggtggctaattatcctggtggaagggcatggggtttttccattgcttctaatttctcagtgaataataataagtcattagccctaagttactcagtagttgtgtaaaagtttgcctcattaggagtaagaacttcactgaggcagatggatgtggatttgaatcccagctcctttacattctgttgattttgacattggacaaattacttatcttcattggtcaaatgaaggtactaatagcacctacctcagagggttgtgaacattaaaggtgaggataaagcacttagcagagtgcccggcatatccaatcaacatcagcctttactgttagggtcccttaaagtaaaatatgaacataattccctcacactggggagtttttgtagctctcttatcttttcagtctggtggacagcagaggttaccctttgggggccaggtcaaaggttaagtttccctatggaagactacaactggagggcagtccacaggccgccatgaagtatacattgttttgatgaagacaggaaggggaaatatgggacttggaagaaggaagagaagatggcagcatgtcaaaactctttggcaatctgcagacctttgtgctatatttgagctacagagaaccacgactttttattttgagttcttacaagactcattttaggtgtggagagagctcttcccatgtgggtctgcagctctagaattgggtagtgccttggatggcacagtcctggtgtatcctgcaggctgagtggacaggagggcgttgactgggtgtgtgtgatacagggtggaagccagctccgagaacgcagcaggagagccaaggctgtgcttcctgttcctgctggcctggttgatttgtctttgtaatcctagtcaatgcatccagcgtctcagtgcatatattgaataaaaaatgacgaatggccttgttgaattgtcaggagtgtagaaaatgaggctcaatcagcactttgggttctaaaatactgtcgtttttcaatctcttctttcaagattattggtatagaccttgagggaaatctgagttcaaaaggaaatagaatatctttggaattttgcaaaagtgtgagtcatcaggacttgagcatacattcccctggtgtgctgcaaatcagatatgaaacatcttcctgaggtggcatggtggtggtataaaagcttcattatagtacagaatgaagtgtgtacttatataaaacacaagtcttcgaagacattgcaagcttttggtggttgctttgcactgtgcctctgtacatgttcacctgcctctgtcattcagtgcttttgtgaaaatggctgggaagcattgaccagctcaaccttttctctctagaaggaagactgagacccagaaaagtcaagtgacagctagtcagtggtaatgtgggccctgaaacctagctgcccagtgcccagtccacctgatggtatgccatacacatcttccgtttggtgaaatagcccattcttggagttaaacttgtgccacataaatcttgcccttaatagaacagtatcttgggtttttaaatgtcccctacatagtgggctgggagagatagaaaatacagccactgtcaccccttcccctgcttactagggcactccaaatgaccatagcacattttttcagtggagtctcagaattcttcaggtcaacattggtcagccttcactgttgtgtgggtgtttgcaaataagacagcacctgtttgccctcctggccttgctaaatcccgtgcatatggaaggcaccctataaatgtatgcctgatggatatgagtcctgttggtttgtgagcttcttaagaacaaggctgacatcttgttcagttttggttcaaatctaatacatagaaatggatattcagtaggtatttgttgaactctttgattccccaaatacactaaaggcttttagagaacaggaaccagggtaaacatttctttagaatgatcttttacatgctggtactttgaaaaaaaattgtggtaaaatatacataacataaaatttattttaaccattttaaagtgtatgattcagtattgttaagtatattcacatcatttcttgcccggaaatgatgttgtttcatattatgaggccataaagtattgataagctaaacaaactttaactcaatatatgattgtgctgtatcatttagtactatattctaatgtgtattagtggcaatgaaatttaaagtttaacatatttatggtacaagttgaaatttagtctcttagcttattatgtgtttttccaatccggttaaggactgctatgagttgaattcagcagttgtatacctggcaccaacagcctttgagaaaccaagtaatttaagtttttaattgagtaacagaaaattgcaactaataaaatgcctggctatattagcttatttgtcatttatatgttgttagtactccttaactcttggtagctttaagatgaaaccaagagtggtttcagttgcattctgtgttctgattgaagctgaggcttgatttgtggcttgaagtttgaaaggaagtgcctgtttgttcagggaacaccaattggactaacagctgtcctctgtattaaggccatctttagcttgtcttgcaaatactttccttgttcactaatcccttctccccaccctgcttcctttagacccatgttaatctattacctgggagcagctctagattcttgagttggtaatgactaatttctccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccagcactttggaaggctgaggtgggaggaaggcctgagcctaggaactcaaggtgagagtgagctatgattgtgtcactgcactccagcctgggtaacagagtggagacgctgtctctttaaaaaaaaaaaaaaaaaaaaaaaaaaaaaaaaaaaatcaaacctcagtgcataagacacaggtgttttcatctgtgaacgagagtagacacattctagtaatacccaatgtttttgtgaatttctttacaattgaaactattttccacttgtagaagttgggaaggaacttggggaatggcctggaaaggtagaccaccatcctcatttcatagaacaagaaatggagacctaggatttgtcatagtcctgcagccagctacagacagagctgtgcctacaattcccttcttgtcctgagttgtttctgcttcatttcccactagaaccccatcccgccctcacccctaagcagaggtccagctagctaatgtgtctgtttttataaaatgccaccagaagcttaagtacgtcggttcgtgtcccatcaaacttgtccagatctctttctcatcatagagaggtaccatcctgagttgctcagatgataaacatttctccattagaaactaggctcggatttgcctgtggccacaaatccagaagcagctgtgtgttccccatgtttctcaccaacccctgcgtcatgtttctgaataaggagtcctggttaccgccacacccctcattcattgctttagattagatgaaaggcgaggtgcctgactcaggccactgactcactctgcttgggtgaacccagctcctcccggtaggaagtgattgccccaggcaggttgaggagtgcccacagcatccaggactaaagcatttggaccctgcagctatttataaacagcactttacagtgctttcagtctgaatattgggactcccctagaaaggacagattcagtcctttctgaaaggaggatagacgaagggtgaggagttcttgttggatgtattttcatagctgaaaggttcccctgaatgctgtcagtgccatggatgttcatagggaaggttagagttcctgtctctgatgtcattcattttatgctgcagctcacttgactgtgggactccctaggaaagcttatctaccttttcagctgttgcacctcttttcttccatgtagtttgccctctgccttacattcactcttcattgtaatgccccagttgccagcacagtgcctggcgcacagtaggtacgtgtttgtgagcttgctttactgatgtgttgtcatgcctctggaacgggctgtaaaaatcaatctttgactctttgccagcaactgcccacataaagagagcatgtgtgagcttgttttatgcaattacaaggtttgcttcatgacttgtgggcgctgattttttttttttaacctcactatctccatcattttctctgcaagattttcagtgaccctcgtgtccatggactgacctccatttttaaaatttcatttttaatttatttttgaataggtagtacagtcacatggtacaaatattaaaactacaaagatggaatgaaagtcagcctcccacccttgatctctgggcatcctattcttcctggaggcaaccattgttttaccagcttactgtgaatctttcagagctacctatacatttacaagcaaatatgtacatagattttttttacccatttgccatgtagattcttttgcaccttgctctttttctcttggtatgttttaatgcctgttcaatcttgtaaataaagagcttccttattatttttaatctctgcataatactcagtttcgaggatgaactatgatttatttaaccagtctgggtattcagataatttctaatccttcgccgttaaaagcagtgctgcagtgaagaactttatgcttccctcatttcaccttaaatgaattaatttaaggtgaattaattaattcctagtgcagagtggcctggccggcgttgttgttttaatggtcacggctgattctggaggagtggctgccctcattcctttctatcctaaccatctgataggaccacaggctacgctatcagtgggtttagtagagtcttttcaacaatcgagtttccagccttatgcccaagctgttggatccctgaaggcttcaatgtttgtgtcctagctgtactttatgcttgttaaaatgtatgtgttaaaattagaatggcttgttggaatgtgtaagattgcgtatagtgtttcatgttttatcactgtgttgagtttacaaagttacttgatgttatttcttttttcttttttgaggcagggtctcacgctttcgcccaggctggagtacgagtggtgcactcacgggttactgcagcctcaacctcctgggctcaggtgatcctcccgcctcggcctcccgagtacctgggactactggcatgcactaccacgcctggctaatctttgtattttttgtaaatatgaggtttcaccatgttgttcaggctggtctcaaattcctgggctcaagtgatcctcccaccttggcccccaaagttctgggattacaggagtgagccaccatgcctggcccatcgtttcatttgatccttgcaacaccctatgagaatatttagatagaacgatttcacagataatccatagtgatactcagctaacgggtggtactgccaagacttgaacccaccattcttgtaacttccttgatatctctaattatggttttggtctgccagtttgttatggagcagaaaagaagatgtaagctttctggaggtagtagctgctacaggcatacactatattatctcagcaatagcaagtccaagtaggactgattcagtatacacaaagaagtattagttgctaaaatattgaaataactttcattctggttggtgcacgttgagtatcccaaatatgaacaaccaaaatctgaaatgctccaaagctggaaactttttgagtgtttttgagtgcctgccaacatgacatgcaagagaaacattcattggagcatttcggattttggatttttagatttgggatgctcagtaagtattaatgcaaatattccaaaatccccgccccccgccccccgccaaaaaaaaccaaaaacccaaaacacttgtagtcccaagcatttcagaaaaatgatactcaacctgtaaatagctttgccccaaacccccctgagtttctttctctacttccctggccagttttcacataggaacccccctaatcgccacgtatttcccccccacaacccagcaataaaggggaaatgccctcataagcgaggagcccctggattgtagctcccgtgctatggccaccatctgtgctcgctaattggttcccaagccatactggtccctaaatattcttaaatctgtaagtgcaggaatggagtattaaacaatgtaagcgtttaggcatataacttgatttctgtaggttttgtttgttttgttttgttttgagagagagtcttgctgtcacccaggctggagtgcagtggcgggctcttggcttactgcaacctctgcctctcaggttcaagtgattctgctgtctcagcctcccaagtagctgggactacaggcgcccaccaccatgcctggctaatttttttgtatttttagtagagacagggttttgctatgttggccaggctggtttgaacttctgacctcaagcgactgcccgcctcagcctcccaaactgctgagattacaggcatgagccactgtgcccggctggtatttatactttgtaaattgcctttgttgttcttagtatcctatttctaaatctgttgtctttttcttttctttttttttttttaacaaaaaaaaaaaaaggccgggcgcggtggctcacgcctgtaatcccagcactttgggagaccgaggcgggcagatcacgaggtcaggagatcgagaccatcctggctaacacggtgaaaccccgtctctacaaaaaatacaaaaaattagccgggcatggtggtgggcgcctgtagtcccagctactcgggaagctgaggcaggagaatggcctgaacccgggaggcggagcttgcagtgagctgagattgcgccactgctctccagtctgggcgacagagtgagactccgtcttttttaaaaaaaaaaaaaagaaaaaaaaaagcctgaaagacctcttttggttttgctttttgctttgtctttgtcttcccggcctctaaaaatctgggtagctggtctgaggtgttgggacccaggacttgctctcttattgctccaccactggagcctcaacctcaaactcaaggtggtggcacctacattccaggcagctgaagaaaggagcaaagaacagagccaaaggcacatgcatgccatcttctaaggaaaattattggaagcagcagtgtgatgctttgtcacacgtcctattcagcagaactgagttgtgtggcacatccagctaaagagggaggttcagttgagtagtagttattcagggtggccttatgcccagctaaaaagtcttttactatgggaaagaggagaactgatgttgggtgacagccagcactctctggcagagctactaagcctgttgtttcatttatctcatttagaaaataaactgtgaccatattaatttccttttcaaagcattgaaaaatttgtatttcctaaactattggagtagtaaaatgggtatggtgacccaccaggtgtgagctcattaagtctatcttttctcttcttgttttttatttaaaatattttattgaaaaatgatggaatttaaagtcgctttttcctttgcagatgaactatttgataacaggttttaagacatgaatcttattttttgagttaacactgataatatttatgcttggtacacttgaaatagaaaaacctgcttggtcacaacatgctagaatttaaaattattaaaagtgatgaattaatgataaaactttattcccataacagaaatttactaagcatctactatgtgccgagcactgtgcaaaggtcagggatggaaatggtgagctcacaatccaagtgtgtacagtttcctagacttggtttcttgaaaggaaaactcactagagattggactccaaatcacaaatgtcatttggcaactgataagtcgggtatctggtaattcagaagcacaggaaatgattaaatgccacatttgacaagatctggcagctgccttgtgaaactgaaagaacaggattgcctggagacaattatcagaacttggactttcatttttccttgctgcagtagacagtgttttattgtggctctttaagagatgtcttagtggtatgaattgcttggtcagctgaaaacttttcacctaatttaattttatttttaatttttttgagacagagtctcactctgttgcccaggctggagtgcagtggcgcaatcttggcttagtgcaacctccaccacccaggtccaagcgattcttgtgccttggcctctgaagtagctgggattacaggtgtgcaccaccgtgcccggctaatttttgtatttttagtagagatggggtttcgccatgtgggccaggttggtctcaaactcctgacctcaagtgatctccctgcctgagcctcccaaagtgctgggattataggtgtgaggcaccacgcctagccaaattttatttttatttttatttatttattttttattttgtgagatggagtctcactctgtcgtccagactggagtgcagtggtgtgatctccgcctcccaggttcaagctattctcatgcctcagcctcccaagtagctgggattgcaggcgtccaccactatgcccagctaatttttgtatttttagtagagacgaggttttaccatgttgactaggctggcctcgaactcctgatctcaagtgattcgcccatctcagcctaccaaagtgctacgattacaggtgtgagtcaccacacccagccccaattttattttaaaatgagctagttatatatttatttctgtacttacaaatttctgttgaagtggaattcttgatcattttaaatgcaggccagttgcttttgtgatttttatgttgttgctaatgttattcttttttccttgaggttattgaaattcttatgttgggaggtaagaagcaagtgttggtggaccaaggtcacaccaaaaatagatcctagggatagaaccagaattccagaattcttttcctgtctcctcctccattttcctgatctgaccgctcttattagcatattccctttaaatagttgaaattgagggttgtgatttcacattttttcccccggtacgtggtaaagactttgagctgaaggagttgaaagttgtggatgttaaaaacacgttctgctttggatgttcctttactgcatgagctcccttgctcttaatgagacacacccatagtaaagtccagacactcagtctggacttaactgagtcaggttaagaactagaaccctcaggcgcaaatgtcacatgagcatcatattcactagaaaatgggtttagttctagcatgctctttcaaggaggcaggaaagaaggcatcttgtgaaattttgggaaggccaggataaaattgctggtcttgtgctccagttaaaggtaacaggtattctttgcctttaattttgcctttagcacagatctcaaagtacttaatagacgttaattataactgaccatgctcttgtaatagattttttttaatgagtaaactggggtgtagtgatgtcatcaaatcaagcagaaaggagactcttggagtagtggtttagagcaagatctgggagcccaggagtgctaggcacaactcctggtttgtcacttaccagctgtgtgaccttggacaagttacttgtcttctcaatttgtgtccacatttgtaaaatgggtaatggcaatagtgtctcttatattattgtctcttatagtgtctcatgttattaggcagagtacctaatatgagagcataggagatgatagctgttggggcattattaataatagcttgtttgcctcctttgaaagtaggctatgtttgtgatttcttagaaggttattagaaatctagtcttttgaatgtggagttgtagtttatagtcaaaagagagcctcagccttttaaccaactttctgtgtaaacatgaaaattccgggctggatttgttccactgtgaattttagctcacacttgcccaactggattatccagtaagtataatttaaaaatagggtttggtttttcttctccaaacacccttaaggttacaaaaaaaagcaggatctgcttcctgccctcaaggagtttatagcctagtaaagtgaaattgggagaagtacttgcccttggagatgatgaaacttgagttaggggtcttgaaggcaaaatcgtaggtaaggcctggagctggagcttggtaattgacagtgtttatggggttgggggcaaggtggcaggaaaatgtgagcacaggcgtcaaagtccttgtgtgcctgggaagtgaaaggaggaggggcagctcctggtggatggccagggtgtggctagatggaggaggagggctcccaattgtggtgggaagaatgctgcacagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggacagctgactttcacgatctcaggtactgatgaagattgtgaagattattacatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgccactgcactccagcctgggcaatgagagtgaaacttcctctccaaaaaaaaaaaaaaaaaaaaagagagagaagaggatggtggagttagccctgaggaatgtgaaggatgcaaccagcgaagatctgagtcaagagtgttcggaaccaaaggaagcgactgcggttactctgagatggaaatgaggctgctatgttcaaaggacagaaacggagtcagtgtggcaggagtgcacaccttagagggtgcagctggagaggcagagaaagggccactcaccatgggccttgtagaatgtggcaggaattcaaatttcattccattgcccatcggaacccactggagggctgtaagcagaggaatgatgtgatatgacctgagatgtgcaaagaacagcagttgcaaagaacagatgtggaggacgggctcgggtggaacaagagtagaagcaaaccagttagaatgatactatagttgttcaggtatgatgtgatggtgactcaggcctttgttttaggagtttgcaggagctcagagcagacagtgaaagtggccaccttgaagcaaaacacaaatgaaagggttgatcacaaactggattaaagttggcagtgagaatactggaaaggaactactgagaagtggtcagagtaaaatgtggaggtagagcctgtagactttactgatgcattggacgtgggatataagggcaagtgaagaatcaatgatgacttctaggtttctggcctgagcacctgggtagatggtgtacatttagtaagatagagaagggggccgggcatggtgcctcaagcctgtaatcccagcactttgggaggctgaggcaggtggatcacttgaagccaggagtttgagaccagcctggccaacatggcggaaccccatttctactaaatatatatatattttgtatgtatgtgtatatatatataaaatatatatataatttatgtatttatataatatacaaatatatttatatatttatatacaaatatatatttatattatatataaattatataaatttaaataaatataaatatatttatcttgtatatataaatatattttgtgtgtgtgtatatatatacacacacaaaaattagctggacgtgggggcacattcctgtaattccagcttcttgggaggctgaggcatgagaatcacttcaacctgggaggcggagggtgccgtaagccaagattgcaccactgcactccagcctgggtgacagagtgagactctgtctcaaaagaaaaaaatttttaaataaaaatagggaaggaggccgggcacggtggtgtaatcccagcactttgggaggccaaggccggtagatcagttgaggtcaggagttcaagacaagactggccaacatggtgaaaccctgtctctactaaaaatacaaaaattagcctggtgtggtggtgggcacctgtaatcccagctactcgggaggctgaggcaggagaatcacttgatcccaggaggcagaggttgcagtgagccaagatcgcaccactgcacttcagcctgggcaacagagcgagactatcttaaaaaaaaaaaaaaaagggaatgcttatggcaagcctggctgggggagaagctgagttctattttgaatgtgttaaatatgagatgttaagtggaaatgtttactaggcaattgaatatctgagtatggagttaggagagaggctggggctgaaaagaggtgttttgagagttatcagtgaatggatggtgtttccagccacaggatgagagcgcagctagagatgaggaaaaggtctaagagctggtggaagagaggagcaaccagcaaacttgaggagaaactggcaagtatcgactgacttgtacatccatctaccttgctgtcgtgatcgacccttatgtttgtgttttgcctgaaggtggccactttcactgtctgctgcgagctcctgcaaactcctaataatccgagggacagaggggagtggtggtgtactgttctagtatctacttttatgattcaaaaacctgttctttttgaaatcacatggtacttaaagatatttatattatcttctctatcgtcttttcctcccttcatttttactttggtaattttacctattaagattgtgaaggaacttgacattttagggatttcttgtagatgttgtaatgaaatatggttttggaatttgatttagaaagaggtggaatgtagtccgttttctttctccggcttccctcaaccttccagttctttataggtggttcattgctttgactaccagaggccttaaatgcaggttgcgtagttgaccatgcgacctgtgaggctccctttgaacctttgtccctatttctgtaaaattaggagctcaaatgagatcaaggtgggcttccttgatttcttccagggaacagggactggtgggagtcagtggcagcaagtcttgtctaaaggtgtgagcagcaacaaagcaacacacgaggcaggaaaggactaggcttcattaatggaggtgatgcttcagctgagatatagaggggattgggggctgggcacgtgctttttggagaatgggcagcatttgcacagtgtgggagtgcgaacaaagagcctggtggaccagctccaggtggtgaccccatcaataggaatagggtgattctcctgcattttctcatctataagtagccatgtggggaatccaaaaaccagttaccaacattcaaaattgctagtgctgttagttctgcaagtataaaattagaaacaaagttcaagcttcgtctgccaagttgaagtttcctaagtgttctctcaaaacccatattaatggactcattttggcgtttgtaaccgggtaagttacagataagggcatctgcattaactggagttgccttttgaaactcctcagccctagctttggtttctcaaatgtggtgtgggtatttggagtaaactgctgtaaggctaagctgttagtaagcatttgattttgagagccctctttcctttgcagctcttataaatggattactcagtaggaattgctggaaattagaatcactgcctcctttaataagtctagttaaggcagggaggtgggccccgtcacagcatagggcagagcagtcacttagcaaggagctcaggaaatgtttgctgaatgaaagagtggagagtgaaaggtcgtgttctcaacctggcagctggcatttctacatcacttttactcagagatttgcagacaaaactttttgtttaaaacaatgctatgttaattataatctaactgttacacaatttttttttttttaaatcacagtacagggctgggcgcagtggctcatacctgtaatcccagcacttccggaggccgaggcaggaggatcgcttaagctcaggagttcgagaccagcctgagcaacactgtagaaccccgtctctactaaaaatacaaaatattagccaggtgtggtgacacacacctgtagtcccagctacttgggctgaggtgggaggattgcttgagcccaggaggtggttgcagtgagccatgattacgcactgccctccagcctgggcaacagagcaaaaccctgtctcagaaagaaaatcacagtatacatggaatacaaaggttttttgtgtttgtttttaagaactagagccttcgaaggagcatgtggcttactggtattgggctgaaggatgattgcatggggcccatctggataatccaagatactttcctgggcaggggcattgacagggatattccctactttcttccacctttagaggatttactttagaaatggtttaaggtttctcaaagttttaagtctgctgtgttggaattattaatactggagtttgtcttttaattgtgtaaattacctggcttgttcattacaaataaccattggatgtcctgtaagtgctaggcactgagctggatgctaggtgatgcaacagtgacaaggacaggtgtggcccctgcccccatggagctgaccttctggggagggagaaggacagtgagcaaatggtctcacacacagtcgtataatcactaactgtggccattgctgtgcaggaaaggcaaatgataattataagagatgggacctgaactagcctggaaagtgggaagttttttttttgttttgttttgttttttttttttgagatggagtctcactcttgcccaggctggagtgcggtggtgccatctcggctcactgcaacctctgcctcctgagttcaagtgattctcctgcctcagcctcccgagtagctaggactacaggtgcgtgccaccgtgcccacctgatttttgtatttttagtagagatggggtttcactatgttggccaggatggtctcaatctcctgacctcgtgatccacctgcctcggggaaggtttttaagcagagacatgaaggggtgagtaggaggatgcctgaaggagagaagaagaaactgtgcaaaggtcctgagccaggagagtggtggtggttggaggggtgtgaaagaagcccactgcagttcaaagagtagagagtgatggagagggttaacccagaatgtgccctttggaaatacctaacctgaaatacttttacctaagccattgttaggatctgagttcttggtgtctgagcacaactgaatgtgaataagaggctgtttggatttcctgctgtggatggcaggatgctattcacaaagaagcctatgtcctgaccctccagacctgctgctacattaggttaaatggcaaaggggcattaggttgcagaaggaatcaacgttgcttatcaactgatgttaaaatcagggaagtatcctggattatccaaatgggcccagtggttcttgtaatgtggaagagggagacttgaagatgctcgcccgctggctttacagatgaaagaaggaaccatgagtcagggaaagttttcctgttgggcactaggcttagtacctgagtgacgaaataatctgtacagcaaaccccggtgacacgagttgtgctgcataacaaacctgcatgtgtacccccaaaccaaaaataaaagttaaaaaaaagctggaaagggcaaggaaacagatcctcccctacaacctttaggaaggaatgcagccaagtgagacctgggttggcctgtggccctaaggaactgtgagatagtaagataagatgaaggctattataataactgtgttttaagccactaagtttgcggccatttgttaaagcagcaatagaaaacatcctgcctacccaactcaacgtctcattgcataggtgggtgttaccaccaagtcacttggcagtgacgacctctggtgcctgctttgctgctcacagagcagtggagagtggctcttactaataatgcctccaggtaaatattgctcagtaaatacttactgagggcctgccacgtgccagaccttgctctcaaagcttgggataactgctgggtgaaaatggtaagatgtgtgccctcaccaagtttcattctagatgcctctcagccctgccccatggagaagggccagcaagagtgtgaatttcacatccagacaccaaccctgactgcagctgctgctaaatagttgtgaacagcagtgacttttccctgaaaaagaagtcccttccttatcttaactacttgtaggaaaacatatatatactgaaatagtttccttccaggttattctgaagtgattctttgggactgataaaatgggacaaactgaatacaataatagttgctgaagcctagctcattactgctggatagaacctgttgtgagtacagagttctcagatgtctttttagatctccaaatcagtcaccaaaataaggaaaatagttttttttataacttaaagtacacacacaccaacatgcatataggctagaaagcctgatatgaggtgttagtctggtagattgacttcttgtttaaagggagaagagtttacagaggcagaggcacagggtttggataaacgcacaaacaagctttaacgcctcctctgcttttcttcaccaggtggggaaggcagggaagtggggggacccttaactaaagagaggagagtaaagactaagcagtcgaggcaggccaccaggtttgctgagggcagccaggaagtggtagagggtgtggacattccctgttaatcactggcccttagagagcaggcacttccccctgcagccagaggagagacagtacttctgtcagtggatacctggagggtcaagctgcgggaaaggagagggactcttacaaggccagtgagctttgaccagatgagcttaccctcaggtatcctgatcacgtggagactggccatatggcttcccagaccaaaataactcacctgtgcctgtgaaaccataccagggccagatgcagctgcactgttgagatttgaagcgtggtgctgttgaattcaagctgctgcatcagtcaggtttctttgccagctttctatccgagcctggggtgaccatatcattcatcttccaaactaggacacgtttaatgaaagggagtggagtgaatgttcaatctttagacaacaggtatgatccaggactgtcctggggaaacctggacatatggccagcctagctaaggctagaagcgttaaccattccattggatggtctgatgacccaaaatggctaagtacaacatagcctgtgtgtggaagggcctcagcacccccaggaagagagggattgtcccaggtgcccttgctagcatatgtctgtgcccatagcatagacagctctctgatgtaggggtctagaataggtgttttctttataatccaaatacaaagcaatatttatttttaccccaaaattattctccttgtatttgaacattacaaaattgttctcttatgagagctgcccttctgactactttattttggaatgacacagtcatctgttctaaacaccttggctaatctaaaaggacctcaatccattttagttgtgaatgctgatagaggttaactttggttttaaataaaaataaataatttaaagaaggaggcaggtcactgtggtggctcacacctataatcctaacactttgggaggttgagttggggagatcacttgaggtcaggagttcaagaccagcctggccaacatggtgaaaccccatttctactaaaaatacaaaaattagccaggcttggtggcgggcacctgtagtgcgagctactgaggaggctgaagcaggagaatcgattgaaccttgggaggtggaggttgaagtgagccgagatcacaacactgcacttcagcctgggtgacagagcgagattctgtctccaaaaaaaaaaaaaaaaaaaagaagcaaagaaatttagttcacattcaatactcattcctcaggatttagcatcgtaattgcaagtactggatgttacaaactttaaaacatcctggaaatgttctagaaaactgggttaggcattgctctctgatgaagtaatatcaaagaaacatacagagtttgattaaaattgcttgatgaaatacaaataaaattatttttaaatgaatgtttagtatgtgtgattttaaatgtttgtataaatttaaacgatcaaatgtcagttgactttcatctgcgttcataaagcttaaatatatatgttagccaaaaaaaagtttggaatgtttttccccgttatattcatttatttaggcatacatagtatgtgaggagtggtagtcatgataagagagacgttgtggtaacagctggggaaaggcatcccccttcaaactgggggggaagctaggctgggatgaaaatctgatgcaagaaatgattgtattttgacttgtggttccagatggcaaactaggtatatggttttgcttcctggctcctcaaggctccctaatagtttagagattatgaagaagcagaaagcagatgggatctgggcttatgaccttagcaggggaaggagccaagtctagagttcatcatgtgcccctccccgccccccaaccaagagtgatcaggtaaagcagggactaggagagaggagtgggtctggaagtgaaggaccacacaggggtccacagagaccaggtgattccatcgttccctacctctgtctggagtaggggctgctggcacttaacaccctggctgtggggaaaataccaaacccatagcactttctggggacaggcagataggggaatgttgacatgtacacgttttacagagcttaaattgattacaatgcacaaaaataatgaattcttttttttttttttgagaccatctttctctatcactcaggctggagtgcagtagtacaatctcggctcctgaaacctccatctccggggtgcaggcaattcttatgtctcagcctcccagatagctgggattacaggtgtgagccaccgcacccggccaagaatgaagtctttatagaagtagattaggccaagtcatgacactagaaataaaaaaaatgcctaaaactagggcttctagtgtgaatgctgggaccccaagaattaagctgtcctcattctggcatttgaagagtggtttgcagtctgataactagctggctacccactcagcctaaagcgaatccctggagtcagcagccccacccaggactccctttcagaattcctgctcagggtgagagcgagccagaaatggacctttttatacaacatcagaacaaaagagaacagggattatcaggcatgtgatgagagctagcagcataaaaggcaatggccgaagcaaaccaacagaaaaactacaagaaacagataatccaggaacacaaagaactgtaggaaaacttctaggcaaaatgcttagaattttgggaacatgttaaacccacagaataagattaggatctgttatgtaaaaggcacagtcagaacaaagagctcttgaagactgcaaatgtgactactgaaattaaaaatgtcagtataaataccagaaaatacagttgaaaaatctcagaaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaacatcaggtctacattgctgcagaaaggtccaggggctctgagaagggagtgtgagccaagatgagatcctgatttaacgcgggtatggcttgggagcttagagaagattgaggcttggataaaggtgaacaatagaagaaaaaagaaaggcaatgagaaaagccaaggaaagcaagagtcatggtccaaatgtgaagtacacaaagcaattgatagaatgtaagaatagcaagtctgtttgaccttaatgctaggaacagtttcttttgaggctgagggcttctgatactgctcccagacagaaaaaggaaaatcagaatacagtttggttcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaagggaaaatagaggtttaaatctttaaaactcagagtagcaaatagaggaactaaatctagttattaaacataggatgggaggtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattactttagcaaaaattaaattctgagtttgaaaatgggttaaatgtaaaggtgacacaattgccacataatgctactttctaactttttaggtcttaatttggacaaactaagcaggctgtgttttaaattaagcaataatagtgttcttgttctaatggtgcaatatttcatgtttcctctgaccagcttgcatagctaggggcagaatctttaatccttgaggaaatgaattattgccaaagacagtgaagcaaagctgccattgttcttggagttttaaaagtgtcccagtgtttagaacttttgatttgaagtatttatgcaaaagtataccagctctctttgggggagaacttgaatatatgaaacggatgtggcttacttgaagaattttgaaataaccttgtgttcatagcatgatagtgagtcctgagtctctgtgcccagagctctgattagactccaaagacctgaatttatatcatattcccagttactgttatacttatatcgttagatttttacattccattttagtatctcagtgtttatttcttatcgttaaagatgattttgtggttttgagttttgccttttaagtgtgggtttctgatatgctgaaatcccaaggcagtttttatttcggtgcagctttaaaattcagtggaggtcattgtccactggccggttttgaaatgatcttagttcacacccagattcttgccctttgtttagtttttcttgccttgaccgcatatgggaatagacctctcaggctctgctctgttaatttctatcacctccctacaaaggccctaactcatatcccttggtccctgtggctctgaaggtcgagttgtcacatagctctttcctccttcaaacgtactgggatggtcagtaatgagtgctgcagctgccctggtcctaggagttgctgtgagcatcctggtagtgcccagagagtacctgcttttcacactgaaccatctgggtggcctgggcccagtttttggcatttaagggccttggagggaaagggaagaaagctggaatttgagcataaattggattttgtgtgggctgagggtcctcctaggtgtagactgtccctcctggacctgtacccactctgctagctcaggagccaaccatgtcctgaacagcttagaccagcacccagaccctaaatgacctagattaggaagtagataggttgttctctgctgtcattgtttggacacagctctatttaccttatttattgttcctgctaggcacagcctcagctaatgggctgtgatctcctgcctttaaggctggttccaggcgaattaagagcctttgcttgtttcccaaaccagggagggcagctttaccttgaggatgaaggcgcctccagttgctgaatgtggttggggttactgtgttctctcatcaaggtgtagctttaccttacctttcggtgatgggttctgccaccttatcgcggtgggtcccaggagaccgggcgcaactggagcaggggcgccctctgctgctgggtgtcagctcttcctcccacggctgcccaggggatttgcaaggggcggtggaacactcctgcttcctccatcccctgtgggaccacctgaggtggaggaaggacagtgccaggaccatgtgcaggctgagctcgcccagaggcggtgcaacagctaacgttattctctgtgggtacatttctcttgtcgtttgcaggtctcttttcgaatctgttgtcctttttccccaaaccagcctgctgcccccatcctgccatgtggtctgctgtcatctgcagtagccgccgcatgtaagacacgaggacctcttctgcaagagcttggtgtgggcatttgtgaaattttgtcaccacagcccctgtaaccagccaacaaattcgagttaaatgcctattctttgtcccacacgtattagttacagagagtggagaacaagtggcagatagaggctgagggaagccaacccactctgagggactgggcatgtaaatgggacaacctccacagctttttaaaccacaggacacccaaaagcagctgtaccctgcaggacacagcaggctacagaagcctggggttcagagggtctctgacccttcgtcctttagcgctgctgaccaggctgctgatcctcgaccccttcttgtcacccattgtgtccctcttctcccttttctctggctccttcccttgcagcctttgcatatgctgtgttccttacctggccacctccagtcccgctgtcatctcttagtgacatcctcccttcctctccagcaggtgctggtgcccacagcactctgtaccatcctctcattgcctctagctccctgtggtttcatgacctcatgacctgttcacggatcaggcttccccaggccagagattgaggagtgggggcaattccttattcatcctaggaggctcttaatcagcgtttgttgagtgaataggtgaacgaatgtgggaatgggataaacaggaaataagccctgtgcctgccttaggtaacttagtagccaccttgggtgtgggtgagaagaggaagtggttaggaagacacacagttaagacaatgggactcctgtgctgctttttctaggcttctctttgctggtggttacctttacaggaaatctcttacccagccttcactccacccaactgcaataatgcttttcttccttcccctctacttggctctattatcttaacttttatcagcatacagaacagttttggttgtgatgttttatttgtgtaagttttgccctttcaactaggttgtaaacttgaaatcctgggttttacttcctaagcagctttgtaaagaaatggagacaacattgcaccaagataatttttgtcatggccacccactagctgtgagatcttgggggatgagtaattaagctcctcaaggcctctgtttctttatctgtaaaactggaggactggtctctctcaggggcttccagtgtgaaagtcctggggttctgggcctctgatcctggcaccccacttatcccttccagcaccctccacatgactccacctctgacatctgccaagtacagtaatttaacacattcaccttatagtctaggcagttcacctcccaggtacttgtttgttggcattcctgggatcggggacatcactggaataggagtggagcagacctgtggggacccttgtggccccggccttgcctctgtcctctgtcaagaaggttcaggcaccaaggacactgctccagttcctaatttaaaagtctgtgtgtcagttctgtaccttggtgtgtgctgttttgttccttcaaatgtagggtgggtttggaggtgggggctgactgtgactgtccagggatctgggaggaaggacagtgctggggctatgtgttatccatgagccacccctccttctctgtctgggcatcatctggcccccctccctgctttccaggtacacttgcctccggtggcacctgctgcatgatattggtttaaaaaaaatatgttgaatcctttattggaatgattcctttattgggacccaacaggcatgaaggtaatagagactatttggtttgtattttcatttgttttgcttttgcttctgagatttgtgggtttcttgatggccaggagtggcttgttttctgttgtaagaatttgttgtttgtacaggttcgtgttcccagtccttttcctcagctccagccttgtttccaaaactctcagctcttggtttatctctgtccagtcaggtgtgtgttctttgtctttgtttcttgtcctagttgttccatgagtcagccaggcctcaaagattgtaaacctgatggtgagtaaaggtgttagcaaaagagacctagcaacaaggtcattggatctctaaagagcctgtcaagctgtgagatggtgaaattttaaggactgtggatttggactgggggcctccttataggagataaaaacactcggctggggagaagaaggaatattacagtgcctagtacataagtggagctacaccagttgtccctgaatcctttgtgggagactgataggatgagagaggacgaactcttgtaatgtgacaaaagtgcaaggaagtaagaactgacttggaagaacaaacatcaacttgtacacctcaaatatatctgctttttatttgtccattctaccctaataaaactggagggaaaaaaaaaaaagaattggaaagaggccaaggctgcaagtgaataattcagtcgagttgtatcttacttaccattaggttctctcaattagtatataaactgaaaatctaagatatagtcagaattacccttgaaaactacctcaggaaggcacagtgttagaaactgacatattattgcttattacatttagtgtggccattttttccttccattgtcacaagtatttggtttcttctcttgagtttcatatgatatccctggcatcataggggcttagaggttgtattctttgaagagggtgtcttttaaacaccagatcatacccagcaagaaatgctgatactatgagagacaggcctattttcctcgttttggtatcccctctttggcttcccctgtttagttgtgtttgtgcgttttgcatgaaccagccataggactctacatttgttctcactcactgcctaagctgttgaagaattagtggactcctagacaaagaataatcccactatctcctagttctgactgatttaactgttaaacgtatattaaattcaaatctccaaattgtctctgtttcatcaacaggttgctcgtgggggccccgcgggcagaagcgcttccactgcagagagccaacagaacgggagggctgtacagctgcgacatcaccgcccgggggccatgcacgcggatcgagtttgataacgatggtgcgttcctttccctcactcagcgttcactccggcagcttgcctgtactgtttccatgagggaggagagtggggacaaacatttattcttgtagagaggacttcttttaattgcatcagacttgactgttttttatttgccctgaaaatatttacttactttacttctgaatcatactgggatgccgcgtgttttgctgctcctcctaaccgtggtttctaaaccgatatggtgtagggatgttgccacctagtgatgtgttgaggttctgcaggaggttgtggaaaaactcatttcatagcaatgaagagaatgaatgagcgtatcttgtattcatcagccaaaagttctcacatgctgttaaaatatttgggagaaagacagttttaaatatcagacccctttggaatgagagctggctaacagagataaagttttccctcctgtctcagatagagacttgttttgttaagggctctggataggtagaagataccatgaggtaggcatgttgacatccagtgtacctggcttcttgtaggttgagcagagcaattagtgtactgagaagctctagccaaacctcgtttgatatgttcggtctaagtagatttgcagattcgtgtctatgttcttctcttgcttcttcatcttttagaaataacatttgttggccaggcgtcggtggctcacacctgtaatcctagcattttgggaggccgagttgggtggatcatttgaggtcaggagttcaagaccagcctggccaacatggtgaaaccccatctctactaaaaatacaaaaattagccaggcgtggtggtgtacgcctgtagtcctagctacttaggaggctgaggcgtgagaattgtttgaacctgggaggcagaggctgcagtgagccaaaatcgtgccactacactccagcctgggtgacagagcaagataccatctcaagaaaagaaataacatgtgttcttttattagaaactaatatgtgttaattttaagaagctggtaaaatacacagacctatgaagaataaaaaaacccactggcaatctcagtatctagacttattttttaacattttggcatttttccttctgtctaaagttgtttaatgtttttgtaatgattcaagattaaaacctgtgtctgtattgctacttatggaggagtgcaaaatttggatataggtcacacagtgggtttaaattgatactgaaatgagcacctggtggtgtttgtggtccccgtctctctgactaacagtaactctcctgtttggcattgatacattgtcagctacaagatcctaaagtaaatctgagtctttttcttccatctccagtaaagaagagaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaaaataggcaactatatagagctaagtactttatgtttcaaatgtttgaaagattccaaaaaccacatctctgtttccttgagatgacaagtaatttttctggattgagtaactgaatttattgagtagctagactcagagtcgaggccatttggaaacagttgcttgtatttttgttcagtgatggtttctagcatgtgcagtcacttggaaggctaactatgctcctttctacagctgaccccacgtcagaaagcaaggaagatcagtggatgggggtcaccgtccagagccaaggtccagggggcaaggtcgtggtaagtgtagagacacatgttcatcctatactgttggactgctggttatgtgccagcaccaggcttacagcaggggacagcagggagcatacattctagcgaacttactgctttaaagcaggaatggatgtcaaaaagaaatcagactgggcgtggtggctcatgcctgtaatctcaatactttgtgaggccaaggcgggcggatcacctgaggtcaggggtttgagaccagcctgaccaatatgatgaaaccccatctctactaaaaatacaaaaattagctgggcgtagtggcatgcgcctgtaatcccagctacttgggagactgagacaggagaatcgcttgaacctgggaggtggaggttgcaagagcaaaactccatctcaaaaaaaagaaaaaaaaagaagaagtaatcacgtaatcaaagccttatttctcctgtgattcctgatatacttagaagcaatcacacaacctacttttctttagaactttcagatttaaataacttattaaagaacctttactaaatattcctacaactctagatggtattaaaaacaaaacaaaactagacatcatttctgtccttggaattttatagctttatagataagttagtaaaaatatgggcatggtcttagaaagtaataaccaggtagttttaacctcttgttatttattctgagttttttcaaatagaagggatagcaaagaaaagagggtttgttaggtggattgggctagatggtcatggtaaggccttcctggttggaatatgatctttttgtctccttcaaaatctggttgctgtaacgaaatttatacagaattttgagaaaaaaaatttagtgaacattgagttttgatatttaaggaatgacatttatggaaaattgatttgatactgtatttttaggctgtgtttacatggaggttagccattcataccctgtagaaattatagagattatttctgtctcttctggccttgtaattctctctgccttttaaaagtaggcatattttgggaaataatctcagagctcagggtgtaagttaggactgattacaaggaaatagtgtggggaaaaggaaatgtctttgttttagctgtgtttgtttgatccctatgaaaacaggtccatgatttctctcctctagaacataattacccactttcacactgatgttctgaaggtttatacagccactaaaagccaatttgaattaagaaaatgaaataaggtgtttctctttgtttatgtgacaggtaaatttacaaataaattgcctatggatacagattgtcattcaattttggattggaggattattctgagtgagaataaggcacattctagtttctatatgtcttcataatggtctccttagtgccactttggggaatatttgctggtctgggatccggtcccaagatgaggacatgcttaatcatcctctttagaattaacctctgtattgaccattttattcatatgtaattttttaaaaacaaggtttatagacaagaatgggctactttcttccatctgcttgcagacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggtatgacctttgtatttatagaaatagagattagttcccctaatttctgtaatatgatttagtacattttgagctaaaatgtgttagaagacattcgtatattataaaagttgggtaggatattaaaaatctctaaatgatatgatttttaaaagctaataatagtggaatatatgttttggtgttgacattcttttcccctctaccagtactttactttaattcaggtagttaacttttttttagcaggaatataataattaacattagtattttttgctgttttagatttgtgcgactcatgaagctggaagtgttaattttaagttagtgatctgaaaacttaggaggattaaataatggtatatacaaataacagtgtattaacatggacattaataacagagtattaatatggacatttctctctgtatatgttattttcaaaggccatgctttgctaataattcagtagagttagaagggcagattacagacgaattggggaattttgaggtataatttcagatatgtgaggaaaagtcgtttgattattgtgatgtgagtaaatggagatgtagagaggtaaagaagaaaatggcccacattttttgactgtgtatgtatagaaaatgctatatcataaaagacaacctaactctcatccatgatgaagagaactgcatctgatttggaaataagccatttttgagaaatgtattaataataagtcacataacactttcactcatcagggaaaacttaggaaaatggtcccttttccattcaacaatttgttttaattgtggttctaaatgactcttgaacacctttctctgtgtgcaatcttcaagggtaatttccctttgcccccacctccaccccaacagaatcttcatgtacagtatttcccaggttattttgacctaactgaaataacatgttgaatttagttttattttagcatgaataaatgctttatatagtaaaacaaaacaaaaatatccaccaattatgtatattttaattcatggaaaatatggtttacctgctttataaacctgacctaaaatgtcgccatttaaagccatatagtgatttgggcttactatatgaaaacttatgttttaaattactaattgtaagaatttttaaaagatgaaatcttggttaaagtgatctaaagaaaagatcaatatgtctcacttttacactgcaaaaaaaagacaaattgaggcaggattacagagaatgtaaaatatatatatcaagttcatgtcatttaaaaattggttctctgtagattttgttaactaagcaaaccttccatttttcatctagtttcatggcattataaagatagttcatgaaaatgcatgggacagtttttaatgactcaaacaaatttctttcccataaaaatttacacaaatgtattttacaaccataaaagtcatctctgtccttcctttttttcctccaaattttttttcctgtaactagtgatagcatgggggatgtttattaggaaccatttattttcttttgtttcatcttcatttttttgttgtttttaccatttcattcctttagggattgttcgtgtagagcaaaagaataacactttttttgacatgaacatctttgaagatgggccttatgaagttggtggagagactgagcatgatgaaagtctcgttcctgttcctgctaacagttacttaggtaggagcaggcacagatggctgcctttgcccaccttctcagataccttgtgtgaaactccctcgcagggcctatggcccctggacttctaggctgagaagaggccaggtggggccgggccacttttgctggaatttgataagcttggtgatctagaggcgttaaaccgactgatgcctgggatcctttccttctgactggggctccctcaaagggggaagaaacctcttatcacctaaaatcatccgtcctccctcctgctcagaagtctgtctcttgagctaatggcagcctccgtaacctgaaacaggccgctcatgcagccatgaaaacatgcatgggtgttcacagtaagctgagatctttgttcagtgcctccttccagagatactcttaagaactgcatttaataaagttactcttaagtggcaagtcaagacctccaggtcctccctctgtgattgtggttctccaaggattagccctgcttctggattgggaccccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaagaataattactgtgcatttcttggaaaaaatgtaaaaaaaagtctaaacccaaatagtaacctgtttaaaaaaaaaaaaagaaagtgaagaaaagtacccagatgttaggatattactggaagaatggaaagtaaaaaacgaaaaaacaggtatagatacatgaataatttcaagcaatgtgctagtaaacacgcactaataagttgttcaggccgggcctggtggctcacgcctataatcccaacacttcgggaggctgaggcaggcggattacttgaggccaggagttcaagaccagcctggccaatgcagcaaaaccccttctctactaaaaatacaaaaatattagccaggcgtggtggtacacatctgtagtcccagctactcaggagcctgaggtaggagaatcatttgagcctgggaggttgaggttgcagtaagctgtgattgcagcactgccctccagtctgggcaacagagcaggaccttacctcagaatgtttcatttagggattacttatgattaaaatacttgattgtaattgcactggccaagaaaccaatactttggtctttaagatggatggctgtggattttataaatttacttgctgtcagaacatttgaaaatatgaagcattttttctcaaacacatttgccacttttagaatggatttcctcaaaagtgaatgcctgagaaagaaatcaaattcatattgttacattcggtttgtctgtactgtgtggaatctgtcacttcaaaagatcagagggtttgggggaacaaaacgatctgcttgaggttttggaagctggcaatgagagcagcttgccggatgcagtggtggcctcctcatccagcgagaacagcagtggctgtcctgcctcttaccaagcataattactttttcttcaatttcttccgtcccgtgcatgcgtacaggcctgctgtttttgaccagcgtttcctatacagatcctgatcagtttgtttataaaacacggcctccccgggagcagcctgacacattccctgatgtgatgatgaatagctacctaggtttgtgacctctgcgacgacaaataaattgtcttggttgtggtcattaaatttttttttttgatccatacagagcataaatctttttatgccctattttgtttccattgaagcacacacaaaaagcatgccatggctggggctctgtggccagatggttgtaagagctggactccatattgccctctaatctggtggctcatgtttttcaattcacttcacaatttgagaactgcaacggtagtggtgaagcttttcataagtaaaacccaataaagggggtgagcttatattattctgcatctgcctcacctttctatagaaacatttacttaatttgaatggttttgatatgggcacttctatttgcttttcaccagatctgttatttgtaatctgacatcctacctgatgctttataatgggtgtgtcctaatgttttctgccctctgaacaagtatataactgataccaatgacaacttcctcacctctgttgtttatactaggttctcaaataccatgtatcatcagtcattgttttgtctgcatgtttgtgtctgagaactaagttggtccaaaacaatgaaatgctatctatggtgtattaatgatgttagcatttgtttttgtctgattaccaaagagttgatgcctcttaccaagcttaattactttttcttcaattttattttattcctgtaaaaatactggtcattaaattacagcagaaccctgtaacatgcactcaattatgcttccagtcaggttatatattctctgtgtatatgatgtaacataaccaaattattcctggacaattcagtatctagcttgatctccttttaccatagttccaatattaaaatagggtggaaattgattcttaagatgtatgaatacttcaaaattcaagttatacataggtgcttttagttaaaagtcttaatatccatagaaagcagtaaattagctagccccaggactttgtccttgtgtcacatctgaactctgtcactcatattacgaatgtgatagctggtgggagggtcaagaggagagaggggtgggaagccagaggaagaggtaatgatggagttaccaatgtcataggcctaaaatatatggattgatgtgaggggctctatatattttgtttttctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtgagaaagcctcaggttatattatgctgcaaatcatttctgctttgactagcttctatacgactggagaagagccgtcctttcaggttcattgacgtaaagaatatttttattgccgcatttttaccagcctatctttatcatttctatgatggcagcagacagacattcatatccctccccagcgtataggattatatttttgattttcagtttttacttatatgttgggatcatgagtctatgagaattaaaatttgaaaaaaattgactcagaaaacacttgcatgattctgttctgtggtttcatatggggctgatggagcatcagctcccgttgaaaacaggaattggtgataaagtaaaaaacagatatgtggctgttggtgccagttgggggggttagaacagtgaggtcttaatgggagtcctgctgtactatggttctaactcgagaaattggctttgagttcttacccttagtatttttcttggggcgtttattataggctaccttggtttttaaaaaatgttataattgagtcataaattctggagttgagggcctttctattatatgtctttgtatccttagtacctagactggtgttgctggtatgttagctgttggttcacggctctttcccctcattatgtttttaggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccaggtagataatagattatgaaatggctatgatttatagattatttgattgtttaaataatagcgctgctgggcacagtggctcacgcctgtaatcccagcactttgggaggctgaggtgggcggatcacctgaggtcgggagttcgagaccagcctgaccaacatggagaaactaaaaatacaaattaactgggtgtggtggcacatgcctgtaataccagctactcccagctttggaaagctgaggcaggagaattgcttgaacccgggaggcagtggttgcggtgagccaagattgcgccattgcactccagcctgggcaacaggagcgaaactccatctcaaaaaaaacaaaaaaaaaccccgaaaaagccaaacaaataaataatagtgcttgtgtcatcttactttaaaacattttactagagtgtttctaaagcgtttgttaaaatgttaaaatgtgatgttgtcaacagatattgcagttggagctccgtatgatgacttgggaaaggtttttatctatcatggatctgcaaatggaataaataccaaaccaacacaggtaaccaaataaccgggatttctacagctagagtctcaactttttgccctataataaaatatttaggtttaagtgacttttcacacaaatcttattttatttacaagtccacaatagtataaattttttaaaaatgtattactagaagataccttcaaaataaatatataaatgtaatgacttgcttgttctaattgtaaaatttcttagataagttaggaatcaaggtaatccaaagcaaatgaatgttattctaccctgacggcattaagataagaggaaatacgatatattctctttagtagcatactaaatagagatgaaattggtcaaacaaaataaatgactgtaactacatggagaatgtagacaccaaaaattaaaaatgtcttttgagaaaaataagacttgtagggaaggtagggagatttggtttgaaatggcctgattgacttaatacaataaacaagctcatcagaaatgggctcttttctgctttgagatactatgtaaatcggatgacttttatgaaatgaaatgtatgaagtgttagatcatatagaaatttatgacttgtatataatataatttacttataagtgaactctcaaatttcagttcaaaagaaacttgtgtgtctttttcaaagcattgttaagaagctcatggtgataacctaatgtccattcggatgccctgtgtatttcaggttctcaagggtatatcaccttattttggatattcaattgctggaaacatggaccttgatcgaaattcctaccctgatgttgctgttggttccctctcagattcagtaactattttcaggtctgttatctatgattttagtgttaagcatgttctataatcaggttatactaaaatgttgaccttttggactgaaatttgtcatacctatacttcaaaggtttatatgaattgtgaagctatttctttttcttttgaagttagtaaacaatgtaataacaacctattttctaaaatcttttaaagtatctgaggaaaacatagatccaagttagaatttttacttcatatatttttaaaaccttaattttgatgatgaaaaaaacaaaacacatataaaatgtgacagtacaaagaacatacagaaggaaaccccctataattcaccatgcattattaaactccaagatcttgatttctattttattttctgtgattggaccatgtatatttaacaaaattaagaccataattgtgcataattttgtaacctgcttttgtctctttaggatacatagtagacttttcctatgtcactgagtacttttccaaaatgaagttaacaactgtctgtgaggcatcttctgacaggttcagagcttatttaaccaactgccttgctctcactggatggttacgttgcttcgcaatttttttttttgctcccatgatataaaaagctgtggaaaacattcttacttttgtttatatccttgattatttccttattataaattcctggatgtgaaattgatatatgtgcttcaagacttttgattcggtttcgccaagatgacctcccaaaatggtgcgacatttcccatccgtggtgtttgagtctccctttaaccagcgctttcatcactgctggaaatcaccattaaaaattggaggctttttttggtttgttttttaattttcaaaaagtagcagatttattttttttaaagttaataatatagaattatagaaaatccagtacattattcccatcttccacaaaacttgtgtgcatttctctacttttagggtatcatcaaaaggctacactgtaacttctgctgtctaatctggtttttatttaatcttgggctatctctccttgtcaatacaatagatgacttaactttagtcagttaaatgtttgcccctgtctatgtgtaactgatattttaatatccttactttcctgtcctcataagtaggttgactgtcaaccctgtacacttgttccctctttacttgcagatagtgtgaaagtagaattcaacaaccctttgataagaagaggagtaacttccccttattttacaaatgaggaaactgaggcccaggacttggcttgagcttttaaggctggagcctgagaggacagaatgtagcacctaaatcttcctgacttgaatcctgtgcattttttctactaaattgtactagcacttcagggtagttagtaaataaacaccaattttaaacatgaggcagccaaactaataagacttattttctatgttaaaagacacagttttcataattcatgtatattttgccctcaaaattgtgtgttgtatgtttaaaaaacaaaatatgttctaggcagaaatgtctgttaaaattctacagtatgtaaaatactatatctgtggcaactgtgccttttaaatatgctctcaaaacttaagaatgtatctagttagtatcttagaacctagcagctgtctaaatgtaaaataaaaatagaatggtaaacaataaaggaaaatggaaaaacagggaatgtgggcagtatttgaccctttattggaccctaccttcactgtgaatggacttgtgctctagcctaccaacagattgattccagaagttcgagctagctgtttgggatttggaatgcattttcttgtagaaacactgttctccagaatggctgggtttaccacaagcccatcagagtcagcctaactgaatccacgtggtaatgaaaccccaggccccattctgagttctggtggggagcaatggaggtgggcctcctcacccactcatacccctcaacccaccgcatacctgcatttcttgtgcctgtggcagcagttgggccacagacccgtggagacccctgtggctgctgggagcagggcagccaaaacatacgaaaagatgttttcagatggtgaaccagagtagggcgtggaattggattccagcttctcaagtgtttgcggggttgcagtaggcagcgcagagatgggaagaagtttaaaagtttaagtttttgcttgcagagatatcgtgggggtagaaaagttgtcaatcctggcaataggaaggcaaagactgaaggttgtgggtgggagactccgagggaggctgaagagaagggcaagtgtttgtacaatggagactcccaagttcaggattgcctgtattaattcacatactgtagacacgctgatcatgagcatctcaggtattaggtgtttgttggtgtaattcttccagagggtatgttggcaagactactcgtaattaaaaatgcacatattctttgactccaaaattctgctgctgggaatttatcccacagataaactcaagtgtgtgcacagatgatgtttgtgaaagcagaaagctcaacaacgtgaatgtctaccgattaggtactggttaaataaaggatgttacactgatacagtgtaacgccatcaggtgtgaaaaacagtgaactagatctatgtgtatatacaggacaagacctctgaaatggatgagaaaaagccacatacagaacaatggcaattaagttcccatttagttgaaattatacatatattttaatatttaattttagataattttaactgacgtgtctggaagaacatacaaggctacttgggtgttcgggtgggaatggagacaaaatatttactttaacccccacatgttgcacatgtactcataagtgtgtacgtttttaaacaaatattgtataatgaggctctgcattgtatacatttatatctattaacagttattttcttcagcaatgggggaaaacgtcacgtgtattttttttcctgtgtttttaagctgtgctgggcagctaaggatgctctctagtatgtgaattagactcacattcaaggtaacagaggctgagcttgtttttcactccttttgtcttcagatcccggcctgtgattaatattcagaaaaccatcacagtaactcctaacagaattgacctccgccagaaaacagcgtgtggggcgcctagtgggatatggtgagcatccctctgtcttggtgggatccccctcagtttcccacctccacttcatgatgactctattgtcctgaggagccacagggaagatgacaggagtgctgggcaaagggaagagggtctgtcaagtgtttttataacatgttgatcatcaatgggcattggggggattggagagctagggaacatgttgggttttttccactgcaataatggatcttttaagaaatatgtgtttgattttattcagcctccaggttaaatcctgttttgaatatactgctaaccccgctggttataatccttcaatatgtaagtacctagtacctttaaaatatgtctactttctgtctgccaggttgaaagttctgcataaatcacagaaaaataaaactgcagtggccaacatgggtctgtcaattctggtgtaaagaattaagtgtatgttttgtctcccttttaatcaggagggcacagcaccgtgagggaggaaaaaaactccacttggtcgccatttgagttttccagagcagatggtttaggacagaatggcttggaaaagtacttatttgctaccacaaccatttcctccatttctgtctttgaaaagcagtgtggaaaattgattttgtggttgtgaggtggtgggtggtggctggtggttgtgaggtggtgggtggtggctggtggttgtgaaagggcaacggcaggagccagagcacagcacagagtcactgccaggctgccttctcttccccacgcccctccctcccggaacacccgccctgtgttcccaagagcaggcccctagggaatttgcaagccggccctgagaggtcagagacctggtctctgctcctggtttcagctttgatactgactgacccacagggcaagtcccttaacatatgagtttgctttcctgtccgttcagaacaatgcctagtagtcattagtgcatacagttgtgctggagatcaactgagaagacatgaaaagcactttgtcatttattagatactgttctgcttcctttttttgtaattcaaagtaagatttttttaaatttttgtggatacatagtaggtgtatatatttatggggcaacacaggatttttgacaagaattttgacaccgttaatgatactcttaacaatagtggccgtcgtaagctctcctctggcatgttttaatagcagccacacttcttcagctgtgagtcacctgacccctggctccagagtcaaggccaggggcataggaattccaagaaaatcttttctgcaaagaggaagtgaaaagaatgaggaaattctcaacccgggtccggccatggtcctggcagtttgggattctagtgtactgtatctgccaccaagggacactttgtgaagaacaaggtcattctgtcctttcatatggttgtcagcctttacgatactatgaggtaatgagtcctctgaagtgttctccctgttatctaaagtagtagttttctttatttaaaaagatgtcccttataatattccagaatataacctaattcaaataacctaaagttgttgcttgaaacaggaaaaaatagccacataaggactagggtttgcaatggtgaatcctctcacacgtcacagctctgttcttagctgtactctaattcttctttaactttatatgaagttttatataacactaatgaatgtatccactaagacaacagaatgaagatactgacctgtgataaagttcagtgaattatgaaaagggacagtttaaataaatgtactgtctttaattttttttaagtcccccttcacctgattctcagtgtcataagctcagttagccttcatctttccagatttcgagctgtctgcaggtggtttctccgtctccccttctgtggggtcgtctcctgctgtgtggtctctccatgggacctgcagaccttgcacgaagcattcttagagtggatggattatgacttcgtgcacagggggagctgtggccttttgctttgctttttgatgcagccggcattttgtcgagtgtagaaagcaattctttgtgtggcttttaatgacaagaaaatgtatactgtgactcttcaggatctatcatcctttcagtatcatttgtgttatttttacccaaatgccataccttacactagcccacttggataatgggccctttgccagtgtttggaatgaattagagagacaaggagaaaacagtgattctttgactaggcagccagagaaaaaggggaaacatttttattctgttctgatggccattttttcaaaccactctcagtttgactgtagatgtgaaatatcatcagagcactccttgacttcccccaaattaatcacctatataaaatacagactttctcctagctgtagcacagcatttgatgccatgtgtattacttttatgttatgtagctactccattaaccaagtgtttatggatggccttttatgggtggaactttcctttgaagacattcaaagaacatttgctttcattgcttttacttccacagtaaattctaaatgaactaagacagaacttctacaaagctacataagttaatacatctaaaatcttctcccagtagccaagaatgtgagcttattgtttgactgggctattttagctcagcagtcctcagatgtggtgttccatacatatagatatctataattgagccgtaatgagtgttctacttggcttgcccctcaagcagttagcaaaggtggcctgcaaagattttaagatgatgtggactgtctggagggttagggaaggttagagtgaatttggcagataaacggttttcctgcacccacacctcccatacttttgctgtgaggggcacttttgctgtgaggggcactcagcgtgtgagcctttatctggttcattgtgaagctagcaggtcacttataaatggatgatgtcaaggctgcagaggcctaaaatgggggagcattccatttggcagctgtgacatttaagaattctccagatggacacaaaaattactattgaaactgtcagtgtttctaaattttgttctgaatagctcacattcagcataagaatgtcacatcgtgtgtgtgcgcatgtgtgtgcaagtggggaaccagttactgccacttctgttcatctgttccataaatcatatgtctatcaggtgttgtgctagttgctggggactgtggtggggaataagactgatgtgatccttgtcctcggctttgccccactgtgggagacaatcaggaaatcacagcgtagtgggcttaaatgtagagactggagagatggaatactctaggatcgcgaagagaggccaggacaggcttcctggaggaggtgaggtccaagctgaaatctgaaggggaagggagggcttagccaagcaggccaacactgctgggaggtggaagggaaaagaagggaaagacagctggctgagggaaggagtgactcctgcggtggttaggaggcaagtgagacctgggcatctaagaccctgtagaaagcaatcgccttttgtgtttgtgatagagactcagaagctggtgctgcttctgtccctctcagtatgaccccaagcctccccagaaaaggtctcttccaactctaaagtgaatattagaatgtgagttattcattttctgtgttttctgtagcagatttttgtcctggagattgccttctccagccctctgcacactttggtttgctttcccttttgatggttagtgactgcttaatgaatgtaagtaatttaagtattggcccatgaaaaacaaagttagcagccacatctaatgaaccaacaaagaatgcgttctgaagtaaaaaaatgagattctgatcatccacatcctagcttccctccaggttccattagtgtaggttatcaagaacaggctgtgccttctagcccagtgcaaggtaggcagtttggttgtgggagctatattatgctgaccgacaggccctccatccactcaaaaatatataatttaccttgtaattcttttttatctttattattatttttttgagaaagttttgctcttgttgcccaggctggagtgcaatggcatgaattcagctcactgtaacctctgcctcctgggttcaagcgattctcctgcctcagcctcccgagtagctgggattacaggcatgcgccaccaagcccagctaatttttgtatttttagtagagacaggatttcaccatgttggtcaggctggtctcaaactcctgatttcgggtgatccacccaccttggcctcccagagtgctgggatgccaggcagaattcactgtgcccatcctcttttttatttgttaaggtaaaggtctcatcctactgtcgaaagacttctccatctctaaaatatattattcctctgtttagacaactatcctttatcagtgcttcttaaaactttaatacgtataagaatcatctggtgatgctgttattaataaagcagattctgcttccgtaggtgtgactgggcctgaggttctgcatcctcacaggccctcaggagatgctgctgttctagagatctttcccagatagcaaaggcacgaggccacttgaataagcattgactggtttaaagggagaaaatcagtttaggtgctcgggggagtgttgggttcctctgcttatcgttagtattctgtgggttcatgaacttcagccagaaactgattcttaataactgctgctgctgaaaggttttaacttattcttgagctcccccaggtggcacaatgaaaatttaactttgaaacattgttaacagcaaaaggaaggaaaagacagcttgatttgaaccatcacaattgtgcaaatgcatattaccaggaaatatgaagagaaacaatggcaatgttttctacaaggaattaaaatcttaaaaggagttcaacatgcttgtggctggattgtgcatgaatgcacttacgttaatatgattttaattttatctagcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggtgagggctgcagatggtcacatctgttttatgaagaggacagaaaaaggttatatggtgatatacagatttctgaaatttattctggcaacctcttaatcaatacaaaatcattgttttggaattccccaatagcatgtacaccccacttaactctgactgcatgcttttcatgcaggataatatcagagataaactgcgtcccattcccataactgcctcagtggagatccaagagccaagctctcgtaggcgagtgaattcacttccagaagttcttccaattctgaattcagatgaacccaagacagctcatattgatgtaagtctctctgactttcattttgccaaagtttttttgccatttatgatgctaaatcaaatgtctttgaagggaatagaactagtgatttgctttaaaggccattcttttgtgttaatatgtttttaatgtacgcaaagttagagaagacttgtttcccaaattagcaataaacataaaaacatgaaatacaatttggggccagagcgtattttccttcttcatttttggccattataacctatcgagactataaatggtagagcttatattctaacactgtttctcctttagctgtacatagaaagaaaaatacattgtgttttacttaccattgagaatactgaaatgtagaaagcagtgtgttgctagtcagaacattaaaatcaaggaatatcaaaattcagcaaagcaaaaaagtattattagcatacagtagtcatttagtgcctaatatagcctaagtcatctttggaagaaaaatgtgtattagatggcctgtgggatacctcatatgaggtggggtctgtttgctaggggtttaggatggttaaggtgcaaggttagcccgggcagctatgacagcttgatttggcattatgttcttgctttcaaaatctaattgatgatgaacgggtgtggtggctcatgcctgtaatcccagaacttcgggaggccgaggcgggcaggtcacttgaggttaggagtttgagaccagcctggccaacatggtgaaaccccgtctctagtgaaaatacaaaagttagcgggtatgatggagcatgcctataatcacagctactcaggaggctgaggcaggagaatgccttaaacccggcaggtggagttgcagtgagccgagatggcaccactgcactccagcctgggcaaaaagagtaagactctatctccaaaaaaaaaaaaaaaaaaaaacaactaattgatgatgagtgtctgtccactatggggctgctggtactggtgccttactgaggcagctttgcagaagtgagtcctcactgtctcaggagctgatgcttacatctgcatattgtcaatcatttttgtcaccaaatatagttccttatatttctgtatacttttatgtacttttattattatcatgttaatattacttgtgtacattcccagctccatagctagagatgattttctatttatcggtgtgattatcaagaacccattggcatggtgctagtatgctgtttgcttacctgaccttaagctctctgtttcgtcatctctacaatggagatcataataatagtatctttttagaggcctgttgtgaggattaaatgagttaagatatgtaaatcgagtattataatcgttggtatcatcattattattgatacttcttatagtagccctataaagttagaatggtggtatctccacgttacctatgatgaaacttggactctgaaaggttaagtgacttgctagctaagtaaggggtagagctgcgtttcaaacccaaatctgtgtggctgctgggtcacactcttctataccacactgcctccatgccctggtcaaagtgttcttcaaacacaattttactaaaggacagaatggaaatttgatgtgtggcaaagtacatttaaagcttgaattctgcattggtaattgtcacacagggaaatgaactgtgtggaatagccagtcacctacatcgatgccttcctgagtcctgaatggtgtaaattgacaatagttttcgttttcctacaggttcacttcttaaaagagggatgtggagacgacaatgtatgtaacagcaaccttaaactagaatataaattttgcacccgagaaggaaatcaagacaaattttcttatttaccaatgtaagaatcgttgtgtagcactagcaaaaatgattctggcttcatggtggctttgtgttaagaaagtttactggaaacgtattgaggactttgcctttttgttcttgttttcttatttttaatagtcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgtaagtattgttagagaccagctgagaggggaaaaaaatcaacactgtgtggcaaatgagtggattgtgacctagcgtgtgtttcttttacaggagaaacagttgagttgtgttgccaaccagaatggctcgcaagctgactgtgagctcggaaatccttttaaaagaaattcaaatgtaggtgatgccttcatatactgtattttactgttttaaataccattgcagtgtctgtatgcatggcctgtgttaacagctatttatgtttttttaggtcactttttatttggttttaagtacaactgaagtcacctttgacaccccagatctggatattaatctgaagttagaaacgtaagagttacatcaacctctccattcagaattatttcatgaaaatatgggcagtcaatgaattggccctgatctacctcataaaagaagtctaattgtagtgagaaaactgactggtaaaatacaaccctattgtttccttttcattttcagaacaagcaatcaagataatttggctccaattacagctaaagcaaaagtggttattgaactgcttttatcggtctcggggtaagtgtttgtgtttagcataacaaatcaatgtttgaaagaaccatttacaatcctcattaaaactggtgttttttaatttgacagagttgctaaaccttcccaggtgtattttggaggtacagttgttggcgagcaagctatgaaatctgaagatgaagtgggaagtttaatagagtatgaattcagggtaagttggagcagttggtcttttcattataccaaaagctgacatatactaggtatggtcttgagtatgtcattttaataaatcagcaatattaataagcattgtaagtaaatcatgagttaaaaattagtttgccagcttttaaagaacatactggcttatagtaaaaattttatcctccaggatggagaacaattgtcactgttcagaatccagttcagtttagaatgcgttatgatttattccttcctcctttataaggtcatctttctcactgcttgtggttgaaagaatattaatgtatgcctacctttcacaagcccagtttttgtggtgaatgtagatttggtatatgcctgtaggaaaggcagtgactggctctgaaccatttcaaagtaggcaatcacagtgactctctgtcctgttgaataaacataaacatagggtacagagtctgttcgtaactcacacatgggtttaggtctgtgtggctgaaatcacattcctgaaggcatagtgaccactgtggtgaaagcctcaaatggcaagcatgggcccacctgactccggcagaatgaagaggctgaattctcctctgtgtgtctcttagcattatagacacagctggggcaggtggtggtggtggttatgatctctatgcaggtgcagctggaaaagaagtctttgggttctggaacagtctcgacaccaagagggctcttacctcctgtgtttggcttctgccgcaggacgtcactctgttcccagcttggactctcagattcatggctgtcctaataatggttttgcagaatctcctctgggacagaggcagcttcatttttgcagtggatggggttttccagaagcaggttgttggtacactgccttggcccaggacttgtcattggccaagcagggtggttacagggcagttcacaaattcacacatgattttccctgggcgtatgttgagaacatggtatatctacactgctgattctgttgcatacagcagttgttcctagaacgagttagctatcagttgtcctttgacctttttgtttttatttacaaaaatctttaggcacaagtctttattttgaatgccctatctatagtccatttttggagcctgtgcttttattataggattacgttagatattttagcttctttctcttggtaaaaggagctgctacttaaatttacattgagaagattagactgagataatatgtattattttctaacaggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggtatgtcggtagatttatctaatgtctccataaatgcaaattagagaaactaacttgttaggggaaaatcattactgttcttaggaaagtggcatattctggcaggttgactttctctttggttgtcacaatttctcttttctagttgggtaactgagggaggctgaggcatttttgctggttaatgaccattatagtacataaggcagagtcattcagtgcttgctgaggcaaatggtattttctgatgtttcatcatgacccagtatgttacataataaggagaactgggggatgctcctggggtaatagtagctgctgttatccaggggccagccagtgttcactccaagtagaaccaaactcattggaaaagataatggcatctcagcaagtaaccttgaaagctttttatgcttatttttaaaatagtaattatttattgtgtactcattgtgtctcaggaactatgctaagcattttgttttcattttctcatttcattctctggatggtcctatgagggcgtttcattatcctcaccatttcacagatgaggacattaagattcagagagcaagtaactctctcagtcactcaggcgttaagagacagattccacatacaagccctgctctgcctgatgtcaaagcctgtactgttaacccctctctctatactgctccatgcttagataactggcctatcatttgtgttccagtttgatgaaggtttgcatgtttatttcttttattttaaattctaaggtgactgggtatgatcagtgatcagagttggtggcttatagcatgatcttctactcatcaatgttaaaaatcaagataatcggttattactaatctttgctataaggaaaatgcaattttaaaagttcttgtatggcttagttttcattgctctgctctgaatgagctatataatgggtctttttgcttctttctctgttcttcagtgtcacttattccttcaagatgtgctgactaccatgttttaggaacagagctggaggctagggatacaggaataagatttgatctctgatctcagtatgcccacagtttggtggggatacagaggaacaaagaaagcatatttctctttctctgagttttaaggtcagagtgggaatgaattacttagtcctatgagtaaatcaataaacttgaatttagagtgataatacttgctggttttacacttacttctgtgcctttggcaggagagaggcaaatattgttgattatgtgaatctggcactgtttgggaggatatgctcaagaggcttgtatggtaatgacaaagaattacataaattggaactattttggatataatttttttcaggagtctcacaactcaagaaagaaacgggaaattactgaaaaacagatagatgataacagaaaattttctttatttgctgaaagaaaataccagactcttgtaagtatttttcaagagctgtgaatatttgagaggatgaggggaaggatttcttcagaacaatgtcttttgatgaccattcttctttttctctctagaactgtagcgtgaacgtgaactgtgtgaacatcagatgcccgctgcgggggctggacagcaaggcgtctcttattttgcgctcgaggttatggaacagcacatttctagaggtatgaccttggcttgaggctgtcccatggaagtaatttgcctttgcctaggacacttttcacttccctaatgcattcactgtctccaaacaggaatattccaaactgaactacttggacattctcatgcgagccttcattgatgtgactgctgctgccgaaaatatcaggctgccaaatgcaggcactcaggtgagaggttccccagcttcattcaggttcagaacatgtctcttttccctgtaccccacactcatgtcctgaagtcatgtgctttggtgctcatttccctcatagccccattacggagaaaactgtcttaaggtactggcactgcaagctgtattttaatagaatcattgaaaaaaagaagtaaatctagggtcatccagttcagcagtgcccatggtaggtttgagaactactggctcaattcagagaatgggtgcacctcacagccctctagaaacctgtgtcttctaccatctctaatgctgcagccattggtgtaatgccccagtgatggcccatcccttggccagctgtaattattaaaaaagatctcttcatagctgactcctgaactgaaccttgtaagtccctggttatgcccctcaaacaagtctaaaataagttctctctcttggccatgtagcagcctctcaaataattgaaggaaatggtcatgcctccttggatgtttcttattcttctcagagcttatgcacccagctcttgagttatgcgtcacattgggcacagctgaactggctcctggcctctcccttcctgggcaatttgattcccacgtggacagagcagctgaggtggggtctgcttggtcccacttaccctggggcctttacctctcagcatctcggcaccacacttctgtcagacctgcctaaaatttgctttttcaaaccattgctgagcagcatgtttgaatttctagcagctgctatttttgtgttagtgttctactgaaacttccaggtgttttcatcagaatttgttgtcaagctgtgtttccagtatcctgtccttgagctatttgtaaaaatctaaatgtatgcctttaagtgtatccttacattttatgtgatttgctttgggtccattgtttcagtttgcaaagtaattctgaatcttgcttcatcatttgctttctcaactttctatccctgaaagttttaaaaactgagaagcatgttctctatgtcttcatccaggtaatgacaaatatgttgaataggactaggtgtagaaccttgtagtgaaccaatagtgaggggttccctgtgggagtctagaacccacagggacttgtataaagatctcgaggcagaatgactgcatgtcatggtgggaataatgaatgggaatgttttgcaaaagagactggagaaagaaatactgtgaattactgttcttaagttaatctgccagtctacttatggaaatgttctggcttcagtcatttagctagctgaaaattcagggagcctccctaatcattctgttttctgaaatatagcagtccttacgatttattatccaagcaagaatacatttttgtttttatttagttttttgagatggagtcttgctctgttacccaggctggagtgcagtggcgcaaacacagctcactgcagccttgaatgcctgggctcaagcaatcctcctgtctcacctcctgagtagctgggaccacaggcatgccaccacgcccagctaatttttcagttttttttgtatagccagagtctcaccatgttgcccaggctggtctttaactcctggactcaagcaatccgcctgcctcagcctcccaaaatgctgggattataggtgtgagccactgcacccagccccaggatacatttgcctgagacaaatgctgtactgggcaagctgctgcgataagtggtatcaaccagcactgtcccggtctctccaggacatatcaacaggcatcataagggactttcaaataaaccacaccttccctaaggatcctttctctgcatctataaaggcagcaggtatagctttctataactgtaaatcagcaactctgaaaatcactgagatttcagagctagacagagaacactttagagggaagggactaacattaatgaagccttaataaaatgtctgcagcttactagatactttatactctatcattcaaacttcagaagaatgccaagggtaaacattgtactcattttacaaacaaggaagcagactcagagaggggatataatttgagaccctcaattgaaacctgtaattgtctgacttcagggcttctgttctttgactctgtggcacttggtccccttaaagtccccaaatctcaaattgagataagaaaactgaatccaaggaaaggtatctccccgtcagggtcacccgaccagcaagtagagctgagaccagaccttgggtctgatgtctcctcttcaagtgctgtcttcttctggaagatgatggaactctgggggccctggtgtccagtctgatgactgggtcacaaatgaaagtgaggttctcttgggcattttatgttcttagagcttggagaactcatgcctcccagtgggaattgatgtcttcacaaattggtagatttgtgaatgggttactggtctcatatctagaacccatgtcttttgaaaattgagacattttcttaacctctagtcttctgacaccttttctgttttctgtgatttctgacatacaatagctcagatgtcatatctgcacatttcttgagtagtttgagctgtagtttttctgggcttgaagatctaagcttaatttggcttaaaaaagcaaaaaaacttttttgtttctttataaccccacgaatttcaagagttttgtgttcatcttttaataaaacacagttaaactttgggaggccaaggcaggcggattgcttgagcccaggagttagagaccagcctgggtaacatagcaaaaccccatctctacaaaaaaatacagaaattagccaggtggggtggcacatgcctgtattcccagctacctgggaggctgagctgagaggatcacctcagctcaggaagtcgaggctgcagtgagccaagagtgtgccactacactccagccaggacaacagagtgaggccctgtctcaaaacaaacaataaaaaacacttctaaattaggatactattataatgaagtcagggagagcagaagtcacatgattgagccaggtaagccatgctatattttagcatcagttaaattaaatccatcttgttaataaacacccatgaaagacacatgtatgccttccctgtgctaaatgttagagatgcaaagttgggtaagatacagtgtcaactgttaagaatgtcatgctgtaggagacagaaccaggaaaacactgtcaaattagccagggaaattgagggggattgtttattggttgtatttatattgtccccatttatccctaaggaagcaagtagagagtatccaagcttcctggctgtcaaaattttttttaaaatgaccaaaaaaatgcataattcttcaggggaataagattttcccttttggctctaaattcagagaacaacttaaaattcagagaacaacttaagatacggatccttttataagatggcctgttatatgataaacaccaagagtggatgatgtccttaatagataattttgtaaaagatacgaaaatcccttcattgggtgacttcctgtactgaatgaagttcaatgagaacagtgggtggtacattacagggtaatttagagaaggtattttggcagttgacaagctaatgtagtctcagcactgctcactggtaatcgaatttaatgcatcaacagagcttatatccctcttccccttatgggcacatggtggatgagtttcacaggtgtgcgtcatccccatggaaataactacattgtaatgaaaccaaaggtaagaaattatttttggagttgtaaagctctacagtagtttctactcacctgttcatcagtaacagttggtgtgacaagacagaacaaggcttggagctctgggaatcacagcccaccctttgtcttccatctttggtcacctggctctatggccagcttccccttgttctcaatcccagctggagaatgactgtcataccagaaacaaaaacaaaaaaaacaaaaacaccttcagttgacagtttaagcaaacaaccaataaagtcttcctgactggcctctcgccctccagaaccacggagcacatctgccctttaaatgtgtagccaacccagtccctgactttggttctcagtctttgatgcccagtgagttaacaatatgtggaagttctggtttgaatggtgccaggcctggggcttagagcttcagctggattcccatccaccctgccactccaggctgcaaaatcaaaaattactttgctcagttgttaacaatattggatcccaaccatttatgggggtggctttcccctactgtcagctgttttaaagacacttgtgcacagtgtcattataataaagctgattctccttgccgaagaccagtttccactctccacttccagatttactggaactttttcttacaaatgaggatggcccttccacatgaccatcttgccctgaggatacactgtacaccttccttgtgttagataatagggcaacaaagttaaacaagatacagtttaggctaattgaaatcatctatttggtttgtttcattgtagtcagcttaccaaccacgtaactattctattgcttcactggtctgtccctgtttcttcttcccttctttgtagatgtccctgtgctgaacgcagtaatctcttccctgtcaggggagggaaggagaggggaagtgagccacgaggccaccttggggctcagagcttgtagaaaacctcatttagagcataacaggaaacatggtggctgataaaggtgttttatgcctgcctgttaccatcagtataattggctaaatctcaagatgtgattgctgtctattgaatgtttaaagaaaagcagttttgctgcttttaagtattttttgtaagtcaggtgaggttgagaaactgtttcctagaagtggaaagggaagtactttgatgagagatttttttaaagaaaaacaccaccgcatagaagtattgaagcacagtgtagacatagcagcatccagggttcaatatggacatagaatatttgactgaaaacacttctcagaagttaaatgctccccctgagttttgtttccctttactttacattctcttaactcagaaatatcagaaacttcaaaccagtggatctctaatcagtgtagtttacaaaatcatgttcacaataatcaccaggtctttagcatgctttgaaaaatagttcctggtatcacaaaagttcatttgcattctaaacccatgtaactgagttgttggaattgccagaagcagctttttaggtttctgagtaaacaccatttctatttaattgatatttgcaaactatcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatctttaaagtctgaatgaggaatgttggctacttttgcctaaactggcccttttctttccattgctgaatattaattaaaagaaagtataggccaggtgaggtggctcatacttatgatacccacactttgggaggtcaaagcaggaggatcacctgaagccagcactttgtgaacaacatagaccctgtctcaacaaaaaaatttttaaaaaaattagctgtgagtggtggcatgcgcctgtagtcccagctacttgggaggcagctgaggtgggaggatcacttgagcctgggaggttgaggctgcagtgacccatggtcacaccacttgcactccaacctgggcaacagagtgagaccctgtctccaaaaaaaaaaaaaaaaaagtatgattgttctcaaaaagataccaggttagatagatagaacagactggctgttagatctatttaactgggtatctttttgagagcaatttgtttagatacacagactggctgtatattgataattgctggaacaggatgatgaatacttaagggttcattatacagtttacttgtgttgataacaaattttttttaagatacattaacaaagaagtaaccactttgtcagaatacaacccagcattttcaagattctggggaaagatcttcaaggaatgtctcttgaagcaatattctgttaagagaaaggatcttgcatcagaaagtcatctcatccattcacaggctgcattgtccaaaatatattcaaaagcagaattagaaccataaactcctggtgtgaactcttgccgctgtatgtagtaatgctgctttcttttctgccctgtaggttcgagtgactgtgtttccctcaaagactgtagctcagtattcgggagtaccttggtggatcatcctagtggctattctcgctgggatcttgatgcttgctttattagtgtttatactatggaaggtaagtcatatctggcatttgaatttcataacaaactttatttcatgttttaaaaaatgggaatcagcactgatagtacgttttctttttcattgcttccttttttctaacattatgaaactcttttgacatagcaaatttgaggaaaattttaccatgaacacctgtatatttaccgaatattttgtatttaaagtatattatttgtacacaataagtttcttcatttgtctctcacacataatttagcatgtttagcaaataacaaatttagattttattactttagcattttcttcacctaagatataagtctggatctaagccaaattgttagggtgtagtaataatctgaatgtgtatccctgctaatttcagtttctgtgaagaatgttcatagcagccattggtgttggttatgcttacagctagatttggaatagaagagtatgacatgaatgaataactctatctcaagggggtcactatagcgtgtatcaaacataaggaaggtctaggttcaatatgatgttcctcattagaatttggccctttgactgtaaataaaatgtaatatcttcccctgattctaccagtaaagagtctacattatgaaaaactgcgtatgagatggatacaaactcttattgcccaaagattacaacctaaaaattttagattattcccagtgagtgatagaggcttacagtcccttatctgccattccaaaaagctctgaaaccttgaagtatatataatgacttatttggcaataaaacctgacgtgatgtgaagagaggctacttcgaagtctttatcctttatgattaatttcactgcagaaatactaacattttgattatagtagcattaggtatgcagtgcattactcattttaaaggacaaaaattttggattctcaaacatgtccggtctggagggttctgtatgaaccatcaaccccctaggatcagactatccttttcttttcattggatccaaaaatataatacataagggttcaagatagtcttacttgcaaatattgagcatctgtttttgctttattttttttgactgacttttgcaaatttgagataattttctgatgtcttctagacatgggattgaagctcatgacaaaactcctcctggtatggagttttagccagttttacctctaatgtttacctcgggcagtaggttcctctggcacacacagccagtcaatataaaacattttttcaaggagatgccttgaagaaaaaaaaattttttttgagactgggtctctcgctctgtcacccaggctggattgcagtggtgtgatcatggctcactgcagccttgacctcctgggctcaagcaatcctcccacctcggcctcctgagtagctgggactacgtgccaccacatctagctagtttttaaattttttttcataaaggtgaggccttgctgtgttgcccagactggtcttcaactcctgggctcaagcaatcctcctgccttggccttccaaattgttgtaattacagatgtgagccattgcacccggccttgaaaattattttgatatcaaaaactaaagttggggtttgatatttgaggatgatgttgtgttttctggaagaggtcataaggatggtctttttcagagcattggcagcctttaatgagggtgagacagcagtggatttaaagttagaaacctaagctgtatataatcttggtcaaatcattccatctccctggggcctctgtttgcctcgtctgttaaataagttgattggattattagatgatttcattattttgggagtttttgttttgtttttgtttttttgaagctctgaagtgtccaggctgtcaaggggactctaaaatacgacttatacaaccccacatgagaagcatttttattactttatacttttattcaactgaattatttaatatgttaaagtcataggattttagggtcagaactacagttcaatggcccttaaattggattttgtatatccatgtagagggcaaagctaaactaggcaggatgaagatccctacttcaaccacagtagttcagattgtatccattttaaatatcaggattctgtacaggattttgtttgcaggtgaaaaaaaaaaaagtcccttgggctggtctaaatcaccttcattttgctaacaaagatgctcatgaccagggatattaagaatgttgctggctgggcgcggtggctcctgcctgtaatcccagcactttgggaggctggtggattacagcactttgtggcaggtggatcacgacgtcaggagatggagaccatcctggctaacacggtgaaaccccgcgtctactaaatatacaaaaaattagctgggcatggtggcgggcacctgtagtcccagctactagggaggctgaggcaggagaatggtgtgaacctgggaggtggagcttgcagtgagccaagatcgtgccactgcactccagcctgggcaacagagtgagactctgtctcaaaaaaaggaaagaatgttgccaagttggaggcaggaccaggcctcttggctcctggtttattcttcttcccaccctatttactagcacatattattgaaagctgcccaacaaaactctatactgatggaaatgttctggagctgcagcatccagtatggtagccattagtcatgtgtggcggttaggcacgtggaatatggctggttcacttgaggcacagagttttaaatgtaatttaaattaatttcaatctgaatagcctcacggagccagcagctcccatatattgtacaaagtgaatctaggcttttaccttcatgagttgctggactaggaatcagagtttttcaggagattttatttgaccaggttaaattttataaaagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtatatacgttttccctattagaatgatttttgtccacaagatttctgttacaaagagaaaaatcaatgagctgactagtgtcatccatataaatatttgaccagagatgtatggtgaagggtgtattgaatatgacaatgaaacaatgcagtggctgttcattgttggttgactgaaagtggtctgtttgtaaacaagccactagtagaaggcagattaaaatttgagatgttctgttgtttggctcttatacacaaaactgtaaaattgactaaataccttgcttccttgtagtgtggtttcttcaagagaaataagaaagatcattatgatgccacatatcacaaggctgagatccatgctcagccatctgataaagagaggcttacttctgatgcatagtattgatctacttctgtaattggtaattgatcaatgttttttaattgctagctgtgggacccgctatggttgtggtggctaactttaagaacaacagcttgctatgtgtgtcccattaacagatgtttccaaatgtccacactggcttgccttgcttggatttgttttattttatttcacttgaaagctcagtttttgttttttttaatgcacagtctttcgttgcaggtgagttattttatgttcttgttaaatatctaccacagcaatgaagaaaatttgcaatatttgtacacacaaaaagagacttttagccctccatagtagcccagtttgcaatgtgttattaattcggtatgtagcattccactagggaattcaaagatgcataagaaatcattctagatttcttgtccattttggaattttccacagatagaagctgtgtcgaccgcctaattaacctgttgcatgttggaaatgttgtgtttctcttggtgaggcttcctcactgtcatctttttgttctctttgctataaagtgatggggaaggcttggaatgctttttactgttgctcaggaatcgttttatgctagctaagcatgcaacttccatttcctgcatgtctcctacaggtcaaagaccattacaacaaactgattatcagcatgatgggcttttatggccaacttcagaagatgatcccttaccaaagttaccttccatctacaaaattctagtacaaaaaataccctgaacagtttttattgcaatatgttgtgatggagtttgaccatatttcatgtatccagagattttatccaaccttggatctcagttgattttaaattcaagtttctcttatttggaaatacatggaaataggaattgctagtgatccctttcaccatttacgtgggcatgagaggacagaattactcctgtaatcctttccatggcactatcacagtgaatcacaacattgccattcagctttacatattacccttaatttccctctttgtttaaatggggtagacagcagtcatattttgtaatagataggtactttggcttttttttctttttttttgcacagaataataaatgaatccatgtagaaatgacctggaacaaaacatcttggtccattttgcctattgatttagtgataactatacatataattttatcttgctccatggcatttttataacataacatcattcaacataaatgtcctgttactattgacgtcacacaataaacacattaacagttctatcaatatcctcattcttctaaactgcattttaaagttgaaaacacctttttttaaaaaaagtaaatatatttcatttaaaaatttaatctcaattcaaattttttcagatatattctcagtaaaaatatactttggatcagattgactatttaaatgaattttatatatatatataaacacacacattaacagtttaaaggtaaatgtatttttgcaaaagaagagaaattagggagtgctctgaaattcagtgtagtgatgcacttctgaagtcctatgcagcacatgatttttattgcaggaaacagttactatgtgattaatgaaatagcttaattagaagcacaatagcaaatccaggcaacataaatgacctcctggctaatgagagaagtgatatgtgtactagagcctcagaggagagaaaaagattataaagttgacctgttggaacactggcatattcaaatagtaatttgtaaaatacttgtgacatgatttgcattttattagtgggaaaggggcatgaaataatctttggtttatgccatttaaaaattattcttaatctaatctgataatcagatattttacatatcatattgtgattatttttaaatatggaagcactgttttcataaactcttaaattgttagtaaagaggtagcctacatttgttataaaatgtaaagagaagatgaaaatggacttttcttccagttttacagctgttctcttccgttgatccccactggctcttctttcatttcagcctcttggttctttcttaaaagaaaaccatgtctttttccccttagtccagaggtagacatagctgaacagaaagcttagacattcccatttagtgtatttgcttctttgtgagattaatttgtttctctttctctttccctcttctctagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacctacaaattgggagttgtctttggactgaatcctcctcttcactgcctgtccttgtaaggatagggaattgcttagcaatgataacctggcattaaaaaaaattctgacagctaagctgcttccttcttagaatatgttttggatgtgggagcaggctagctgtgacgtgtgtggcagaatcaactagtcagaaaatattttcttcagcaaaagaaagattttagatttgagttttatgaaacttctctagctggattatcacaacctaatacaagaaaataaaatatataaatatataaatatatataaatataaatatataaatatatataaatatatatatacatatatacgtatatacacacacacacacacacacacacacacatatatatatataaaatgcctagacaatatagtgtgccctggcctgaataaatgtctgtctaatatattaggtaatagctctccactatacttggcattacataaaatcttggccttcttggttctttgaagatcaaacaggtgttaccacccaaagaaatatgtgattgattggcacttaatgatttgggccagtggctgtgaacctttttagcctcagttcacatatcagatatacccagattaaatcactacaataatatgtaatcgtcataacctcatagagcctatcagtagctgtggtttgactagggctatggcataaataacacagactgtaagtaagtcatggcccatccagtcatagtgcctgtgattccaacacttcccctccctctcaaaaattacaggaacgtctaccagcgattgtggaattattacagggttatccttggatctatttggattcacagaggaatcactgcaaacattgatacttcattattggttgtaaattagttgctgcaaattcagtgtgtcgtgcatagtcatggtttacgcttttcccttgtggctgagaatattctagcatgtggtgttgatataggtggggaatgctttaaagattgtccagactgccagccatggtggctcatgcctgtaatcccagcactctgggaggctgaggatccttgagaccacaagttgagatcagcttgggcaacatggcaagacccaatctctacaaaaaatttaaaaattagccaggtgtggtggtgtgcacctgtagtccttgctactcgggaggctgtggtgggaagattgcttgagcctaggagtttgaggctgcagtgagctatgatcatgccactgcactctggcctgggcaacagagtgagatcctgtctcaaaaattgtccaaatcagggaagtaaggataagatcaagccttctactctaaatgaaaacatcttaatgagaaactggtctccagtacactatcccacaaaaggacaatgtgggaagacaagccgggattgagagacttgttttcaaggagggaaagagacgctgtcagtggttgggttccacataagtacatccacagggctgagaaaacagaaatgtggaagagttgttggatcaatttggggagcataaagtaagtgattaaaagcagttccttaagaccaaaggacagggtccaaccacttggaatgaggaaaaggtgagggtcaaagaggtgaagaaaatgaacttcagaatgatttcaagagtggctattgcatgctagtgggcatctgttcttcccgtagtttctgattacggttaatagcaagttctttttctctcctgtaccttaaacaggttttgccagctccaaaaggcatctcatccagctgttggaaggtgggagagctgtacactaggagctgagaccaggtctgtggaggtgctaccaatagacctcatctaggaggaaaatcatgaggggattcatagccaaatcctcttgactcagggtaaatgaactgtaaaacacaaaccagaggaaggaaactggtgtggcccagtgcaagggtggaccaggcaccacaaagggcaaaactaaccaggtaatagttgatgattacaccagagttgagggagtcaagtggtcaagtgcaatttttgtagcagtcagcaaagcataagtgcctcaatcttctcttgccctggaggcatctctcagttatgctgcctgtgctggggtcatggaaacagttccctgctaggagaggtcagataaatttcttactcttcagccttctaaaacgtgccaaaaatctcaagaaattacagtgtcagaatgtgctaccgttgttatctcaaagcctagcaatttaagttttcagttcaccaacaatcagtaagtggatttaagtgagtgttctgttaagatcctgtcattgtgagagggatgtgatttaataattattttccagttggaagtaaacagatgtttagggatgttaggctctggggatatacgtaagacactggctctgaccttttataggaagcttatctgaaactacagatggtattgacaagcataagtgaattcactttttataggtagcagaatttaaaaccctaagatatcaatgattgacacataaattcaatacctggccaggcgtggaggttcacgcctgtaatcccaggactttgggaggccgaggcaggcagatcacataaggtcaggagttcgagactagcctgactgacatggtgaaaccccgtttctactaaatacaaaaaatgagccgggtgtggtggtggcacatggctataatcccagctacttgggacgctgaggcaggagaatcgcttgaactgggaggcagaggttgcagtgagccaagactgcgccactgcagtccagcctgggcaacaaaagcaaaactctgtctcaaaaaaaaaaataaagtcaatacctgaacctttgtgggcagaacttgcccccagaacaaccccattcccagaaaatttagagtcattcttaagcaggtctacacatttaaatcaccaaagaaatacatttattaaaatcccgatggctggacaatctgccacactgactacatgagaatctgagtgagacccagaaattagcgctgcttaaagctccccagctgactcgtaaagtgcagccaggattgagaactactttagagattattggatgttgtgaatatttatcaaaataatatgctcactgtgtggaatgcctcgttcctgtttgtggtacttccactgcaccagtaacaggagctgagaagctagaggtgcatttgctataggcagggaggcagctgagcggtgcataagggcatgtctctggagccacgctgcaggtgtgaattagcttctcctcttagaacataaccttgggtgagttacggatatctctgtgcccagtttcttggcctgtaagataagtgctcactcagaggttctttttttttttttttttttttttttttgagatggagtctggctccatcgagacggagttttactcttgctgcccaggctggagtgcaatggcacgatcttggctcagtgcaacctctgccttctgggttcaagcaattctcctgtatcagcctcccaagcagctgggattataggcgcccgccaccatgcatggctaattttttgtatttttagtagagacggggtttcgccatgttggccaggctggtgttgaattcctgacctcagatgatccacccctgcttcggcatgccaaagtgctgggattacaggtgtgagccaccatacccagcccagaggttcttgtaaagagaaaattggaccatctggaagtgcttactagttacttttatacttacccttgtttattatatagaaccataaatcttaaaaagggaaggaagcatggaaatctagttctacttcctcgtttcacagatggggagacacggtttatttttattgtcacgggaaccttttgtctcctcattcttcagtgtctaccaacttaagtcttactagtgggtgttataactacaaaaaaaaaatacgatgaacctcttaaagtccttatcaacatagatcattctgaacaacgacaagagtgaccttatttctatgttaaattctgtctcaacccttaatacagtgaccataatgcagtcttcggttggggtcagaaagatgacatgttaagataatcaacaaagcatcttgaaatcgctaggtattgaatctttgtgtttttctccccgctgacatggaagagtgtgaaaagagcagattctctttttgaaccttttctcagagttctttacacaccatcgatttctttggtttcctttagtgggaaggcaagccacagttttactgcttattacctttactgctgtgcagaagaggaaatgctcacagagctcatcttgcacctgagttacaccatgtgtgttagaacggagtttgtcactggaagaacaaatttgaaaactcctgcctcccacatgtcacaataatgcatggactgaaagactatgtaaaggcaaaaaacatacatatacatgcattcttccataggaagattgggggactgcctgatgccaaggtgtcctcaaattgctgatggaactgaagttctggggttcttacctgaggaagccactggtggtcaggaagtctcaattagagaagttaagagcagtctttctcaaaatttaacatgcctaagactcacctgaggatcttgttgattcaggttctgatttaaacagtctaggaaacagcctgagagtctacatttctaacaacctccaggtgttgcaatactactgatctatggattactctttgggtgtcaagggtctctagagccagtctttattcaagtccctattgtgtcactttttactgtatgacctgggcaagtttaaatgcctgatgccttaattccttcacctgtaaaatggcataaggtataatggtataaggaataagattataacctaggcttacactgtcttatgtctttctacacaacttccaaacccctaacatcctcaaatgtgtggataaggactgactggggtgcagttaagtctgtttatctaaatatatagctttcaccgtcttgacaggatagctgacatttgttgtaggctactcttacaggccatgcttttaagattcctgccccgtgagaaggaaaatcccatgacagtgaatagcattacaacggaatgggaaacaatgtgccagttctagtagctgacccacagaagcagtgacatgttgatctggttataaagacttatctaaatcagtaatgaaacaaacacattgaacaggttcaggatgacttaaagagaagcttttgcaacttgacatttcctttctcaagcagcaactcagtgtttctttgcctgtgcctaccacgaacaacccaagtactcatgccagaaaacacacacacataaattaataaaactcctaagccactgtgatacatatctgtggactggcttgctctattccatactttttctagttggaagggctgaggtgctaaaaataccttcccagactcccttgcagctagggttgtacatatgaattttttatttttatttatttatttagagacagggtctcactccatagcccaggctggagtgtagtggtgcaatcttggctcactgcaacctccacctcctgagttcaagtgattctctcacctcagcctcccaagtagcaagtagctgcaattacaggcacccaccaccatgcacagctacctttatatttttagtagagatgggggtttcagcatgttggccaaactggtctgaaactcctgacctcaagtgatctgcctgcttcagcctcccaaagtgctgggattacaagagtgagccaccgcacacggctgaaataaatttaattctatgacttgcatacctgttcacttgagatctgaaagatggactcatggtggctgtttctcctagcaagcatggcacagagccccaggattcaatgttgagtgtcttccagctttctaagccatcatcagagaaggattgtgacctcttgattccattttcttgaccttcgattgcaacttcaagtatttgccttcaaccctattttgaaaaataaaaatgaaatcctaagccccccaaccaaataaatggaccccctctttgccacagggaccccagagtaattttgaaaacctgaatttaagggatgctgcatctcccttttggggttttgacacaacaattgaccagcatttcttcctaataagagaccactgaccacagagtggctctggctagtgtacatgtgactcatgaaggggcatgaagccccattgcatatatgcacatttctccttttgtaaatattcatgattcctattgctggccactctgttcagcatagactcctgttccctttgcccctccctcaaagtatctgtttctagctcctggccagaggctatccttcccagtgtcagaatggtcaccctgccagctgcaaacttttatgaaaaataaagctctcctttccaaatttataaactttgtaaccaaccaataggttctccttgcctactgcccagatagagccaatttatcaagacaggggattgcaatagagaaagagtttaatgcatgcctctggggattcagtcaggatggtggggaaaattataagacgcaaaccttcttggaaggcctgggggagatgcataagctccagtaataaacttggctgaaggcagccttgtccccttagttaagtaaattaaagtagaaacaaaggaatgtgcggagtttatctaactagcttgtttactcatgtggtcctaagactaacctttgatttactgtgggtgcttaactgatttctactcaggaggtccacaatgtcaactaccctctagtggtgtttactcacgacctttgtcaattaacctttactgaataaatgcaagtctcactgactgatcaaggccgcagtcacaactgtttacagcactctgcttgtagtctgtaagcagcctggacactcagctggactggcaaagcagcatatctgtgtgtcagtgtactttattcatccgttgttgggtcagggtctgtgggacagactccgcagctggtgccctgtgtggggatcgctgtgaagggagcgcgacagacccccagaaatgaaggtggagaggactggcggtcaagtcagtaaaacagtgagtcattggtgcctgcttgggattaccaagtttgggggggtgggggattgttcaggctgagatttcatcatgggacaatagttatcagttcaacaaagacagtacataaaagtgttgaaacagttacttaaggctaggggagcatcagttttgcaggctcaattaagagacccaatgcaaactgttgtctcacttaatccatggttcccagaagaaggaccgctagatgtagaggtctgggaacaagtggggagaaatattaaacaacgttatgcacaagggcaatgtgtcccagtaacagcttttaatgctatgggctttaattagagcagccctagttccgttatacacagaagagcctaaaaaggggaaggaggaggaaccgtcacctatcttatcgcctcctcttccctcagccctgatattactgggccaaaataacaaagaggaaacagaagttgtgcctgagccacctcctccaatagataagaaaaaaaaaacaaaacaagagatacactacagctatgaaaccctgtcttaagcaggcagcattaaaaggggagctcttagcctgcccaataatgcaaaatcagcaaggcaatcaggtacctaaagagttgttaaaaaaaagcattagaggccaaagccaggcggccaagcgagcagtaagcagaaggagagacttggcagagaggaagttcgggaaaccaaagccagcaagtgctcccaggaactctgtccacacggaggcagcggcaacaaacagccaggcccagtgcttggaagttagcctgttagagagaggcaggaggcgcatgtgggaaagtcggcccagtgggcaacagccactgggcagcgggggtaggaagtggcacaggcgaaaagcggcacagaaaaaagcagcgcttttgcaagcgcaacacagctgccactccaggaccagtctgcttagctctccagctctgcaggtggcccacggcaaaatttcatgtgctccttgtagacaagagacatcccaaattataattctatgctaagatttaagtaaaatttaataatttgaaaaacctctttctgataatgggcactgttatctctctcttacccctaactctctccaaatccaatttaagtaaaactgtaacctctaaagggagagaaattacaaacggcccatgagttagttaaggagcagttaaagcaaactttactccccagtagaaaacaaaaacaaaaacaaaacaaaaacaaaaaaacttcctgattacaaggttattcattttatggataatattctcctaacagcccttggagttcgcccattttcgtcattcccaaaaagtctgggaaatgaagacttttgcatgacttaacatgctattaatgctactttacagcctatgggaccccttcaacagggccactcctcccccgtggtgattcctcaagattggcctataatcattattgacttaaaagttttttatacaattcctctagcagaacaggacagagaaaaatttgcgcttacaataccagctatcaataatgaaaagccagcttgttgattccattggaaagtgcttcctcaaggaatgctaaacagtcctaccatgtgtcaatatcatggaaatcaagctttggtccctagtacaaaagaatttcctgattgcaagattattcattttatggatgatattctactagcagccccaacggagccaatacttttaaatttatattcttctgtcgtaaagaatacagagctaagaggtctaatgattgcacgtaagaaagtacaaatgtcctctccttggaaatatcttgggtacatactaacttcctggtcagcaagatctcaaaaggttaaattaaatactagcaatgtatacaccttaaatgattatcagaaattgggcgatattacctagctccaccccactttgaggattcctactgataaactacaaaatctgttttctatcttaaagggtaatccagccctggattctcccagatatttaacccctgaaggaaaaaaggaaactgaggaaatagagcatgccatctctcagaggcagctagatcgcattgatccatggtattcaattcagttgtttatttttcccaccaaacacccccctacagggttaataggacagatgaccccagggctacgcttcctagaatgggttttttgctcacatactaggactaaaacactatctccgtatatttagttaattactaaagtcatctattcaggccacaaaagatgcaatcagttgctaggttatgaccctgatgtcatcaggattcctttaagcaaaaagcaatgcgaatcagtattgctcttatcgatatatctgcaaatagttttctctgattatacaggacaaatagagcacatgcttcctgctgataaactccttcatttcttacctcatacgcaggcaatcttacctacaaaaatagttcactcccccatacctaatgctttaacactgtttactgataggtctggtaaacatggaaaagcggcagtctggtggagactacacaattcaatcacttgatctgggtttactagcaatcagagagctgcaattggggctctgatactggccttggaaactttttccactcagcccacaagtattgtaagtgacttggcttactcagtatatttgctacaaaatcttgaaacagctttaattaactccactctggagccagccttgtgtgcttttttttctccaacttcagcaattgctagatcaacatacacaacctatttttattacacacattcgagcccacagctctctgcctgactcattggcttatggcaatgaacaagcagatcttcaggttatgacatcactgcttgaccaagccacccaattgcatcaatttttccaccaaaattagggaaacttatctaaacaatttcaacatatacaaaggctggctaaacaaattatcctacaatgcccagactgccagctcacaggcacatcccctccttccacaggtattaaccctagaggactagaacctaatcagttatggcaaacagatgttacacacatccctgaatttggaaaactgagatatgtacgtgtatccattgataccaacacccatttaattagtgcacatgcccttctgggagagtctactcgatatgtcattaaacatcgtcttttaacttttgcatttatgggatggcccacaaaaattaaaatggataatggtcccgcttataccagctcacaatttcaacaattttgtcacaatgtggaatatccaacattccacagggatcccatatgacccccaaggacaagcaatagaacgtgcccactcttaaaaaatacgctcaaaaaaaacaggaaagaaggagtatgggtaaaagaccctgcaacactataggcacaagccttatttacccttaattttttaaatttagatgacaaatttcaatcagctgtagaaaagcactttgctaaaacctctcaaggcataaaacctgcagtttgatggaaagatgtaaacagtaatgtatggtgtggtccaaataaattattaacatggggaagagggtatgcttgtgttcacaccccctcaggtcctctttggattccagcgtgacgcatcaaaccataccatggcatggctaggacccaacccagtaccagaaatgaaggagttaaccctacaagatccacagacccagaagatgcggcttccgtggatgacacaagccccagatgttacctgggggatgctgaagaagacaactcaggaggctgaacaaatcctgctccagacacagacagcatttactccagataatttgtttcttgctatgttttctgttgtacattgcaactcacgtagggtattaatcccttttatgctctcactttgttcgcagctggtacctgctacactcttttgggctcattatcttagacccacctttcttttgcccagttaccttggcagacactcccttcccagcctttaataacgtgactgcttggctaggagggatagatttacccccagtggagtccctcaataatcacacacattggactaaagtgccaaataacactacataacactccactatcctcccactgtgtataagttataaaggttctaacccttaatgtgtacctgcccaaaaacaagtatggctacatcatggcaaaggaaatgccttaacattcttagctgcaggtagcctcaaaccaggcattgcaatcaatgctgctttcccaaacattccttcctgtgctaaagaacaaagccagaaaagtaatggattccactttagctgggatgtctgtcatgggaaacaagcccatagactccagttaggcaactataacatcttagactgaagtccccatggccgattgcagggcagccttactaatgtcttcgtccatcacagcatcaatcacagtttcatagccatgttttgtttccctatattttgggccaatgtggggataggatatcccagaccccaagtaaagtccatgccaacccaaggcaccttatggtgcctgggacatctcagcacctcccttaacacctaacatgggacatatcataattcccattgcaactatactataacctttattcataatcacacgaatcagtgcctgatttgcactacccatccatatattttccttatgggaactaacatttccattataccccaaaactccacgtttgtgacccaggtgcagggataggcttggtttgcctcatatatcactcaccacaatatatctaatttaaaaatcactagtgtcatggtattaaggagacaatctgagacatttctaccagtcaatttgacaggattggcaaggttcctctgcccttgccaccttagaatgtgctctgtcccaggtcagacacaaaagattcacagttacacttatggcctttataatctcagcctagtcatcctggcaactgctagcattgctgttgcatctattactgagtcaatataaacagctagctttgtagataatctggccaaaatgtgtctaatgatcttctcttacagcaacatatggatcaaaagattcttgcatgactgtgagcccttgaggctgccttagagtatgtgggggagtgacaagatgcactggcattccaaaagcaattaaactgtgactggggcataaacatatctgtgtcacttctctaccttggaatcaatcaatacatagttgggatgaggtaaaacaacacctctggggaacctttcatgacaatttaacagcagacataaagcaacttaaaactaaaattttagaatcccttcacaccatagatctacacacccaacaaacacccatatagaagggtgtgcaagatcatctctcctggttagaaccccactcctgggggtcactctttgactggaaagaatgttgctaattgtactcatgattgtattatgctatttgctaattctaggatgcaaagccagaataagagcaatgaccaccacacctgacaaacctgttgctgcatacatgtacactctccaatcaaaaagacctgatgcagaaaacaaaaaaagaggagatgtgggggttcagtcaggatggtggggaaaattataagacacaaaccttggaaggcctgaggggtttgggtaagctccagtaataaacttggctgaaggcagccttgtccccttaaattagagtagaaacaaagcaatatggagagttatctaactagcttgtttactcatgtggtcctaagactaatctttgatttaccctgggtgcttaattgctttctactcaggaggtccacaatgtcaattaccctctagtggtgtttactcacgacctttgtcaattaatctttactgaataaatgcaagtctctctgactgatagaggccgcagttgcatctgtttacagcactctgcttggagtttgtaagtggccagtatgctcagctggactggcaaagcagcatatctgtgtgtcagtgtactttattcatccgttggtggatcagtgtctgaaggacagacccctgcacatgccctgtcaactaaaggggagatcagagtcattattcagattagtctctccaaaaatttgaagacttctggagtttttaaaggataatttggtgggaaggggattagagagtggagagtgctaattggttgggtcagagatgaaatcatagtcggttgaagcaggttcttcttgctgtcttctgttcctggatgggatcacagaactgcttgaaccagattactggtctgcgtgacaacagctggtgcaccagaatgcggggtctcaaaaatatctcaaacaccagtattaggttttacaacagtgatgttatctctaggagcaactggggaagtcgggaatcttatggactctatggactgcgacctccaggttacatgtaggttctaagttatactgagggcttaagaaataccctgtgagacgtgggccatgaagtctgcatcactgtcactctagatgaaaaccactgttccaaaccaaggaattatttcttttattaaggccttaatgcttcagaagctctttttgtccaacaaagaaaagcctcaacccaaggtatccacaaacaagagtaggtatttcaagttacctgctatccttgacatcataataaaatcaatttgccagttctctgttgttccttcacccccggtctgaattcctgtgttaagtggggagggctagtttttgggttgttctgggtacagaagagacatttttctataaccttctgaatggtcctgtttatatgtgaaccagaaacatatttttgtatccattggagagtggcatccctaccacactgggtggagtcatgaatacattcaacaatgtcattcctaaaatatgccggtgccagaattgtttctctctcattgtatatccatccatcatgagtcctctgattggggtcaaaaccccaattgagtgctctttttaggtactcatctgagtatatgggaggctcagggccacaatctgttttaggtagcaaaggtatcaatagcattttggggactttatccttactattttcttcgtggcctcatctatgcaatattgtcctttgccaccaaactatctgtctgccgttgcccaaggcaatgtattatagttacttcctgtgggctaaaatggcatttaataggactagagtttctctagcatgttttgtttgtttttaattatcagaggttagtagtcccatttttttccagatggccccttgagcatgaaaaacagagaaagcctatctagagtctgcgtacatggccacttgtgctctgttacctagatggagggttccaatgagggctctgagcaccgttttcagtgctaatgttctggagggcaatgctctggcttctatagtctgtcagtgggttaccaccacacacctggctttctattgtccctggcccataaagctgttcctgtcagtgaacatctctaggtctgggctgtctatggttacgtctgtcaggtctggccagcaggaatgaactaattcaactgtttgtagataattgtgcgcaagttcagatggcatttgatgaaggagggggcaggatttagagtagagatggccttcagcattacatttgagttgtctgaaaggatgacctgatacctgcagagtctcccagaggtcagccagtatcctcccttctgttccagcaaggggagcacacagtgggttgggtgtactgtggttggctggcctgatgtaaacttttctgcttcctggagaaagtcacaagtggcagcaacagcccaaatgcaaggagatcatccttttgtaacaatgtccaattgctttgagaaacaagcaatgggtcttttaatatttcctaggtcctgagttaacactcctaggcttattcttgtctctcaagcacaaagagatcaaagtgctggggcagtcagcagttttcctttgatatcaaggaaggtcctctatcagtctccagtccattctaggggttcattatctcctccccacaaagcattgtatagaggctttgcaataagtccaaaattagaaatccatatccaggaaaatttggccataactaagaaatctcacaactgttgccaggtggttggtctgtctgccctggtgaaggtgtcctgctggtcagggaccaggttcttctgcccttgggagagctcgaacccaagatactactgcaggccgacaaatcagagcctttttcttggataccttgtaccctagttcagccagaaaacttagattcaatatagtgttttggtcagacaactcctgtgtggtactggcaattaagatgtcatcagcatgctgcaatagagtcccactctttaattgcaagtctgggaggtctttagcaagaatttccccaaagatggcaggggagtttttaaacccctgagggagaactgtccaacaatacttttactgtgctttagtatctaggtcttcccatttaaaagcaaacagttcttgtgactcagggctcagggggatgtaaaataaggcatcttttaaatctaagactgtgaaccaactgagttcaccatttggggatgtgagtaaagtatagggattgggggccaccgagtagatatcttttaccattgattgatagccctcaagtcctgaacaaatctatgtttcttagtcccaggcttctgaaccagcagaataggcatgttacatgaggactagcaaggcctaatgagtccaaactgaaggaaagcacacagcagaggtttgatgtcccttctcgcttgttggcttaacaggtattgtttcaagcatggctacgttgttcttacctgtaccttcacttgtactggatggctgttctggcccttcctggtctcctatctgcccatgcttccacagcaacctgcagggcataggcttgttctggagggtactaaaatatttactcatactgggctgaaagtaactttggcatttactttagttatgaggtcatgtcacagcagaggaatggggcattcaggcatatataagaagctgtgcttcaggtgggttggcccagctgatattctaagggttgaaggatggtctcgttaaggtttctcccaagaccctggtcactttaacagtttctgaacagtttagacagccaggtatttatcaccaagtaactagcctcagtgtccaccaaaaagtccaaaagttgacttcccactgtcatcatgacctgggactctatgtgggaatatggagggtgttgcttgggtcaggaggaaccccagggccccataattcctggtccttatcctaggtatctttaacctcagacctcttggctatttcaggcatctggtgaacagggagtgggttttccttaacactgttctttttacaatgtggatagtctttcctccagcagcctattagcttgcaataagtgcactgcttgggacctacagtggggtgtcaccctttgttggtctggggcttagtaggggtcctacctgggatggagcatctgaaggagattcacactgtggtcctggggcctctcgagtcagagccacagccagaaggttagcctgatgtttcacctttcattgttccttttaaaaaattatctgcactggcaaacgctctaaaggcaatctccattaactgggacagggacatacgcagagtcccacccatcttctccaactttctccaaatgccgggggcactttggctgataaaggtcatatttaccatctgtcggtacttctagatcatgtctgtataccacctacccactttaaacacccattccaagaattctgaggggctctcattaggtttctgcctaacttcctgaaacttattaagacctttctaggctggacgcagtggcttacacctgtaatcccagcactttgggatgctgaggcaggtggatcacctgaggtcaggagttcaagaccagcctggccaacatggtgaaaccctgtctctactaaaaatacaaaaaattagccaggcgaggtggtacatgcctgtaatcccacttactcaggaggctgaggcaggagaatcacctaaacccaggaggcggaggttgtagtaagctaagattgtgccattgtactccaccctgggcaacagagcaagactgtctcaaaaaaacaaaacaaaacaaaacaaaaaacctttctgtttcagcactactttgcagaggccagccagaatacagctgcagtcttggtaagactaaaccttgataaagccttctccatttatgttccactcccggtctaaggtgggtacagccacctgtgcagccattcttaccaggttacctgggacctcgtgcatgagaccaacctcttctctggccttccctaggaccattctctgctcctctgaggtcaataaaatgcaaaggaaattttgtacatctgcccaaggcgtgactgggttgcaaatatcaagaaaaaatcttccatcctcctcagattctccaagtacgtgggtacgttatttttccaactaaactaattgaaggtggaaatggagagtagacccagataagccccattggctgacctgtgacagcatcaatgctcccctataggaatctgctgaagagggaattgccttccctgagctagaggggcactctggccaaatttggtttcctgtcagaggtgtgggggtagaccattcctattgctcctggcttctattcctgcaaaggtggggagatcacagaagatggggagatcagggaagatggggaccccagctcaggtgctcatagagcagccccagccgccataggtaggaggaggaactgagggctcatttaacctagcaatcaaaatgtcatcatctttttcatgtgactcaaaaaaacaggattttttctactgccagttagttgggccacaaccttacacctttactgcattggtttattttgcctaagtgccatgaaacactgtacataggaggtcccatcccatttctctttccctttacaatacaaatctaactccaagattctgtggtgacaaacagaaccctgacaaggccatcatgcattcttaatcccacaggaaactatggccaagttgtgttacagagaaaacaaactgcttatgggtcagtgggtaatatccccaaaatttccacttctcgaggatacatgccaatgggctctccaccagtatagcagacatttgggtccccacacttctgtgtttttatcacaactttgtctccaatcttcaaataagagcctccagtggtttgcagggacaccccatccatcagatcaagcccaaaacaagttttccattttcttggcctgacaggaagcccaatatgccggagggtgaacttgatggctttcccatgggtcaaagaaaacagcacattaagagcaggtgcaggcatacaagacggattgaggtatttccctgttgcaggaagtctgggaccccaaatggagggaccggctgaagccacagcagaagaacataaattgtcaagatttcaaggacatttattagttccccaaattaatacttttataatttcttacgcctgtctttactgcaatctctgaacataaattgtgaagatttcatggacatttatcacttcctcaatcaatactcttgtaatttcctatgcctgtttttactttaatctcttaatcccatcatttttgtaaactgaggatgtatgttgcctcaggaccctgtgatgattgcgttatctgtacaaattgtttgtaaaacatgtgtatttgaacaatatgaaatctgggcactctgaaaaggaacaggataacagcgattttcagggaacaagggagataaccataaggtctgactgcctgtggggctgggcagaacagagtcatatttttctttttacagaaagcaaataggagaaatatcactgaattcttttcccagcaaggaataacccagggaaaggactgcattcccaggggaggtctacggactgccactctgggagtgtctgccttatgcagttgaagacaagggatgaaatacgccctggtctcccgcagtgccctcaggcttgctaggattaggaaattccagcctggtgaattctagtcagacaggttgtcagctctcaaaccctgtttcctgttaagatgtttaccaatgacaatgcatgcccagtgggacatggaaccttatcagtaattctaatttcgccctggccttgtgatcttgctctgcctctctgcccttgtgatcttttattgccctttgaagcatgtgatctttgtgacttactccctgctcgtacccctctccccttttgaaattcctaataaaaacatgctggttttgcggctcacagggcatcacggaacctgccaatatgtgatgtcacccccggaggcctagctgtaaaatttctctctttgtactctttctctttatttctcagaccggccgatacttagggaaaacagaaaggacctacgttgaaatattgggggctggttcccccactataaaacagcatattaacagcagctgcaggcatacaagagggattgaggtattcccccaactgccacatagcaccttataaccaccctcccaaagtggattctggaacatgcgttcccactcttgatctcactatggaaacctcttcactgtccaacagtagccataagagggcgggcgcaaccaaggtgggggccacagtcaaagcaaagcagctaccaccccaccacccacacctatctacggacaggacaggttgaaagaaactctccaaaaataaattttagattcccagaaaggcagagaatacacacagaacagtacacagacgttagtttctttgccagggcccaaatattgacctggcaagactaaaatttgaccccattggcccctatcatctttgatccactcaaggtggggagggatgacctctgaccaagaattcaatttgttagtattacaaagccggtctgattcccaggtaagaaggagatttagggaaaacactatatcatctttgtttcaaagctaaactataaattcctcctatagttatctcagcctatgcccaggaatgaacaagggtggcttggaggttaaaggtaaaatggagttggttatgttagatccttttcactctcttttgcgtgcatgtgtgtgtgtgtgtgtgtgtgtgtgtgtgtgtgtcctctagctacataaatcctaaacctgggtttgtttttttttatacttttaagttctagggtacatgtacaaaatgtgcaggtttgttacatatgtagacatgcaccatgttggtgtgctgcacctactaactcgtcatttacattaggtatatctcctaatgctttccctccccactccccccacctcacgacaggccctggtgtgtgatgttccccttcctgtgtccaagtgttctcattgttcaattcccacctattagtgagaatatgtggtctttggttttttgtccttgtgatagtttgctgagaatgatggtttccagcttcatccatgtccctacaaaggacatgaactcatccttttttatggtcgcatagtattccatggtgtatatgtgccacattttgttaatctagtctatcattgatagaaatttgggttagttccaagtctttgctattgtgaatagtgccacaataaacatacatgtgcctgtgtctttatagcagcatgatttataatcctttgggtatatgcccagtaacgggatggctgggtcaaatggtatttctagttctagatccttgaggaatcgccacactgtcttccacaatggttgaactagtttctagtcccaccaacagtgtaaaactgttcttatttctccacatcctctccagcacctgttgtttcctgactttttaatgatcgccattctaactggtgtgagatggtatctcactgtggttttgatttgcatttctctgatggccagtgatgatgagcattttttcatgtgtctttaggctgcataaatgtcttcttttgagaagtgtcttttcacatccttcgcccactttttgatggggttgtttgttttcttgtaaatttgtttgagttctttgtagattctggatattagccctttgtcagatgagtagattgcaaaaattttctcccattctgtaggttgactgttcactctgatggtagtttcttttgctgtgcagaaactctttagtttaattagatcccatatgtctattttagcttttgttgccattgcttttggtgttttagacatgaagtccttgcccatgcctatgtcctcaatggtattgcctaggttttcttctagggttttttatggttttagatctaacatttaagtctttaatccaccttgaattaatttttgtataaggtgtaaggaagggatccagtttcagctttctacatatggctagccagttttcccagcaccatttattaaatagggaatcctttcccattgttgtttttgtcaggtttgtcaaagatcagatggttgtagatgtgtgttattatttctgagggctctgttctgttccattggtctatatctctgttttggtaccagtaccatgctgttttggttactgcagccttgtagtatagtttgaagtcaggtagcgtgatgcctccagctttgttcttttggcttaggattgtcttggcaatgcgggcttttttttggttccatatgaactttaaagtagttttttccaattctgtgaagaaagtcattggtagcttgatggggatgatggcattgaatctataaattaccttgggcagtatggccattttcacgatcttgattcttcctatccatgagcatggaatgttcttccatttctttgtgtccacttttatttcgttgagcagtggtttgtagttctccttgaagaggtccttcacatcccttgtaagttggattcctaggtattttattctctttgaagcaattgtgaatggaagttcactcctgattttgctctctgcttgtctgttattggtgtataagaatgcttgtgatttttgcacattgattttgtatcctgagactttgctgaagttgtttatcagcttaaggttattttgggctgagacaatggggttttctaaatgtacaatcatgtcatctgcaaacagggacaacttgacttcctcttttcctaattgaataccctttatttctttctcctgcctgactgccctggccagaacttccaacactatgttgaataggagtggtgagagagggcatccctgtcttgtgccagttttcaaagggaatgcttccagtttttgtccattcagtatgatattggctgtgggtttgtcataaatagctcttaatattttgaaatatgtcccatcaatacctagtttattgagagtttttagcatgaagggctgttgaattttctcaaaggccttttctgcatctattgagatgatcatgtggtttttgtctttggttatgtttatatgctggattacgcttattgatttgcgtatattgaaccagccttgcatcccagggatgaagcccacttgatcatggtggataagctctttgatatgctgctggattcagtttgccagtatcttattgggtatttttgcatcaatgttcatcagggatattggtctaaaattctttttttgttgtgtctctgccaggctttggtatcaggatgatgctggcctcataaaatgaatcagggaggactccctctttttctattgattggaatagtttcagaaggaatggtaccagctcttcctcaaaccactggtagaattcgactgtgaatccatctggtcctggactttttttggttggtaggctattaattattgcctcaatttcagagcctgttattggtctattcagggattcaacttcttcctggtttagtcttgggagggtgtatgtgtccaggaatttatccatttcttctagatcttctagtttatttgcgtagaggtgtttacggtattctctgatggtagtttgtatttctgtgggatcggtggtgatatcccctttatcattttttattgcatctatttgattcttctctcttttcttctttaatcgtcttgctagaggtctatcaattttgttgatcttttcaaaaaaccagctcctggatttattgattttttgaagggttttttgtgtctctatctccttcagttctactctgatcttagttatttcttgccttctgctagcttttgaatgtgtttgctcttgcttctctagttcttttaattatgatgttagggtgtcaatttaatatctttactctcttctcttgtgggcatttagtgctataaatttccctctacacactgctttaaatgtgtcccagagattgtggtatgtcccagagattgtggtatgtgtctttgtactcactggtttcaaagaacatcttcatttctgcctccatttcgttatgtacccagtagtcattcaggagcaggttgttcagtttacatgtagttgagtgtaaacctgggtttttgaaggataaaaacctctgggcgagatgcaagagcaacggtcaccctgagttaggcctgctggacttctctcagcaattccttcagggatcccctccatatatgtaaatatacaacaaagtaatgacaaagagaaggctttccaaaccacaattccagaccagatttcaaaccagaagagcatttctttaaacatgttccttattcttcatccagctggggagagattgccacagactgagactcttcttacaattccaggaagagctggctagtccctgtgatggggacacaggtaaatctagagaggtcagaagatcaggagaacaaagaaggttttggcagcacctggaatactcaccaaaccaggttataagatgtctttgaggaactatgtctccattgcaattagatccttgcactctgggttggcagcagcctgccggcagagacagcaccagaggcagcccttagtccaagagaactaagcagccacttggattggcctgtggacctgaaactggtgaggaactgccaaaccataaacagatgtccacaagaggtatcccagacgatctcccagatttgtaactgaacactggattctccttgcccactgcccacataaagacaatttatcaagacaagggaatcgaataaggaaagagtttaatgcacacagagctggctaaaggggagaattgttttattactcaaatcagtctcccccaaaattcagagatggagtgtttaaagataatttggtggatagggagttaaggagtgggagggctgattagatgggttagagataaaatcataggaggttccaggtgggttcttgccatcctgttcctgggtgggatcatagaactgggtgaaccagattactgatctggttggtgccagctggtgcatcagaatacagggtttcaaaaatatcttgaacacttttacaaacactgatgttatttctaggagcaactgtggaagtcaggaatcttgtggcctctagctacataactcctaaacctaaccttgtggctaatttgttagtcttacaaagatggtctggttcccaggcaagaaggagatttctgtagggaaagctctattatcatctttgtttcaaagttaaactataaactaaattcctcctgtagttatctcagcctacgcccaggaatgaacaagggtggcttggaggttaaaggtaaaatggaattggttatgttagatccctttcactctcataatttttttaatttgagacagagtcttactctatcacctaggctggaatgcagtggtgtgatctcagctcactgcaacctccgtctcctgggttcaagtgattctcctgcctcagcctcccaagtagctgggattacaagcatgcaccaccaagcctggctaatttttgtatttttttagagataaggtttcaccatgttgagaaggctggtgctgaactcctgacttcaagtgatctgcccacctcagcctcccaaagtgctgggataacaggcgtgagccactgcccactctcatttttgcaaatgcagttttaacttaatcattttcagctggcaatttccagtgactgcctcagaactccctagctgggttattattttagaaatgattctcagtggtacagcctagagaccattttagtctattttgtttacatttaatcaatctccttaattaaatctcttcatgccaataatatctacagtggtttctattttatgcatcaaactctgaccaatatggccatccacccaaagaaaatgttataagatctgggaaattgaaagagaaaatatgtagacaaaaggtaatgttgccttcttccagctaattctgaattcaaagtacttttactgcttttaagatcaacttgattattcaagatatgtccaataagttcatatcgcagtgaattctgtttcttcttttttctaaatctctaagaagggtgaaaatatgcgtgtacattacttaactaaaaaataataaatggggtcaggccgagtggctcatgcctgtaatcccagcacattgggaggcaggcagatcatgaggtcaggagttcaagaccagcctagccaatatggtaaaaccccctctctactaaaagtgcaaaaattagcagggtgtggtggtgcatgcctgtagtcccagctagtcaggatgctgaggcagcagaatcacttgaacctgggaggcagaggttgcagtaagtcgagatcgcaccactgcactccagcctgggcaacagagcaggactccatttcaaaaaataaataaataaataaataaataaataaataaataaataaataaataataaaagagacagggttcaggacataccaccttaaaaactgactgtaggagaatacagcactctaaatttaccttgttagcataaagattattttgagctgattattttgcaaaacagcagaaacaagggaagctctgaaaacagagatgttacccttttgtaagagaatttatacatctgtaaaggaaatcgccatttgtaaggacagcttcctctctgcattctaaaatcacttgaaactaatcaatgaagaaggcattggcataagtctacacaacaaaccttgctcttgtttaccaggattttcctggccattatgtcataattgagtctcctccacaccattgatttaattcagaaaaccatagtatttaagcctgaagtgaaagtcacctcttagagatttacccatttctctggattatctcccatgtatataggagatgtatgtgttaataaacttccgtgtgttttactcttgttaatctgtcttttgttcctggagtctgggaactcccatcaaaagaagcaatcaggaaatgagaggaataaaagtaaagtgtaaagaatcattattcttcaagttttaaagaatgtcacatttcgtgaattgaaatgtggttattaaatcccaccaacaaattccagaaaaatttaaaaatcttcagttagtagaaatgtgtaagtacaataaaagaaagtatttccagtgtgcagaatatcaaaattggtgatgaatgggtatggtttttatttgcctagcagcctgtgatgcagtgtgtgtgtgtgtgtttgtgtgtgtgtgtgtgtgtgtgtgtgtgagctgcctctctacttattcccagtttccaggagtggaaacatggtccaaccccagccaaagagagactatcctggcgcttttcaaaactgacttggaaagaagtgctcactaccaaggttttgctcagctaggactactgaagcctggtgctactctgtccatccgtcattatgaggaaagcagacaccaaggaaagcagagctgaaataaggaaaggaagcaaagtgagggcagtacacattctggtgctttaggtccaacataactgaagaatttccagtgacactgatagcacaggagtcagataaatgcctagggagatggggtgggttgcggggaaaccccaccatcatgacaaagacagtttaaagcctgaaagccaagccacaagtcaaacccacagactggattgagaacctgtcttcccacttggtgcactggcctctgatcaccaaccttcaactattttacatatacttacccttccccaattggttttttacacagccatgcacacctttgagtgatgcctttgttttgaactttttgcatactcacaaaacaatcagcatgcactcccctattctgagcccataaaagccccagactcagccacactgggagagaaaccacccaatttggggtggggtaccacccctgcatcccctctgcactgagagccattatgttgctcagtacaattcttctacaccctcctcacccttcaattgtcagaatatcctcattcttcttcaatgcagaacaagaactcgggaaccaccaaatgcaggtatgagctataacacagccatatgtgcaagtcaggcacagactgggtgcgctgagggggcaggtcacctcctgcagcaggtagtatgcccaaacgaggcctgggtgggggggggggggggtcaccaacaggaggtccctgctggcaaaatgactgagaaaaatcctgcatcattttctggaagctcatccaggatcatcagaagggtgagtaaatgtggacctatgatgcttctctttttcccaaggtttctcatcctcagactatcttctgaaggcagatgaagcaccaatcctctgattagccaattaagggcaaatggtgcagctacagagcaatgctggggaggaacctgccacactcacccctgctctgttgcactcgggtgtagggaatcctggctttttttcccttcacaaaggtcttgccatcatcagggatcagaataaggtcctggggcaactgaaggcatccagccaagggcacaccttgatgttgcctgaagttcccagaccagctccagttcccaaccacctgttagggtgtcaaccaagactttgctgtggcatttcccttctttctttcatggattgtaatggctcctatctcttcttttataacattaagggtgctgttgcaaactacagagatattactgggtaggatgggtacatggcccagtcataaaaatgtaattcagaacaatgtggtttccatctattcttggaggcagcgaggaggcagtgattaagagttttttttccccattgaaggaactcatttgcataagagcaagaggctttttcctccaggtgcctaccctttccttgacttaatctgttttttttttttgtcgttgtttcaccatgtcaggagttaacacagacctgcaaatacagagagctttcctatgcgagaggtttttttttctttcttccttttgggaggcaccttactgggccacatccccaaatcttgggactccctttctctcccttgttagaggaggatgtggttccacagcttcaccttagcagtctgcagagaaacaatggcagagaaacaatggaggaatggcccaggctgccactgccagtcactgactgcagttttgcaaggcccacatgggagtcaatttaatgagtccatgcaccctcccggggcactttgttatcccaaactcaattccaaccttcaggttgaagccccagaaaagaaaactaggtcttagatcagacaacagcagaagtctaggggcacagcacaggcaagtacgactaattcctgccaattaggcacctccccccagcttcatggaaggaggttatgtgtgtatccaaggcataaatgaggtctaggggactcgaaggttaccaacagcaagaggacaggccagtgcagatattcctaccctctaggcttccctgctacatgggtgaaggccatattgggacccatgggcagcacctgtcaaggttggtgaaacgtggggctacaaggatggaagaaaaaaggggatgcactttttttcctctcccacatgtaccctgggtacttgctggaaagagaaattaagggatgcctttttcccctctttccagatgggtaaaaaccattttcagtctgtacttctctccagtgcatcctgaatcattggaactcctttgaaaaaaaaaaaaaaaagccttttttctgtttccttgtctgtcctccctttgtggatggttaatcgtgtctccataccacaggaacctcccattcacatgtatccccaaactgggataagtataatttcccgaaaccttaaactgtttggcctaaaaatgaaccaggaagaaattacagttctaaccgaaaaatctcttgaagaaggacaacatctacagtatgtagataacctctctgtctgcttccccttcacaggactccagataggactccatagctcaggggaagggaactcagaaatctgacatgctggcagaagggtaaaagttcttaccagtgacacttccagcgtccctctctctgtaaaaacaggatgaatgaatggtaaaacaaaaaaagaaaaagaaaaagaaaaaaaaatcaatgtttatataatctgtaaagatttgattaatggaaaaaaagatttgtgaggctagtcttaacctgtagctaatctggtatacattgtgtctttctgtatagttctgtcataaggtggaataccttagaataaaacctgggcttaggatcccataagcctgctgttcaagcaggccagaaaactggatagttacaaactttgctacaggtctcagaagaaaaacaaaaacaaaaacaaaacaacactggatgaggtctccatcttgttttacatccctgggagcttaaccttgtaaccacatggaagtattttctcttgctctctgccattttacaatggcatcccatgttcagtcctgccttagggaatgagtactttctggctaatatctgtgtgacttttttttttttctttttgagacagagtctcactctgtcacccaggctggagtgcagtggcatgatctcggctcactgcaagctccgcctcctgggttcacaccattctcctgcctcagcctcccgagtagctgggactacaggagtccaccaccacgctcggcttattttttgtatttttagtacagatggggtttcactgtgttatccaggatggtctcgatctcctcaccttgtgatccgcccgcctcagcctcccaaagtgctaggattacaggcgtaagccaccgcgcctggccctatctgtgtaacttttacattgacttattctgttctcatccatccacaacttctagcttccttttttaaatcttcctttctgcctctgcctctgcctctccctctccgtctccccacggtctccctctccctctctttccgcagtctccctctgatgccgagccgaagctggactgtactgctgccatctcggctcactgcaacctccctgcctgattctcctgcctcagcctgccgagtgcctgcgattgaatggttttcatattttttttggtggagacggggttttgctgtgttggccgggctggtctccagctcctaaccgtgagtgatccgccagcctcggcctcctgaggtgccgggagtgcagacggagtctcgttcactcagtgctcaatggtgcccaggctggagtgcaatggcgtgatctcggcttgctacaacctccacctcccagccgcctgccttggcctcccaaagtgccgagattgcagcctctgcccggctgccaccccatctgggaagtgaggagcatctcggcctggccgcccatcgtctgggatgtgaggagaccctctgcctggctgcccagtctggaaagtgaggagcgtctctgcccggctgccatcccatctgggaagtgaggagcgcctcttcctggccgccatcccatctgggaagtgaggagcgtctctgcccggcgcccatcgtctgagatgtggggagtgcctctgccccgccgccccgtctgggatgtgaggagcgcctctgcccggccgcgaccccgtctgggaggtgaggagcgtctctgcccggccgccccatctgagaagtgaggagcccctccgcccggcagccgccccgtctgagaagtgaggagcccccccgcccggcagccaccccgtctgggaagtgaggagcgtctccacccggcagccaccctgtccgggagggaggtgggggtcagccaccgccaggccagccgccccgtccgggagggaggcgtgggggtcagccccccgcccggccagccgccccatccgggagggaggtgggggggtcagccacccgcccggccacccgccccgtccgggaggtgaggggcgcctctgcccggccgcccctactgggaagtgaggagcccctctgcccggccagccgccccgtccgggagggaggtgggggggtcagccccccgcccggccagccgccccgtccaggagggaggtggggggataagccccccgcccggccagccgccccgtccgggaggtgaggggcgcctctgcctggccgcccctactgggaagtgaggagcccctctgcccggccagctgccccgtctgggagggagatgggggggtcagccccccgcctggccagctgccctgtccgggaggtgaggggcgcctctgcccggccgcccctactgggaagcgaggagcccctctgcccggccaccaccccatctgggaggtgtacccaacagctcattgagaacgggccaggatgacaatggcggttttgtggaatagaaaggggggaaaggtggggaaaagattgagaaatcggatggttgccgtgtctgtgtagaaagaagtagacaagggagacttttcattttgttctgtattaagaaaaattcttctgccttgggatcctgttgatctgtgaccttatccccaaccctgtgctctctgaaacaagtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccacagggtcctctgtctaggaaaaccagagacctttgttcacttgtttatctgctgaccttccctccactattgtcctatgaccctgccaaatccccctctgcgagaaacacccaggaatgatcaataaaaaaataaataaataaaaaaataaataaataaatcaataaaaaataaaaaataaataaataaataaatcttcctttctgtgagccacatttagagattctagatttttaaaaaactgcttaacatctctttgaaaataattcataatacttgtggttaagtcataaccttagttgaggtttgttagtttcacctgtgaggttgcttttggtaaagttcaaaagccagaaatattggcggcttgaccaactcaagtaataagggatttgaaaatattttttaaaagagcaccatggttaaaagtcagcttatattaaaagtggagaggctgcgtgtggtggctcacgtctgtaatcctagcactttgggaggccgaggcgggtagattgcatgagctcaggagtttaagaccagcctggccaacatgtcaaaatcctgtctctactacaaacacaaaaaattagctgggcatggtggcatgcacctgtaatgtaagctacttgggaggctacctcttgaactcaagaggtagaagttgcagtgagctgagattgtgccactgcattccagcctgagcaacagagtgagactctgtctgaaacaaaaaaaaattggatatcctagctataggtatatttaaaacacctttatgtcttttttttctcttcttggatcttgtttggttggaaaaaggtttttgtcttctcagttgacttaatttttttttcactcttaatgcacacatgagaagcctaagataatttctgatagcctgggattccttgggaaaaacagagaaggcaccacagaacccattttgggaaaaatgttttcctcagggaactctaactaataattaaagtcagatagatccctctcaaaatctgtttttgtcttcaagctgtacctacttattaggccctagaaacggcatgttttcctaccggttttttgaagagctcaacccgagtccagtaacccaattaggagattggcaagtgaaaaatctgtcagggccaggtggctgacacctgtaatcctggaactttcagaggctgaggtgggtggatcacctgaggccaggagtctgagaccaccgtggccaacacggtgaaaccccatctctactaaaaatagaaaaattagctagacatggtgatgggtgcctgtaatctcagctactcagaaggctgaggcaggagaatcacttgaactcaggaggtggagtttgcagtgagctgagatcacatcactgctccccagcctgagcgacacagcaagactgtgtctcaaaaaaaaaaaaaaatcttataactagtggatcttcttctgtctgtgtagttatgcatgtgatatgtatgtgatgtttatataaaaaagagctccaattaattggattaagtaaaaataagcacttagatcaaatatttttaaagaaaaaatagaagctgtaatcccttttagttcatgtgactttaatctttgagaaataaaaaaagtcttaaaggttatatgacaaatgtcttcaaaatgtaaatatgtggtctaaattatgcaggtcaaatacttggattactaaatactttaaggtcaaaaactgcttctttggcttttgaaagttgttaagacttgcctgctttacagtttaaggcctggggacatatggatttaactgtacccctaactatgctggaaagacaccttacctgtgcctagtacataattaaaataactaaccaggttttacattaacactaaaaatatctaagagttaccattataacatgtaacggaggctaccgaaaatagatttacatggaaggtgtaagagaaaagtaaaatatgtttttagtaaaagattataagaaggcatgggaatgtaaatttttgcctagagggttaaaggattgttttaaattaaaggtttgaacaagttgtggaaggtctgtaaaaattaactttgtaaaagaaatcttgtgtgtaaatgtattgactaaattcaagagtattatttggtttttccacaaatagaacatgggaataaaaggaaaacaaggttttctaaaggcactgatctgctctttaacaaaaatgtgtaaagagttataaaaggcttataagaggatgggcgcagtggctcatgcctgtaatcccagcactttgggaggctgaggtggtcggatcgcccaaccccatgtcaggagttcgagaccagcctggccaacacagcgaaaccccatctctactaaaaatacaaaaattagccaagtatggtggtgggtgcctgtaatcccagctactcaagaggctgaggtagaagaactgcttgaaccagggaggcggaggttgtagtgagctgagatcgtgccaccgcactccagcctgggcaacagatcgagactctgtctcaaaaaaaaaaaaaaaaaaatggtttataagaatctcacctgacagatgaacaggttaagatttgatagaattacctataaggttttttgttgttgtttttgaggcagagtctcactctgtcactacccaggctggagtgttgtggtacaatctcactgcaacctccgcctactgggttcaagtgattctcctgtctcagattcctgagtagctcggattacaggtgggtaccaccaggcccagttaatttttgcatttttaatagagacaaggtctgtccatgttggccaggctgttctcgaactcctggtctcaaatgatcccctgcctttgtctcccaaagtgctgagattacaggtgtgaggcaccacccccagcctataaggtttcgttttttaaaaattaaggctgacattaatagaagactaatgtaagggtggaatttggctttctctctcttaaacaagattttcacgtaatataattaaaggataatgaaagacttttgtttgtcttgcaaataagctactgaaaaaaaaaggaagggagatacaagagacagactgtttggaaacctaagtcttccctctaaatgagtaaaggtttttgctttttaaaaaaatttttgggctgactctctttttggactcagctcgcctgcacccaggtgattaaaaagctttattgctcacacaaagcctgtttggtggtctcttcacatggacgtgagtgaaatttggtgccatgactcagatcgggggacctcccttgggagatcaatcccctgtcctcctgctctttgttctgtgagaaagatccacctacgacctctggtccccagaccaactagcccaaggaacatctcaccaattttaaatccagtaagtggcctctttttactctcttctacaacctctctcactatccctcaacctctttctcctttaaatcttggcgtcacacttcagtctctcccttctcttaatttcagttcctttccttttctggtagagatgaaggagacacgttttatccgtggacccaaaactccggcgccagtcaaggactggggaagacagtcttctcttggtgtttaatcacgcggagacgcctgcctgattattcacctaagtttcagaggtgtctgaccatgcagggacgcctgccttggtccgtcacccttagcagcaagtaccgcttttctggggggcaagaaccccccaaccccttctctccgtgtctctaccccttctccacttttctggcgggcaagaaccccccaaccccttctccttcacccttagcagcaagtaccacttttctagggggcaagaacccctcaaccccttctccttcactcttagtggcaagtactgcttttctagggggcaggaaccccccgaccccttctctctgtctttaccccttctctgcttttctgggggtcaagaaccccccaccccttctctccgtgtctctactctctcttttctctgggcttgcctccttcactatgggcaagcttccaccctccattcccccttcttctcccttagcctgtgttcttaaaaacctaaaacctcttcaacaaacacctgacctaaaacctaaatgccttatttccttctgcaatgccacttgacccaatacaaactcaacagtggttccaaatagcgagaaaatagcactttcaatttttccatcctatgagatctaaataattcttgccgtaaaataggcaaacggtctgaggtgcctgacgtccaggcattcttttacacgtcggtccctccctagtttctgttcccaatgcaacttgtcccaaatcttccttctttctctcccgcctgtccccttagtcccaaccccaagcatcgctgagtctttctaatattccttttctacagacccatctgacctctcccctcctcgccaggctgagctaggtcccaattcttcctcagcctctgctcctccaccctattatcctttttatcacctcccctcctcacaccaggtccggctcacagtttcgttctgagactagccctcccccacctgcccagcaatttcctcttaaaaaggtggctggagctaaaggcacaatcaaggttaatgctcctttttctttatcccaaattagagagcatttaggctctttttcaacagatataagaacccagcccagttcatggctcatttagcagcaaccctgagacgctttacagccctagaccctaaaaggtcaaaaggacgtcttattctcaatatacattttattatccaatctgctcccgacattaaataaaactccaaaaattaaattccagccctcaaaccccacaacaggacttaattaacctcgccttcaaggtgtacaataatagagtagaggcagccaagtagcaacatatttctgagttgcaattccttgcctccactgtgagacaaaccccagccacatctccacacacaaaaacttccaaatgcctaaaccacagtggccaggcattccttcaggcccgcctcccccagaagcttgctacaagtgccagaaatctggccaccaggccaaggaatgcccacagcccagaattcctcctaagctgcgtccaatctgtgcaggaccccactgaaaatcggacagttcaactcacctggcagccactcgcagagcccctggctctctgactgactccttcccagatcttctcggcttagtggctgaagactgacactgcccgatcaccttggaagccccctagaccatcacagacgccgagtttcaggtaactctcacagtgaaaggagaaatttgaactaagatggaaaggctcatggcaggccctcagaacctagatcagggatggaccttttctgctgtccagagtctcctgttgttgttcttcagatcaccagactggaccctttggatactgacagcagctcagcttgggcccagcactattcacaatggcaaggacttggaaccaacccaaatgcccatcaattatagactaggtaaagaaaatgtggcacatatacatcatggaatactatgcagccataataaaggatgagttcatgtcctttgcagggacatggatgaaactggaaaccatcattctcagcaaagtaacacaagaagagaaaaccaaacaccgcatgttctcactcataagtgggatttgaacaatgagaatacatggacacagggaggggaacatcacacactgaggcctgttgaggggtggagggcttggggagggatagcattaggagaaatacctaatgcaaatgacgaattgatgggtgcagcaaaccaacatgggacatgtacacgtatgtaacaaacctgcatgttgtgcctatgtaccccagaacttaaagtataataataaaaaaagaatggatcgtatgattaaagaaataaagatatataacattaaaattttgagccatcattttaggtaaataaatgatttatgataacctggaattctatttcataatatcaagtgttctaaatctttaacatatttgataggcttcccaaaatcaaacttcaacttcaaaattctctttcctgactcccaacttttagctgctacagagggcccctgaagcacccaaaagagaaataaacaggattatctgacatgtttagttacacagcattgtcaaaataaaaattatgtttaacttcttcaggttatattttagtatatcatattaaaatatgttccaaaattgtattggatttctaaaattctaatgtttgagtatatgctatcaatcataattagagttactatgttaagttattataaaccacaataataaccaaatttctttgttaatcctgtttttgactgtaactaccctggacattttgttattcagagacaactgttgtcttgttttgatccttttcaaaagatggtttataatcagctataggactttgacacgtgctcttaaataaaggtttctgataacttgggagattgtgacattggaatagaggaaaacaatataggattcatgaagagctgaattgcagaataagagttaacaaaatggactgaactaatagaaaactgaagtaatcctttttaattttttgcttaaaatgttgctgaaccttttgtttttcaaagccaggaaaacttttattttcagctatttacaacttttaacaattgagtaaggtatactcctgcaaacaaaatttggagcatatttgtttctctctgcctggtttctccaaaatttggaagctagatgcaaatattcttaacttatagcaatataatgttctgcataagcgcaataagaatccattttcttttgcaacaagatgcaattggagaaactggttcttttaccaaggcttttactaaaagggtgtggttccctctagggaatcaagcttgacttgcagaggcaataaagcttgcaagttttccctcaggaaagcttgcctcatgccttgtctacacaatctccatacaggtttggtgagttagaaatgtcactttctaacagggctaggagccccaagtcatcttgggccctcaagaagagagaaatgtacccaattcataggtatttaagagtacaaacccatggctgggctgggctttaaaaagtgtcaactgagcttccttagagaacagggtttcatcagagccaatttttaaaagcctatgtgaaaataattattcttgctgcactttatgcaaataatcaggccaagtatgaaactaaactcagttttgcaaacaattcagtcctatcatgatttgttttaacaaaaatgaggactggagagagagcaattatgtttcaaaacttatacacttgtcattctattctagtctcattattagtagtttttaagtttttgtctgcattttagactaaccctgcttattcctgtgaactaaccagtgatctctggctgcagttcagaagagaaaaaagggatgggtaatgtaaaaatctgaaacaatttttaagttctgggcaatcattctgcaagtcctgccaggtgacaggagtaaatagggtgtctataacccagcagtttcgtttttgggaaaataagaccaaaggagctaaccaaagctaagcccatgcactcaaatcttagcaggcataaccatagcccccagttatctgggcgtgtcagcagcctcaggattttggagctgcccttatcccccctcttttgttttgttttgatacatgtcctctttttttctttttttcaagatggagtcttgcttgctctgtcacccaggctggagtacgatggcgcaatttcatctcactgcaacctccgccccctgggttcaagcaattctcctgcctcagcctcctaagtagctgggattacaggcacatgccaccacgcccagctaattttttgtatttttagtagagatggggtttctttttttgtttgtttttgagatggagtcttgctctgtcgcccaggctggagtgcagtggcgtgattttggctcactgcaagctctgcctcccaggttcacgccattctcctgcctcagcctcccgagtagctgggactacaggcacccacaaccacgcctggctgattttttgtatttttagtagagacagggtttcaccatgtcagccaggatggtctcgatctcctgacctcgtgatctgcctgcctcggcctcccaaagtgctgggattacaggcgtgagccaccgcgcctggccaagacggggtttcaccatgttggccaggctggtctcaaacgcctgaccttatgatccgcctgtctcaggctcccaaagtgtttggattacaggcatgagccactgtgcctggcctgacatatgtcttctaatatgtctcttcttgacttcaggttatcaaactccaaactgtaatgcaaccgcagcttcagacaatggctcccttttaccggggacccttaaataggcctctgagggagatctgactgccatcttcccaaaacagcggcccctgtcagcaggaagcagttaagttcagtcttcatttctattctaatggcagttagatgtacctcctcagagaggggaatggatagcagcaggaggcagaaaaatgcctaggcagacagggacaggtaactggtgaaaccccacctccaagccaaagacaatttaaagcctaagaaccaagttataagtcaaatccatgaaccagattaagaacctgtcttccagtttggcatgctttcctctgatttacccctacccttcacctactttacatacacctaccccttccctaatgggttttttacagtcatgcccacctttgattcatgcctgtgttttaatcttttttgcatattcacaaaccagcacgtactcccctattctgagcccataaaagccctggactcagccacactgggaaagaaaccgcccaacttcaagtgggggaccacccccatgtcctgcctctattgagagctcttctcttgctcaatacaattcttttccgccctcctcacccttcaattgtcagagtacgcgcattcttcttggacacaggacaagaacttagggaccgctgtatgtgggtacgagctataacacaggggggctggggcccagcctgggtgggtcgaagggcaggccacctcctaggggcaggtagtgtgccccaccaaagcctggagggggcatcaccagccagaggtctccagctggcaaagtgaccaagaaaaatcctgcatcaacatcagacaaaatagtgtccagttatttaaagacatttgaactgagttttttgtgcttgagtctgaaagaggcctggcaaatacaaagtaaaaatctgtcaacacaaatgtcaggcctctgagcccaagctaagccatcatatcccctgtgacctgcaagtacacatccagatggccggttcctgccttaactgatgacattccaccacaaaagaagtgaaaatggcctgttcctgccttaactgatgacattgtcttgtgaaattccttctcctggctcatcctggctcaaaagctcccccaatgagtaccctgtgaaccccactcctgccaatcagagaacaacccccctttgactataattttactttacctacccaaatcttataaaatggccccatccttatatccctttgctgactctcctttcggacttagcccgcctgcacccaggtgattaaaagctttattgctcacacaaagcctgtttggtggtctcttcacacagatgtgagtgaaaaccattgcacctctgaaaggattaacaaaataaaataagtatttggttattctgcccctccttagttggtttacccaatgagcttctcccttgtaaaccaaaaataaaattcggctggggcagtggctcaggcctgtaatcccaccactttgggaggcgaggtgggcaaatcatctgaggtcagtagttcaagaccagcctgaccaacagggtgaaaccccatctctactaaaattacaaaaattagccaggtgtggtggcacatacttgtaatcacagctactcgggaggctgaggttggagaatcacttcaacccaagaggcggaggttgcagtgagctgagatcatgccactacacgtcagcctgggcaacagagtgagactctgtctcaaaaaatatatatattctaaaccctccaaccaactgaatggacccctccttttggccaagagcattccaaagttaacctgagaaactagttcaggccatgatgggaaggcggggtcagacatgtctcattattctgtcctcccttctggaatttaggtacagctgaccagcattaacattaacatagagattttacatctgacaaaacagactgtttgtagcctaagataccaacatgacaaggagcaggttctgcaagaaactaaagattttatcccaaaatatatttcttgacatattttgaaatggccctgcaaagctgtctcttgtggggaaaatctacattctacagagaatcctcttccctttccaagtactttccctgattcagaagggaattaactaactctggcacctttttaaagtctgataagaaacagttacaaggttgggcacagtggctcacgtctgtaatcccagaactttgggaggccgaggactcccaaactctgtaaaatatttgaagagatttattccgagccaaatatgagtgaccatggccccgtgacacagctctcaggaggtcctcagaacatgtgcccaaggtgattggggcacagtttggttttatacattttagggaggcatgagacatcaatcaaatacatttaagaaatacattggtttagtcctgaaaggtaggacaattcaaagttggggcttccaggctataggtaaatttaaacattttctgatttacaattggttgagtttatctaaagacctgagatcacagaaaggaaatgttcaggttaagataaaggattgtggagaccaaggttcttttgaagttttattgtggctgccctcagagacaacagatgacaaacgtttcctattcagatctttaaaaggtgctagactttaagttaatctttttaggattgggagggcctggaagtaaaagatctagctatgttaatagagattctttactgatgcaaattttcccccacaaaagacagatttgcagggccatttcaagatatggcaaaaaaacatgttttgggataaaatattttgcttttcttccttgtcatgtaatgttattccagagtcagggtgaaaagtaagtctcgatatatagggttaaataaaacccatctgatgagaatttatggtttgtagggcatgactccccagaactcttagataggaatttgggcaagataaaaaaatcagaatttactcctcagtagcaacacatgacagatagcaggtcctgaaataaactgaagtgttttactacaaaacatatttttttgacatattttgaactagccctgcaaagctatttcttctggggaaaatctatattctgtagaggatccccttccctttccaggtttttccttttaaggtctgacacctttttaggtctgataagagacatttactatctgttctctctgaagcctgctatgtgggacctttatctgtgtaataagaatcttggtctccacaaccccttgtcttaatccagacactcctttcaattgatcctaggtcttgagatagtaacttaactctttcaaccaattgccagtcagaaaatctttgactctccctataacctggaagccccctcctgccacaagtttcccaatccccctatattacgtcttaaagttgtcctgccttttcagaccaaagcagtgtacgctttacatgtactgagtgatgtctgcctgcaacttctgttcccctaaaactgtacacaatcaagctatgacccgaccaccttgggcacatgttttcaggacctcttgggactgtgcctcaggccttggtcactcacatttggctcggaataaatctcttaaaatattttacagagtttgagtcttttttttaaatcaacagttcaaataaatttttaaaacttttaatgtgcccaaatttatcttttaacattaccagtctcagtttgtgaaagtctagagttctccctgtccatgtctgtaaattcttgaggctcatagtctcatttatagtaccccccaccccaccaccactcagactctttgtgtgcaaagtctatctccattgccacaaactctcataaaaaaaattcatcctttcctccaattttcacaaaagcacaacacataaaagcttcagtatccaataatctctctttttttgcaaactttactgaaggtttgggttataaggagtgctcacattgtgaacagtctttgcaatcttctgcctcctccccttcccctttgctctacaaagtgaattcctctccttgcttcctgtaaagctgttctgagccttccctacagatctctccttccactccatcagcatttcaaagcacttactccagataaaaactatgtttgtgctaaataaatcctggtgaataggatgccctcatatcactacacaagtaattacctgaatcaaagtaccctttaaagaaagaaggcaaatgtatatggagaaaaattatgcttcagtggaatattacgtattgtttagagcacaacttttcagggtatctgattccaattcactgtctttgagctattttacaactctgtaaattgcagataaatggtaacaacgcacataattcttacctatacatgtgcaaataaattctgtcaggtagaagggcaaccctccctgattcccaaggaaagagccagttttacagcctttgcaaatttttctgaattcctgttttttcacttctcctttgaactggctataatatctttactggttccctcatttaattaatgtattaaataaaatttttgacacatgttcattttatagctgcatgagagtcattattttaccttttttgaaaattatctttccagcatatcaaaaagggttctagggcaggaaatgatagcacactcaaaagggaaattgattaattaattaatgaagggactatttacaggagtgtgggcagaattaaacctccagggctggtgagcacccaatcagcaacagagaaaaattagtactatctctatggatactggacaagggtaggaagctatggccacacttagaggaacacaaattatagcttggaagaaaagaagcagggggaaaaaatatgacttttctttccttttgtcttctgaacctcatgaagccagagggtactggggacaaggtgacacagtctagcttgttttgtattgctttttccattcctttcagtcacatcagtccaacatggatcacaaattctcagtgaatttacaggggctggctcatgtctgctatgtaaaaatttttttatagaagcttacagtatgattacactttatatctacatgtgtgtcttagtctgttagtggtgctgtaacaaaatacagtctggataatttataaatgacagaaattagttttcttacagttctagaggctgtgaagttcaagatcaagatgccggaactcagtgtctcataagggctttcttgctgtgtcctcatgtaaccatccaataggtttttcttgcctgctgaccagatagagccaatttatcaagacaaagagtttagtgcatgtggagctggctaaacagaagatgagttttattactactcaaattaacctcctgaaaattcagaggctagggtttttttatagtttggcagacagcaggctatagaatggggaatgctgattggttgggtcaggaataaaattatagggagtcgaagctgtcatcttatgctgagtcagtttctggagggggccacaagaccagatgagtcattttacttatctgtgtggttccagctggtccactggaattcaggatttgaaaaataactcaaacaccaatgttaggttttataatagcaatgttatctataggagcaattgtggaggttggtgatcttgtggactctggctgcatgactcctgagctataatttctaatcttctagttaatttgttagtttacttattttttgagacaaggtctcgctctgtcacacaggcagaaatgcagtggcaggatcttggctcactgcaaactacacctcctgggctcaagtgatgctccccacgaagcactacaggcaagtgccaccatgcccagctaattttgttcattttttgtagagacaaggtctatgttgcccaggctggtctcgaactcctggacttacacaatcctcccattttggcctcccaaagtgctgggattacaggcatgagccattgtgccctgcctaatctgttagtttaacaaaggtggtctggtccccaggaaagctggggatttgtttcatggaagagctcttatcatctttgtttcaaagtttgtaatctaaattcctcccaaagttagtttggcctatgcccaggaataaacaagggcagcttggaagtgagaagcaagatggagttggttaggtcagatctctttcactgtcaaaattttctcactgttataatttttcaaaggcagtttcactcacatggtagaagagatggtaggaactgactcaccccctcacgcccttttataaggctctgccctcatgacttaattctctcctaaaggctccacctcttaatactatcacattgataattaagtttcaacatagaaattttaggggacacattcagaccataacaacagagaagtaatacagctgtttactaaagtcctcaaaggttctctccagtttctggactctaagtctttgactaagaagcaaaagttgacaccatttaatatgtacttttatatgcacattctctgtatattggttgaagcatggtgaatatactttggagaaaggaaaaagcactttatacaacagttgattccttcctgagggaaaaaaatcttgctaaaatagtctcaaggtttctgctgggcctttgtactttcacgcaaattaatgttcagctgagcatcttgacatgctcaggcagaaagcagcaaaattgcaaacagggattgagggagctgaataatgctgtgcatgataaagtgacaagactttggagctcagggaataatctagaaggaaggagattagaaaggaggaggcaacctgagaggctggggtagagctgtggaaatgtttgagggactattttaagaatgtgtaatattcaacttaaaattgttttcttctttccaacttaggtcccgcagaagaagggtgggaagaagaagggggccattcagccatcaatgaggtggtgacaccatcaacattcccaagcacatcccattgaaacggacttcaggaagtgtgcccctcgggcactcagcaaagatatctggaaatttgccaagaaagagatgggcactccagatgcgcatactgataccaggtttgacaaagctgtctggccaaaagaataatgtcccatacggtatccacatgtggttgtccagaaaaacataatgcgaatgaagattcactgatatgtgaaaggaaaatatcacgggccacaaaatcactgagctaaagggaaaattcaagctgggaactgctcaaggcaaacctgcctcccattctattcaaagtcatccctctgctgagacagatgcatatctgattgcttccttgggaaaggcttatcagaaactccaaagactgcaaccatttgtctctcacctacttataacctggaagccttcctccctgcttcaagttgtcccacctttccggcaggaaccaatgtacttcttgcatatagattgaggtctcctgtctccctgtataaaaccaagctgttcaccccttgggcacgtgttctcaggacttcctgaggctgtgtcacgggcacgcgtcctcaaccttgtcaagataaactttatacattaactgagacttgtctcaaactttcggagttcacaaaactatgtacccgttacactttctaaaaccaacagtcagtgtgggagaactgctgatactcgaatacatcaaatagttataaaaccgccaaaaaccgttttctctcaaacttttggtaaaatgtgcttcagggaaaacgcagattggtggttctgataaaatcttaataatgaaataattttaaaaagcaataatggtaaaaataaatcccatttattatctggtatgtccccggcattgtgctaacacagatagctctactacccatgtcacagcaactgaaacagataatatgctcctttttcaggtaaagagacggaggctcagagaggttaaacagctcactcaaaggcacagagccagtacatggcagtacatctcttctcccggggccgccgtcgcggtgatactatttagggccacacgtcccagtgttcagctttcgtatttacgtactactgtttggcaagcggggactcctgaagctctctgaccctggaaaatgcgtggcttgcgtcacagaggagcgtttctggaacgcgctcgcagcacgacaccgcggtgtgtgcaagcggaacgccgccctgtccttgagccttttggctgagattgggagggcagaggaagcaggaaggtgggatttgtttcaaaagggtgcgggaaggggacgctccataccgcctcgcctcttagtgtccccagtcccatcacccgacgtgtacggggacggccgacacgctcaccccacacctcgccggctggggcgggatctgggcggcggctgcggcctggcgcgcgctccgcatctccttcctcgggaggctgggcgggactccggcgagggggcgggccccgcaagcgcccgccccttttctctccccgcctccttcccgctccgcgtcccgcccagcggcgcagggggccgggctccggctaggagggtgggggccgcgccggtgacagccgatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggtgagtgcggcccgggaccttgggcctttttgcgcggtcccgggcggggagctgcggccgctgccccaggccgggtcggcgccggccagctctcgcctgaggcgcacccctcctcctcagcgtttccgcccccagcgccttaggtgcttccttcctccctccgaagtgccggcgctggctggcggcgtaaataacggtgggcgtgtggctttgaccgtattgttgaaaacaaaccagctgggccgcgggacgacctcccgcctcccggcgcacgtgtgcaggtgcgcgctaggccaggccccttccaaggagtcggacccgggtgggaggccgagcgtgggcacccccgagaatcgcgtttggattccgtgcagtgatgatgaatgcccagttttgcatatgatgattgcatagaattggcgtgataatagggaaggcagattataactggcccagggtttcttagaatgttttccttgccagtggcttaaaactgttggcaccaacagcacatttcatcatcagcaagtaagtcttgggcacgtgttgagtgcatgaggacaagatgctgtgaagtttatttaccacattatcttggttttctctagaagctgttcaacaaattgcagaaggaattgcatagttaggcattttaacttttacatcccacttcccatgtgaaggcgatgaggggaaaagggaaaaccttaatgaattcataaaatttgagtacaaaggttatcttctgcattgtgacttctgcattgaacgatacctgcatggttggcaactttgtcttaaaactgtggtttgtagtggcataatttttggctcaaagccttaggtttttgtttttactttaaaatgaccctagttcgaggaaggggcgaatttggtggtattcatgagtatgccataaaacttttacaagctgttttcctttagtaccttaatttctactgttgacaatctagtttttgctaacgttttctcttctaaagcagcaagaatagtaagtttaaaatgcattactggaataataagaccttttagtttaattttaaatggagctgtttgccaaaggacattctacaacgattctgcttagggagtgatatgggatcctgatatgggagtgtagaggggtcaggagactttcagtaaccagacaattgaataggacctacttgaagatggtgcaaacaggcagtggtgaattttgctgttgcttgaaagctttcctctgcacttactcttttttcccgtgtgtgtgtgtgtgtgtgtgtgtgtgtgtgtgtgtatttttttttaaaaatagaaatggggtctcactatgttgcccaggctggtctcaaactcctgggctcaagccatcctcccacctcggcctcccaaagtgatgataggtgtgagccaccatgcccggactgcacttaatctttgcttatggtaattagcattagtggttctatatggaatcagtgagtcttcctatgcaaacatcaaaattttcctctttcttttgagacagggttttactctgtcacccaggctggagtgcagtggtgctatcatagctcactgtaacctcaaatttcagcctgagcctcccaagcctagaactaccggcaagcaccaccacgcccggctattttttattttctgtatatgtgaggtctcattgtgttgcccaggctggtcctgaaccgctgggctcaaacagtcctcaagcctcggcctcgcaaagtgctgggattataggcgtgaaccactgtgcctggcctcctgtttttaatttatttttttaaggctggtcaagttaagcagtgggagtggagaaggaacaaagaaatctgtaaccggttgtgatcaattagttgtaaataccactgcattcggaccagcttaaagtttctgtttcttagacaggcacttactgtttttaaacctagagttagataacagattttctaaatgatagcagcaacggggtgtacaggatagacttttccaggttctgctgttaattttataaagccttgctcagacatgctcaggttacctaacttctaaaatgggtgatcactttaaggatgcaaattagggagacaagagtatcgtaattgctgtacagagccattggaatgtcagtaattggaaggtcataactctggagactgggttatctcatccctcgcctcccacaggcaggtgtatctttgcctcctattccctgccccatcgtggtgattctatccctctggccttgccggataacttcctctctatttctctcagcctcttgccttctgtttccttatggcttttacttactgctttacccatcatgtttggtttcaggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtaagattctcatcttgtgtttgcaatttgatggagttgtggactttattcaaggttacagcaaatgcttttttttactctttggtggaatcttttttgttttgttttgttttgtttgagacggagtcttgctctgtcgcccaggctggagtgcagtggcgcgatcttgcctcactgcaagctccgcctcccgggttcaggcgattctcctgcctcagcctcccgagtaactgggattacaggcacgtgccaccacgcccagctaatttttgtatttttagtagagacagggtttcaccatgttggccaggatgatctcggtctcctgaactcgtgatccacccaccttggcctcccaaagtgctgggattacagacgtgagccaccgtgcccgaccagagtcttaaggtagtagcagtattctttttttggctgggggcaggtgggggcaatgtatttgggcttgtgccctgaatcgtggactccacaacttcttgattttgagaaagccagtcaaaactgcactgaaatacagatgctaaatttaggatttatgttagtatatcttcaaggatattataagaaaaaatgtctgcaatttgttgatgactgggtatttatgtatattgcctttaatcccttcaacaaccttgcacagtgggtatgattctctccattttattcattgttattatttttatttactttttgtttttgaaatggaatcttgctctgttgcccaggctggagtgcaatggcatgatcttggctcactgcaacctctgcctcctgggttcaagtgattctcctgcctcagcctccagagtagctgggattacaggcacctgccaccatgcctggctaatttttgtatttttagtagaaatagaggtttcaccatgttggccaggctggtctcaagctcctgacctcaggtgatcctcccaccttggcttcccaaagtgctgggattacaggcatgagccaccactcctggcctacttatttttttgagacaggttcttactctgtcacccaggttggagtgcagtggtgatcacagctcagctcactgcaacctccacctccctggctcaggtgatcctcccacctcggcctcctgagtagctgggaccacaagtgcatgccacacccagctaatttttgtattttttagcagagatggggtttttccatgttgcctacgctggcctcaaactccggaggtcaaggtatttgcccacctgggcctctcaaagtgcagggattatgggcatgagccattgtgtctagcctgtttattattttttaaattaatttattttctttttagagacagggtctccatcacccaggctagagtgcagtagtgtgatcatggctcactgcagtcttgacctcctggggtcaagagattctcctgctaaggcagctgcctcccgagcagctgggaccacagccatgcgccaccatacctgaccaattcttttatttttttgtagagatgggggtctcacttttttgcccaggcaggttgtgaactcctgggctcaagcagtcctctcaccttggcttcacaaagtgttggtattacagacatgagccaccgcacctggcaggttaactctgtacagatgaggatgctgaggcacataaaggttaaatcttttgcgtaagacagtaccattgatagtggagttgggattcaaacccccatttgtccatctctgctataccgtgctatagtcagaatgatgaaatatatgaaaggatatatgtatttttaataaactgtgtttattgaagggtatctttttataaattacaaaagttaaaatgtttatttttctgttttaaaacaattagaagtttttggaattgtgtagaaaaagtgtgatctcttcccaaagataagtagagatgttaagggtatacactcatggagccacctatatacagccttcattaatgttactgatttaaaagtgttgttcttttaagcactgtatgcttcaaacaaatgagttgcccagagttaagtcttaaatggaaaaggtttagctgcagggcatttcccagttatgattcatggagattcaagttttctttttgtaagcattatagcgtatgggagaagttgatctaatcgcaatttaaaaaagcaaaatatgactgctatatatatgataatcagatgctatctagtccaagtatggaatagttataagtgtggattaaatgggaagcatttgtttagtaattatgatgggatataatggagaaaatataatattccatggaagatttttcctgtttttaaaaaattcttcattagaagtagaatatgctgctttttgaagcttatcagtcatgaggtctgatcggtgcctgttgtaggtactcaaatatctcttggatggagagcgtagttgttcttgccaattaagaggaaattaagggttaaagcaaagcagcagctgctatcagaatcccttaactttggaatgcagtaagacatattgcttgtcagaaacagctttccaaaccaacagatggaattacaggtttttaaagcacttccattgctcctagatgcctgctaagttaggacagttgcagataaagtgcttacagccaagtggagcagatcccttacactgtcgaagaaagtaattcagtggtagcaagttatttttagctctggccccgcagtgccattgtacttgcctgcaagaccatcagaaaatcatttggccttctctattttgctcattccttaacagatgctttgatacttcgaattgttagataaatttaaaatgtacatttttatgacttttgtgttttttgttcagtttaaaagaaccatgtagattataggctttcaataaatacttgttagttggacataaatatgtaaaattaaggttttaaagcacagatatttaagatacagtcttagagcaagagaggctgtcctccttttactgataataagacaaattaagtcatttgcccaagatcacatagttactggtgacagatctcagcataatcagtatatatactgtaatgtacagtggtaaattaaaaaaaaattaaaagccattttagaatgtagaactcggaaaatcttaaaattcttaaatttgacctttgcttttaggagaaaatgtgcaccttctaccattcattcccagcactttgcttgaatgtgcatgggtgtaaaaattatacttcaaccataatttatagcagtattctaaattaaaaattataaaatgctaaaaatagcttttgagctaattttcatgatattgaactttcagaatataaaagaacaaacttatcctattgatctgcattttaggtatatccagagtcttcaggagcttcttgattttaaggacaaaagtgctgaggatgctaaagctatttatgagtaagttcactattttgaccctattcttaaacctattattaggtcacttgggggaaattggttaacttttaggtttctactactttagaacatgtgatatatgtgactgtagcagcccatacaggcaggacaaataacaatcagcaaatttgactaggcataagaaatgcttcgtgttcctctttaacaaaagacaaagttcaggtgtgatgatcagtggaaatgtaggtgtggcctcagtgccagttggactgttcacctggagggtgcatgctccttctaatggacaaccaccttcagccccagctgatctttgccatatgaaaatactgcccatatcatctgattgttttctgattttaaaggaaagctacaagtctagatttgtaatgtaaaatctctcacttttgaaagattggtaactaattaaaacattttttaaaacacagaaggcctagaagaacatggttgcaggtctctagtttatgctgtatggcctgcaagatgatgtaagtaatatgacaatgttaataacccatataccagaattggtaaaccaaagtatttgccttatgcagctacctgcttattgcagtgaagggtactgagagtgtaatgaccatctcttgtcctcagttagttacacatgttttttggactgtctttaaagtgaacagtaacacttcatttttttaaacatgattttaatctgaaaataacttcagcaagagtttactccttgcttaggtattgagcagactttacatgaatgatgttttttaatctttaaaacaattcattgaaataatgctgtttgtgcacaaagagggtaagtagtttaaggttacatagttagcaaatggtagaatccaagcagtcttactttaaaagtaaacattatgttatagagccttctgaaaacagtcattcagagctgtggaaaataagtagtcaagcagaataatacagatttgtgtttctttgaagcagaaagaaaataataaaggagtgactagaatgatgagttgtttgttgtttttgaagagttttgttgtttgtattttagtttaacagtcttgttttgaagcgcattactaactaggaattccaaaaatgttttaagcagtggaaacatcattggaataagttaatagtactcaggatgatgactttgaataggaaagcactcatttggaagtgtaaattcagatgggttatgttagaaaattggtttcgttactgcataattaagacttcttgggccgggcacggtggctcacgcctgtaatcccagcactttgggaggccgaggcgggcggatcgtctgaggtcgggagttcgagaccagcctgaccaacatggagaaaccctgtctctactaaaaatacaaaattagccaggcatcatggtacatgcctataatcccggctactcaggaaggctgaggcagtagaatcacttgaactcgggaggtggaggttgcagtgagccgagattgcgccattgctctccagcctgggcaacaagagcaaaattccatctcaaaaaaaaaaaagacttattttctcttttatttagttatttaaccatgcagtgtcttctaagtgacagagatgggaagactagatgatttgaagatttgtcttttaatataattgtttacttttcctctcccattttataaactcataggatgagtgaaatgagaattcttttctgtttttctgtcctaagtgtttccttctctctttgaaccctagggaataggtccaaaacaggcaggctttattggctcattcatcttgattccttgcagagcagagcaggtgttctctagaggcaagtgctttgtctcctcctatgcagaatgtctctggaataccatcctcttagccagtgctcagatgaccttagttgataacagttaaaaccattaacattttttggattacgttttgtggcagccttactcttaggaagccaagaaaagaattaaatcttgaaagttttattttggaggtctgtatactttcatagatttggtatattttatgatctgaaatacatttaaataagtataggaaaacatgaaccgattttccttttattaaattggggattttttgtctagcatagttggttaagcttatatttttgtattaagtttacttgtcaaaatatttggctgttttgacagatgggtttgtttagctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactgtaagtgtccctcatgagtcaagagaagaagctaaatgagatgtgttggcatattttaaatttatttaggaaagttccatttaggtaggaaatttagttttaccttttggctaattaagaaaaataaatagactgccatcaagaaaggtgtttttattgaatgtaaaatactatgtttatcctaaaggaaaatatttgttctgtttggtacaatttaaacagtattcagatttggaaaagagcattaggtggtttagcttattttgttggtttttttcctttttggatagctttattgtttggtggaaaaggcaaaggaagtccatctcatcgaaaacacattggaagcataaatccaaactgcaatgtacttgaagttattaaaggtaaatactgacatttctccttgcaaaaaaagatacaaaaatcaaaattattgttatttcttactattaaaacatctatttgtatcatgagataaaatggtaggcacaaatgcatgggtttgaaaataaccttatagtattatttgtgcattatgtataggatgactattttattgatagaattatttgttaggcaaagtttggtgatactatagaggatatcttttttgttttgttttgttttgtttgagacagagtctcactctgttgcccaggctggagtgcagtggtgtgatctcagctcactgcagcctctgcctcctgagttcaagcgattgtcttgcctcagcctccccagtagccgggattacagatgctcaacactacgcctggctaatttttgtatctttagtgcaggcagggttttaccatgttggccaggctggtctggaactcctgcctgcctgcctgcctgcctcggcctcccaaagagctgggattacaggcgtgagccaccgagcccagctgagggtatctttcacttaaaaaagaattgaagtccctactgccctgtttctaattcttacactatgagcagtaattcataacaatttggtttgaatcatttcacacttttttctatttataccacttgtacacatacacaattgatgttggtcttacattgttgtttttagaaaatggggtgctctatgtttttttctacaagtttacagacatcttgctgttcagtacatctggatatgctccaaggttttgaatggctctatggaatgtatcagtatgtgttaattaattctcctgttcatgcacacttaggttgttttaatttttttctgttaccaccaataccagcagtactgctgtgaacatccttaaatacacgctcacttttgctagtattttagaggtgagattcctagaattaaaaacatttaaatgcatataaaattttggtatctccaaaaaggtttcaaacaatggataagagtgtttcctaaccaactcttaagttttgttacatagatagcaattattttctccagcctgttatttttcttttttacattgttggtgtctttttagcatatagacttttacattttttttgtagttatatttgtcattcattgtttatggctattcagctttgtcatgtcacacttagactttccctgggccaggcacagtggctcatgcctataatcccagcactttggaaggctgaagcgggtggatcacctgaggtcaggagttcgagaccagcctggccaacatggtgaaaccccctctgtactgaaaatacaaaaattagctgggcgtggtgacccatgcctacgtagtcccagctacttgggaggctgaggcaggagaatcgcttgaaccagggaggtggaggctgcagtgagccgagatagcgccactgcactccagcctggttgatcgagactccgtctcaaaggaaaaaaaaaaaggaaaggctttccctggttgggggcagtggttcatgcctgtaatcctagcaccaaggcaggaggatggcttgagcctgggagttggagacaaacctgagcaatatagggagaccatgtctctaccaaaaaaaaaaaaaaaaaaagcagactttcaccaaactatcaaagtatattttcttctgtagagagttcaagactttgatttgtcaataccattgccatcttaatgcgtgaaagagaagtatatttattaaatccttttttgttttgttttgattcacactagatggctatgaaaatgctaggcgtctgtgtgatttgtattatattaactctcccgaactagaacttgaagaactaaatggtaagcctgatgttgtctttttctcaataattagtgctttgattacttgataagggataagaatttaaatgttttaatggaagatgactttttatcaacttcgttggatatgaaggctaaaggatagtaatcatgtaaaaaatatatctataaacatatgtaatttagtcagattctttatgaaaagatttggctttttgtatcacattttctttatttttaattgataactttgattctttgcttattttttattttctgtttagtcatagaaagaaaatgataccaagaaagttacatttgacttttacatgcacttcactaatgtaagacttaccctttttctacttcctgagttgtaaataattttctgttgttgaggacatagactggggttataaaagaggaaagaaagatgctcatctatttgagaatctgtttgtctctgatggttttctttttaccctgattagtgccttttggacaaaaagggtttagatgccttgaagagggattgatgagtctctttttcctgaaagcatggtagtttgacagaaaaaagcatttcctaagatgacactttaagaaggtgtgggaagaataaaacaaaataggcttttactaagctgtattctggaccttagagtgagagagcagtgaagttatgcaattgaaaatagcattgcttggtgattttctaaagccatattaactcttttgagccatgatggtagcatagcatttggtaaataacaatcacagtgtacaagtaagtgatagtttgcaaacctgaactgctgtgagcaatttccagatgtcccatttttgttcccaagggggagtttattcagaggaaggtctgatttattggttgaattagaattctaagatatcatgagtcttaatcatttgttctactaaatgtctgttttatacacacccctatcaccacccccagtggggctcctattaagtgtttaaatgtagaattaattactgtctcgagaaattgatgctagctcatattttttattcagctttatatccatcgaaatgcctgaaataaaacaatattccacccaggtgaaacattttgaaaatggcttaaagaatgtatgggctgggcgcagtggctcacatctataatcccagcactttgggaggccgaggcgggtggctcacaaggtcaggagttcgagacaagcctggccaatatggtgaaacccgtctctactaaaagaaaaatcagccaggcgtggtggttggcgcctgtaatcccagctactcgggaggctgaggcaggagaattgcttgaacctgggaagtggaggttgcagtgagccaagatcgcgccactgcactccagtctgggcaacagagcaagactccgtctcaaaaaaaaaaaaaaaaaaaaaaagaagaagaagaatgtatgcatgcatgtgaattggactgtggaatttaaagattttaacacttctctatttggaaagtaaaattcctacccgaaagttaagcgatcttaaaaaagactttaccatcctagagaaaaatgggcgcatgggttggttcgattgtgatgcaagattgtgagaagtgaccacaggactcttgtcatcatcagttgtaaatatttgtgggtatgggttcaaacactaatacattgaagaaatggtgtggcagttctcccccaggtaatactgtcctccgtagttaatgttttcttttcatcactacacagtttattcttaaaaatgctttaagcacatctctctgtactttcatatttttctcttctgctctgtagcaaaatcaccaggacagccaatacaagtggtttatgtaccatcccatctctatcacatggtgtttgaacttttcaaggtttgtaaaatagtattacataacctttaccagtacttttctgaggttaggaatctgctctgaaagccaaatattccactaggttctcctattaagaagtgccatttcacatcagtatcatatcacattgctggagatcagctttttatcaacacagggagacatctccatgtagtggtgagctcagactatggagtcagaaagacctgggtttgaatcccaattatggctcttaatatgtgtgtgaccttgggcaagtcactcaacctctctgagcctcagtttccttttctgtaaaacaagaatactgtccaggattgtttatgactattgggaataacatactaagtgtccagtacagtggcaacgtattacatataggtgctcaatagagttatctttatgtttttataaaacaatatttagaagagtgattctcaacttgctaccctcaaaggaccagaattctttttttggtctggcttttcttgggagggggaggtcatttatattgacttacagggtttctgctgtaatctttgctctttacaacaaaatttgaaaacaaattatgctactaatattgagagtatcttttttccccgccaataatacttgctggttgacaagaaaatgggtgaggagtgaggggcacaggtcctggtgggtgaaaatgattgccctctatcagaagcttgtagtctctcttcagttgtgtttcatcagccagcagcaaactagaggaaagagggggtggctttcaatctgataatgtaaaggaaaagtgcactgaaacacagaaaaactgaccgaatatcttagaacagcagcagaatgttctttcttccaagacagcaaaaatgtatttaataccttacaaaatcttttttaaaatatttattttattttttgtagagttgaggtctcactctgttacccaggctgtccttgaactcctggcctcaagcagtcctgccccagagtgttgggattacaggcataaaccactgcacctagccctaaaatctttttatccaagtagttaaacaagtagtgatgggcacttcaagcattaacacgaattttttccttgaaattccagtggcataaagatcttgtgccctatgattgaggcactccgtattatattgtacataatgtcagtaataatggctttcacctggaacctaatcttaacctgcctttggtggaaatgatggaatctcctccataagaggactcaatcgcaattgctgtgccagggccacacactcttacttccaaattcggatgcctttttagttacatctagtttatatcattttctactgcaatgctgaatgtcatgatattgtttaaggcttctgatatgttggcactgtgtaccctatttcctttagaaattagtcaaagcagctttacaatgacaatacccttaatttcaaactagagataaagggattcattgctccatcaaatacgaccatcgctgttactactatatgaaaaaaattgctttcctttaaagaaatttatgacagttttttaaatagttctaaaaatatagctgaaactacattttcaaaaatgttttgcccatcatttactaaaattataaaagtgtttgaacagagttttctgctttaatgtaactagttaaaagtgttttgaagtctgactttggaaaataagcaaaatttagttggagtctttaggtcagaatatccttcaaatcccccccaaattgactccattaaaaaaaaaactttaaatgtggttataagaattgtgattctttggcatatttccatcaaattttaaaacttcaaatagtgcatatgtacttgaaaattacactttctcttttctaaaaagctgtatttttaatacaaccctaatgtatttcagaatgcaatgagagccactatggaacaccatgccaacagaggtgtttacccccctattcaagttcatgtcacgctgggtaatgaggatttgactgtgaaggtaaatgtgtttaatggtttgttttcttttttttttttttgtaattgatgaacagacatgcaaaggtaaccatacgcataatttctaaaagacataatctactctcaggggaaaagaatcttgtctgtaatagataataagcacattgcttcattgagctggtggattatagttatcccttgagtcttttctatgcaggtcccccgtcgaggtgattcaagttaaaataaatcttggagacagacaatttatcattaatatctctttgataagtaagatctaaaatatttgggtagttgcagtattatggagatagtattttatatataatttaaaaaattttaaaacagtgctttctaatctactggtttcatttgattctcatgacgtaggtaattttatcctcacttttacaggtgtggagactaagacacagtgattagctcaggatcacacagggcagaaatgctatgggacatgatatccagtcttctgtccccagtgctaggccttttctattacattgttcaggtggcccagtttcttcttttacattttattaaaaattgttttctgtcacccaggctggagtgcagtggtgtgatcatcactcactgtgaccttgaactcctgggctcaagcaatcctcctcccatggcttccagagtaactgggactgcaggctgcaggcatgcaagcctggctaattaaaagaattttttggtgggtagagactaggtctcactttgttgcccaggctgatctcaaaacacctggcctcaagtgatcctcccaccttggcctcccaaagcactagtattacaggtgtgagccactgtgcatggctccagtttaagagtatgatagtgtttttcttttttaataatcatttaaaaatttatattaaagtaataaatgcagagactataaaaattcaaatgtgtcagttcctggccctttgtaggcctcattactcagagattcttagtctttctttacttttttttttttttttttttttttttgagatggagtcttgctctgttgccccagggtggaatgcggtagtgtgatctcgcccactgcaacctctgcctcctgagttcaagtgattcacctgcctcagcctcccgagtagctgggataacaggcacccgccaccacgcctagctaattttttgtattttagtagagacagggtttcaccatattggccaggctggtctcgaactcgacctcgtgttatccgcctgcctcggcctcccgaagtgctgggattacaggcatgagctactgcacctggcctaatgtttacattttaaacagtaaatattacctttctgttatagtagttgaggagttagctctctttaatagagcacctgctcccctcccctcccctagcccaagggccagtttccctatactattatcccaatatttaagtttgtatatgaaattcgaagctgagaataatcatcctgcaaaattttgaaggcatccattgttccttttttaaaaaaggtacaattcagtggaattcataaggttattcaagtattgccgctgtctcattttagaacattttcatcagtcctaagaaaaaacccaagtactccgtcaggcacagcagctcatgcctgtaatcccagcactttgggaggccaagttgggcagattgcctgaggtaaggcgtttaagaccagcctggccaacatggtgaaaccccatctctacaaaaaatacaaaaaattagctgggtgtggtggcaggcgcctgtaatcccagctattcaggaggctgaggcacgagaatcgcttgaacccagcagcagagggtgcggtgagccaagattgcaccactgcactccagcctgggtgacagattgagactccatctgaaaaaaagaaaaaaaggaaaatacgcagtacctatgaagtcacttcccgtttttctctcttctagcccttggcaaccactgatctattttctgtttgtgtatttctctttctgggcattttatataaatttaatcatgcagtatgtggtcttttgttactgacttctttcacttagtataatgttatagtatgcatttgtacttcattcctttttatgaccaaatgatattctgttatatggatataacacctttgggttatccattcatcagttgatagacatttggtttgtttctattttttggttattataaataatatggctatgaatgtttgtgtacaaattattgtgtgaacatgtgtttcagttatcttatgtatatacctaggaattgaattgctgaatcataggaaactctgtttaacttgagaaactgccaaactgttttccaaaggacctgcaccattttgcattgtcatcaacaatgtgtgaaggttcctgttttacctcgtccttgtcaacaattgtagtctgtcttttttattatagacattattgtgagtgtgaagtggtatctcagtgtggtttttatttgcatttgtctaatgactatgatgttgagcatcttttcatttgctgatcggccatttgtgtatctttgaagaaatgtagattaagatccttttttcagttttaaaattggctgtcttttattgttgagttgtaacggttctctctcatgtatatgtgtatatatatatagggattctatgtgtgtgtatatatatacacacacatacatatacatatatacatacatatgtgtatatatacgcatatatacatatatgtgtgtgtatatatatacaccctatatatattctatttgtgtgtatatattctatgtgtgtgtatatatatatacactctctctagatatatatatatgtatataggggttactagtccctgatgagatgtatgatttgcaagtatattctcccattccgtgggttcttttcactttcttgatagtatcctttgaagtacaaagttgtgtttttttgttttttgcttttttaaatagagatggggtcttgctatgttgcccaggctggtcttgaactcctgaacttaagcagtcctcccaccttggcctcccacagtgctgggattacaggtgtgagtcaccacacccagccaaagtttttagttttgaaaattttcaatttttttttcacattgcatgtgatttcagttttatgtctaagaaaccattgcctactccaaagtcttgacgacttatgcctatgtttctaagagttttatagttttagcttttatatttaggtcttcgatccattttgagttaagttttgtacatggtttgaggtagaggttcatcttcattcttttgcatgtggatatccagttgtcccagtactatttgtgaaaaacctattctttccccattcaattgccctgtcacccttgtcaaaaatcaattgctcataaatgtatgggatttatttctggattttcagttctatttcattgatgtatatatctctcgttatgcaagtacttaatgcctgtctcaatgattgtagctttaagttttgaaatttgcaagtgtgagtcctacaacttctttttcaagattattttggctgttatgggttcttgcatttccatgggttttaggatcagcttgtcaatttctgcaaaaaaacaatgccagctagaattttgatgggcatcatttgggaagtgttgccatcttagagttaacaatattaactcttctaattcatgaatacaagatatctttacacttacaacacagggcatctttataggtcttctttgctttctttcaataatgttttgtggtttttagtgtacaagtcttggacttttaaatttattcctaagtattttattatttttgatgctattgtaatggaattgttctattaattccattttttggattgcttattgctagtggataggaatataactgatttttttgtactgatcttgtatcctgcatccttgccaaatgtctttattagtgctagtaaatttttgtggattacttagaattttctatataaatgatcatgtctctgcaaaaagatgtaagtgtggctagaacctctagtacagtgttgaatagaagtgctgacaggagacatccttgtcttttttctgatactaagggggagaacttcttgtctttcactattaagtatgatgttagctctgatttttttcatagataccctttatcagattgaggaaatttgcctgtattcttagtttgagtgtttttatcatgaaaggatgttcaattttgtcaagtgctttttctgtgaagattgaaatgattgtgtggtttgttctttgttctattaagtagtgtattacattgctttttctatatcaaaccaaccttgcattcttgggataagtctcaatttttttatggtttatgttgttttgttgaggatttttacgttgatgttcataaggtatgtttattggtctgtagtttcttgtgatgtgtttggttttagtatcaggatgacactggccttatagaatgagtagggaatttccctctctttctacattttggaagagtttttgaaggattggtattaattctttcagtgtttggtagaacacagcagtgaagacttctgggcctgagcttgtctttgtggaaagacttttgattactagttcaatctctatttgttatatattcatatttatggatagctatttataaatataaataataggccaggcacggtggcttaacgcttgtaatctcagcactttgggaagccaaggcaggtggatcacctgaggtcaggagtttgagactagcctggccaacatggcaaaactccatctctactaaaaatacaaaaattagccaggcacggtggtgcgtgcctgtaatcccagctactcgagaagctgaggcaggagaatcacttgaatccgggaggcagaggttgcagtaagctaagattgtgccattgctttctagcctgggtgacagatcaagactctttgtctcaaataataataattaaataaataaatataaacaatacatttgatatctatttagattgtccatttcttcctgagctcctgagctgtgtctatagtttgtgtgtgtttttttgtttgttttttgagacagagtcttgctctgtcgcccaggctggagtgcagtggcaggatcttggctcactacaagctccgcctcccgagttcacgccattctcctgcctcagcctcccgagtagctaggactgcaggcacccgccaccatgcctggctaatttttgtatttttagtagagatggggtttcaccgtgttagccaggatggtttcgatctcctgacctcgtgatccacctgcctcagcctcccaaagttctgggattacaggcatgagccaccacgcccagcctatagtttgtgtttttataggaatttgtccatttcatttaggttatctaattattacacacaattgttcatagtattccctaataattctttttatttttgtaagattggtagtgatgtccccactttcattcctggttttataaatttgagtcttctttttttttcttggtcaatatagctaaatacttatcaattttgttaatctttctaaagaaccaattttttatttcattgattttctccatttttctattctgtatttcattaattacactctaggctttattataatttccttccttctgcttgctgtggtgttattttgctcctgtttttctagtttcttaaggtggaagttttggttattcatttgagacattttacaactataattttactttaagcactgctttgtctatcttacaagtttttaatgttttgttttcattttcattcatctcaaagtattttctagtttccttttggatttttcccattggttaataggattgtgttgtttaattgccacatacttgtgaatttcccatgtgttctcttaatcatttaaatttcattctgttgtgattggaaacatactttgtatgatttcaagtatacatctattgagatttgttttacagcctaacatagggtctgtcttggagaatgttccatgtgtacttgagaaaagtgtgcattctgatgctgttgaatgttctacagatagctattaggtttagtaggtttgcagtgttgtacaagcttgtctttccttgttgatcttgtaattgttatatccattgttgaaagtggagtattgaagtcatctccaattattgttgaattgtctatttcgcccttcagttccatcagttttgcttcatgtattttggagctctgttgagtacatatatgtttttaattattatctcttttttgtgtattaaccttatatcattaaaaaatgtactattttgtctcttataacagtttttgtttaaaagtatattttgtttgaagttagtgtaaccatcccaactctttttgtttctgttttcatagtgtaactttccagacttttagtttaaacctctttgtgcctttcagtctaaaatgtgtctctttatagcatacagttagaatttaaaaccattctgccaatgtccaccttttaattggaatgttcagatcaattaaatttaatataattactattaatgtaattaacagtaattttggtttatgtttgccgttttgtcttcaatatatgtcatatcattttttattatttctccattatcactgtcttttgttaaaatattttgtattatatcattttaatttcgttcttgtttttgttactatatttctttgagttttttaagtaattatcctggggattacaattaacaccttaatttataatctagttcagattaataccaatttgctttcaatagtatacactgacttttctcctaaataggccttttcccctccccacccatcctttgtgctgttattgtcatataacatacatttttgtacattgtgtgcctgtctacagagatttataattattgttctattcaattgtcttttaaatcagataggacacaaaaagagttacaaacaaaaaatatactcatattttcctttagatttacttttgtaataacttttactggcactgtttatttctaaacatggattcaatgttttgtctagtatccttttgtttcagcctgaaggattccctttggtatttcttgatagcccatgtctgtcagtgatcatctctctcagtttttgcttatctggaaatgtcttaatttctccttcatttttgaaggatagttttgctggttatagaattcttgttgatagtctttttctttcagcactttggaatatgttatctcactgccttccagcctccatggtttggatgagaaatcagctgttacaatcttattgaatattgcacatatgtgatgagtcatttctctgtttctcagactggataatttcaattgacctgtcttcactctcactgattcttttctttcacatgctcaaatatgctgttgaacccctctagtgaaattttcatttcgtttatttttcatttcatttattgtacttctcaattccagaatttcaacttagttctcttatataatatctatcctgtttttttcacctttgctaaatgttgatgcatatcattttattgccctatattttattgttgtatcgtttaaaattttctattttgagacatccttatactttagttctttagtgtttgtttacggagtgtgagtttactgactcaggtatagtttattgactgatttttccttgcctgtgtatgggcaatacttttttgtttttttcatatcttgttatttttatagaaaactggacatttaaaataatatattttgacagctctgcagatcagatactgctgtctccccaaggctgtctttgttgttgttttgtaattttttttttttttggagttaattcttttaagtttgaattctttgttgtgtgtggcttctgaagtctctgctcatttagcttagtggtcagctaatgactggactgagatttcctcaaatacctggaatcagtaagtttcccagtctttgccaagggactctgtgtgtgtatagaagtgttcaggagaatatcttcaacactcagccaggcagttaacaactgtgccttaacctttaggtcctgctcgcatagagcaattagaggtgagagcttagggccttctcagtgtctttcctgagcatgaccctgggcatgagtatggccttccagattcccaggagatagctgaggttttcaaagcccctatggctatctcattccctagaccttcctgttaagctttttggttagccttattgtttgccctagctgttgtccagtttcttctgcagccctcaaattaatcagttacttctaattgtttttgacagatgtttccagggatgggggtggggtgcaagacttttgtactggggagctcagagtcaggtcaaataaatacagtcttcccagcagctaccaggctgctggtttcactctgattgcatattgattggagggagggggagcagatgggagcaagttaaaatgcttactgttcttatacggattcagttgttttacttgaataaatgttccccagattgctgcatgcctttagttaatttccagaattctgtcaaagtagattctaaatgatttttgcacccccctcccccgctctttctttttttttttttttttggtgctttgatagaggagagacttttgcaggttctttctcttctatttttgctgatgtcactcctgctgttctttttgagaagacaacgtttattacaattcctcttccttcttatgtgaccagttttaggtgtctacttttgtttaactagagtttttaacttttttttttttcttttttttaagctgtgctctgaagtttcagtgatgtgacttggtgtgggccttttcttacttactgggctgtggtctttgaacttcccattattttcttgatattttccttttcactgtgtgtttagtctctttctgatagtcatattaagaggatgttgggcttcatgacatcactccctgttttttatcgcttcaactttttattctattctgtgagatttccttgacttcagattcccagcccttctattgaacttttatttccattatcttacaaatttccaagaatccttatttttaaaattaatccctttttagaattctgctctagttttattttattgctctaaggatattatttttttttaattaatttgcctctgtaccctgcattgtccgtttcctgagtttccttttgtccgtttctctctcgtttgttcattttaaagagataggcacaaaaaagtcaataaatggcgatgccatctgtttgctgtaaaaacaatatgaatgtatcacttttttttttttttttttagctcagatgctaatgtgtctattttttggttagttgtgtgtcagctactttcccgttaaggtttacagtcaagaaaagacccattggtcttctggtttggggcttaagttgtgctgcagcatgttctttcttgtacctttttctgcttctattagaagtgctttatttagcattttggtctgcagctgctttctattgctattatccgtcattgcatagatcaaggtttactgagttcttagactctcagaagagattacttctgtgctggtggatgggcttaacctcaggaatctgtctttatgatgtaaagaaaaattcataatgacccagcaatcctactcctatgtctatacctcaaaggattgagaatatttaggcaaaaccttacacacaaatactcatagtggcactattcacaatagtgtacaggtagaaacaacccaaatatctatcagctaatgaatggataaacaaaatgtggtatgtccatacagtggaatattatttggccacaaaaggaatgaaatactgataaatgctacaaactggttgttgtaacattgaagacattatgctaagtgaaagaagccaatcacaaaaggccacatattatatgatattatttacatgaaatgtccagaataggcaaatatatagggacagaaagtagattagtggttgcctagggatatgaccactaaaggagctagggtttcttttggaggtgatgaaaaattctaaaattgacagtggtaatggttgcacatatcgatgaatatattaaaaaccattcaattatatactttaagtgcattaattatatggtatataaattatttttatcttttttgagatggagtctccctctgttgcccaggctggagtgcggtggcatgatctcagcttgctgcaagctccgcctcccaggttcaagcgattctcctgcctcagtccctagtagctgggactacaggcgcctgctaccacacctggctaattcttgtatttttagtagagatggggtttcaccttgttggccaggctggtctcgaactgctgacctcaagtgatccgtctgcctccgcctcccaaagtgctgggattacaggcatgagccactgcgtccagcctgctatgtaaattatatctgaataaagctgtttaaaataaaataggcttgtaaaggtctcaaaaaagagtgttctagaagcctgctatgttaattatatttgaataaagctgtttaaaataaaatagaaaggcttgtaaaggtctcaaaaagactgttctagaagtcctgtctgtattaggctctgccttcacctgttgtttctgctcctcacatccaaggtcacatgaaggcatctcctcttgcagcctctctttacatgttgaattcttgctttttcttcagtcgagctttgatccccattacttaccctagacttttagaatcaaggcttggttttgtttcttccccattttttttagcttgttcaaattattgacattttttaccttttatcctcttgctaaaaatcctatacaaaagttgttgtttctgtcttacagccctagctgctctttcaattctgtgtttagtatataatctataaataacctatgtgttatagccacatgtcttttttttgtgtgtgtgtgtttttttatagatggagtgttattctgttacccaggctggaatgcagtggcagaatctcagctcaccatgacctctctttcccgggttcaagcaattctcctgtctcagcctcccgagtagtggggattacaggcacgcaccaccatacctgactaatttttgtatttttagtagagacagagtttcaccatgttggccaggctggtcttggaactcctgacctcaagtgatctgaccacctcagactcccaaagtgctgggattacaggtatgagccacagcgcctggcctacatgtcatttaaattaaaacttaaatgtcttggttcatttactgttgatgattttacagacttaacagtgaaaacgctgttggctaagaaactttaggaactctgggtgaatacagggaatgtcctggctttagagctgtcatctagtcagtagtggttcatttcatctgggcctagagttcacatgaattaacctagggagcctagtgttactgggaataggaagttagggatggcagctcttggttagatgacattgacaagtggtgcttttgtgcactgaagagaaaactttaaaaataattggcaaacttctcttccttggccttcctgttgacattacttatctcattatcttaataaggtttcgtgttagttttcacatctctctttcaatacatttgtcatcaaaggtaccattcttcttgccttgaatatatacagactaaatatctgtctctccattattccctccctcccttttcctgaagaacttggatcctccaataatctattactgctcttttggaaactcttttgcctactttaaaatccactggctccagtttattgtattgttggctgcaaagcaaagtactactttgactgtagtttctaactctattcctgtggcttagtttgccctttacctctagcaacatgatgcttctcacatcctctctgtcctgtctgcttatcccctcttattttcccatgcagcctgaggctggaaatgacttcttattttgtacttgctaggttgttgttacagtctccgtggccaaaaggttaaggaaaaccaggaaatatttactcaagtctacctttttatcttagtatctattctaatatgttctttactcccttcatgtatttatagaatacacatacttcctattcatgttaactagcaaatgtgcagcagagcattgaattaaaggatgagtaattaacaaattgatggatttctcaaaatacccagagctctttattcatcttactaaaataaattactttacagggccaagagcaatttcaagcataatgctgcataaaagttttctggtttttttttttttttttttttttttttttttactgagcagagtctcgctctgtcacccaggctagagtgcagtggtacaaccttggctcactgcaacctcctcctggattcaagagattcttgtgcctcagcctcccgagtagctgagattacaggcgtgcaccatgacgcctgactaatttttgtatttttagtagagacagggttttgccatgttggccaggctggtctcgaactgctgacctcaagtgattcgccggccttgcctcccaaagtgctgggtttataggtgtaagccaccacacccagccacaagttcctaataaagtccttgtatactttattattgatagtgtaattacttaattttagatgtattcgaggcacatctttcaatggtatttcaaggcagatttttttagttataaaaatcaaaatatctacataattaccattataaaggtaatatatatatactgtaacaatttttaaatatataaaaactcaactataagccattcagcctattgacttttaatacatattattcagtactattttaatctatatatacataaattaaaagcagatttgtttgtgtatgacaactatattgttataggcagtaaaatcaattcagattctgtgacaaaggaaaatggctgtagtagattagaatataagctggatagtagctaggaaaataagtccatgttaactttgaaggaaaagaaaaattgtatgtaaataaattactaaatttgatttgccatactgtttgagttgaaaaatgatatgaaaatgtaaagacctacatgccttacgaacatatcagaaagttttctggggttctaggctgtaaaattgctggtagatggaaatacaaagtagtggttctgtctttttctccctgaaaatgaaaattatactgtttttttcctgttaaagtaattgtgaagaaaattcagaaactgaaaaccccaaacaagaagagaaaattactcattctacagacaataaaattagatatcatttcagacctttttataatagaatttttgcagagtattataaatgcttctttgtaactgttttttttttgtttgttggttggttttttttgctgcttaactatctcttatgccagtatatggagttctatataatatctaattaatggttaacaatattctattttagaatgtactttcttttacttaactaatcccctatttaggttgtttacttttaggtattctgcatagagctgtgatggatgttctcatatatactttgcatgcttttctgcttattttctcaggataaatttctggaagtgacattgttgtgtgaaaggtacatgcttttttttttttttttttttttaaatagaggcagggttttattctgtcacccaggttggagtacagtggtgagatcatagctcactacagcctcgaactcctgggctgaagtgatcctcctgcctcagcctcccaagtagttggggattacaggcatgcactaccacatctgggtaattttaaagttttttttttttttttttttgtacaaacggagtctcactatactgcccaggctggtctggaactgctgggcccaagtgatccccctgttatggcctcccaaagtgttgggattatatgtgtgagccaccagacccacccaatatatgcttttctttttttgtttgtttttgttttcttaatttagagacagtggctccctctgtcactcaggctggagtacagtggtgccatcatacctcactatagcctccacctcctgggctcaagtgatactccttcctcagcctcccaagtagctgggatcacagttgtatgccaccatgcccagctaattttagaaaattttttgtagcgatggggtcttactctgttgtgcaggctgatctcaaactcctggcttcaagtgattctcttgtctcagtcacccaaagtgttgagatcacaagcgtgaatcaccatgcccagcctagtacatgcatttttaatttttttttttttttttttttttttttgagaaggagtcttgctctgtcacccacgctggagtgcagtggtacgatcttggctcactgtgacctccatctcctgggttcaagcaattgttctgcctcagcctcccaagtagctgggactacaggcatgtgccaccacacctggctaattgttatatttttagtagagatggggtttcgctgtgtgggccaaactggtcttgaactcctgacctcaagtgattcacccatctctgccttccaaagtgctgggattacaggtgtgcatgtttaatttgcttctagtcaccatgctgcccaccagaaaggagtaacagatttatagttacatacaagatagggttaacttgtgcccagttctgtgctataatgcactgttaatgagactcccggaaatatacaaagccacagcagtattatgatggagtttatgtattagagtttcacatattagaggagttgggttgggttcaacagcgagggaaatgcttatattggcaacttggattgtgttgtattcattttcaaaagcagcactcaggctgggtgcggtggctcatgcctataatcccagcactttgggaggccaagacaggcagatcatgaggtcaggagaacgagaccattctggctaacatggtgaaaccctgcctctactaaaaaaaattagccgggcatggtggcaggcgcctgtagtcccagttactcgggaggctgaggcaggagaatggcatgaacccgggaagcagaggttgcagtgagctgaggtcgcaccactgcactccagcctgggcgacaaagcgagactctgtctcaaaaaaaaaaaaaaaaagcgctctcccaccagcagttaaactgtgatgctatgagtatgtgttgatattttgctgttttgaggatttgggcatagagcacgatccttttcttaccttagatgagtgaccgaggaggtggcgttcctttgaggaaaattgacagacttttcaactacatgtattcaactgcaccaagacctcgtgttgagacctcccgcgcagtgcctctggtatgttatcaagaaataatgaagtgtgtttctgtgaattgccttccacatgctgtagctgccaaataagtaagttaagccgtcatgtagggtactccacaaggaagaaagaagctcttagaaatgcacactttcccctaaatttaaacagccttcagaatacttttttttttttccaactgaaatgggcacgagacagagatttggagttcttgttacaaagtttgatcgtgatatagcagtagttttcctgtgtaaaaccacattttgaaatatggttaaccacattatttctaatgtggggaataaattactggttttagtagtgtttggtcaacactgaattactttttagtgttgacttttttctcaagtacttgtcattagaatgatctcatatcctagactgaaaaataagactaaaattctaatctgttcaatcaccaacctgaaggcttaaattataattgctttgatggtgttttgttaatcttagttccacctattttcaggtttaataggatcaacttttgaattgactccatccttatctttatgttctaactcccccacaaaaagtatgttgccaaaattttgtctgtaattctagaagaactctattcttctaggcttggaaacttctctgacatttccagtagagttatgctgtaacatgatgggggtatagtacaagatagatctattttagaccccttcctaggaagttactaggactttattctgatagttttgtgtccggaattggtgggtttttggtcttgctgacttcaagaatgaagctgcggaccctcgcagtgttacagttcttaaagatggtgtatccagagttacttcagatgttcagatgtgtctggagtttcttcctcccggtgagttcctggttttgctggcttcaggagtgaagctgcagaccttcacggagagtgttacagctcataaaggcagggcgtctggagttgtttgttcctctcagtgggttcgtggtcttgctggcttcaggagtgaagctgcagacctttgtggtgagtgttgcagctcataaaggtggcacgtccagagttgtttgttcttctgggtgggttcgtggtctcggtggcttcaggagtgaagctgcagaccttcgcggtgagtgttacagctcataaaggtagtgtggacccaaagagtgagcagcagcaagatttattgtgaagagcaaaagaacaaagcttctacagcctggaagggtaccagagtggcttgccgctgctggctgtgggggcctgcttttattcacttatctggccccacccacatcctgctgattggtctattttatagagagctgattggtccattttacagagagctgattggtgtgtttttacagagtgctgattggtgtgtttacaaacctttagctagctagacacagagtgctgattggtgcatttacaatcctttagctagatacaaaagttctccaagtccccacccgattagctagacgaagagcgccaattggtgcatttacaatcctttagctagacacagagtgctgattggtatgtttacgatcctttagctagacagaaaagttctccaagtccccacccgacccagaagcccagtccagctggtttcacctctcagttttgcctgatgcatagcacaaatgctatggctgcagctgtactatagttgaaatgcttgctctagtaatgtccttctccaattcagatacatgccctccaggagttggcatccatatgtcaaggggcagacagacaatgtcaaatgataaacatgagcatctttttacaagtctagttttatcctaaaaagtagagggatagaagggagctgctgtttttgtagtaaacgaatattgtagaatttttatggagagcggcatagtgagctagtccagactctggatctaaactctttggttctgtttctgatactgctgcatcttagatgtgcagccttgggaaaattattgacctctggatgccacagattccccacttagaaaaatggagttattgtgagaattaagtgagttgatacatgtaaaaatgctctttatggtgcctggctcatggtaaatgccatgtaagtgtgtgttattttaggatgtaaaatgtatgtgaatttttaagaaaataggaggcttgacctggaacaggctcctccatacatctacatgcccttaacaaggctaagactgttactaatttcttgcagagcctcctttctgctgacatcgctttgtagatggtcccagtcagcaggcagtagggtagctggagaaaggccagctgatgcccacaggagtggctttcttgtctacctggttacggagggcttcctccctgtggataccttcttgtgggtctttgcatggataggctatcttcacactgtaagtccggagaggaacatccacacatctctgttccagacctccttctcatccttcactcagttttgttctttccaagtccttaacaagccagccacttgttttgccactgcccatgctggaagggtttactttcactgctgtctttcaggcctgccctccaaccttgagagggattgtagtaggaaaacggcagcttactttcagatggtgatagcacatggggtagatccaccagtggactaggcccatgttgtttttcttccctgttaactggttataggggaagccctatgagtcagcccataagtatggtcaagagagagcacgtggtaaagtaggtcaggtatcatgggagcctgaaccacctgctcatacagttttcttcgggccacttctaagaccagttaatgtatcgctcagagtcacaacaggaaagaggtagctcactcaaattatgaaagaaggcctttttacaaagaaactaattacataggtgtaggtaaagatagcacaggaacccagggctagcagcagcaaagctatcaccaccttggatcatgagggatgaggagaaggcaaagttagcagaacccagaggaagggaaagctgcagagtagctgcttactctccaggggcccggcctgcccaaggcaacctcagggaaggaaccaggggagtaaatacccaccttgacttcctctgaactcctgctgggttttccaagacatgctgtaagcagagggcatgggaatccagtgacaatccaggttagcctcccagggcagggaggtgtgaaatggaatagttgatttgtacgggcaaacagagactctgggtagaaaagtcaagttatagttggtggagttaggtaaagctggagcctgggtttgtgaatagcactctgattcttgagtccatacaagctcatagttagcatgctatatggaatgtcatcaaacatatgacttggtaataaaaaccattttcccatttatccagatgttttgttttgtattaaggaattggtaggatttatccagataaagaggctattctggatactgggaccaaaatgaacagacacggaatgatatgtttaaggaacttaagagcaagaggtgtagttgtgctggactggaaagtgggaggcagagacctgatcttaccaggtctagaaagctctttttagaagcttaggttttgatttctaagacagtggggtaggggtggtgggagtgctggtatgttttgaagatttttaagtggaaaagtgacccgtcagtgagaattaagaaagtagatctatattagagatatctccaggctcagaatgtggctggaaatttatgatattaagtcatgagatatatctattaggctgcaacaagccattttctactcttgctcctaaaagagataacacattttatatgatattgccaagagcagtattgagataccatatccggaattggtttcttctggtaggttcttggtcttgctgactttgagaatgaagctgcggaccctcatggtgagtgttacagtttttaaagatggtgtgtctggagtttgttccttcagatgtttagatgtgtccagagtttctttcttcggtgggtttgtggtcttgcttgacctcaggagtgaagccacagaccttcgcagtgagtgttacagctcttaaaggtggcatgtctggagttgtttgttcctcctggtgggttcatggtctcgctgacttcaggagtgaagctgcagaccttcgtggtgagtgttacggctcataaagatagtgcagacccaaagagtgagcagcagtaagatttattgtgaagagtgaaagaacaaagtttccgcagtgtggaaggggacccgagcgggttgccactgctggctggggtggccagcttttattcccttatttggccccacccatgtcctgctgattggtccattttacagagtgctgattggtgtgtttacaaacctttagctagacacagagtgctgattggtgcatttacaatcctttagctagacagaaaagttctccaagtccccacccgacccagaagcccaactggcttcacctctccatcccccctctaaacagtataccccaactgttgttgggaattgggcgatgaccgctgtagctacttcttgctggataggggcaaagaaggggccctgcagttgtagtgtcctccagaggggaactctttaggccagtgaaagggccagcgggtcagtccaggggtccttgatagaagttgttagttgagttcatttgggattccatttgtaagaccatctatagcttgatggccttgattctagaggaaacaaatttgacaaggaggttaaaaatacagggtccgaaggtgagtaatagcaagatggctgtcacaggacctagaaaggggagaagccatgttgcccaactccagaggttggtataagagtttgaaaggtgttgtctgatttcggaagacttttcctgtaaacgccgggcggcatctcatactatccctgactggttagtgtaaaaacaacattcttctcctaagaaggtgcagagtcctccattctcagcagtgaggaggtttaggccttggcggttttggagagtcactgctgccaaagagtctatttgggattgtagagtaaggatagatttcgttatttcttgcaaactgtctaagaaatcctttgagagtgtttggtagtaggataatgaagtagataaactggctgttccggttcctgtagcagtggccatttctaactctgtaagtaggggtattagttgtatggccctgcgctgatggacttgagctttgaggggcactgatagggtctgatttccataagattagaagttaagataataaatgttacactgttaacttttagcaaactttacttttgttgaaaaccttgtaagtttggaatttcaattattccttgctattaataagacctcgttcagtccatattaacttaaaattggtatagatggctccttcctgattctgtaagtactttaaggtttggctgagtgcaaacagctcgcatatttgagcagaccaattattaggcaattttcctaactctgcttctacaatagtttccttattacttactgagtacccattgtgtctttttcccttaatcgcctgggaggaaacatctattgtcctgtcctgaagggagttcctcctgtgtctggtcggaccttcagatttagatcccctgttaggaaacctgctgggttaaggatttttgataggaaagctacgggttgtcagtggtctcagtgcttccgggctatgcccttgtttacactgacaacaaggtggtattggagtgttatagggttacagagaagaccttcaattatcagttataggttttaaatttaccctggcttttgaaggaatagggtacactgttttttctttactacttctatctctctttctctttgacttctttgcctctctctttctgactcctctttgtctcttcctctctctgactttttgtgtctctctttctctctctctctgactccctctttgtccctgtctcttcctctctctgtctctgactttgtctctttctttctttctctctgactccctctttgtctctctcttcctctgtctctctctctgactttctgtctctttctctctttcctttctgctggtctttccctgcctctgccagctgcttatgctgctcttctcccctctcctggagaagtccgcagaccaagaacccactggaaggaaccaattccagacacaatacgaccgagcaggccagcaaggaaaagcaatatgctttttcgagaccaaccacaagtcattttatagaaagaataaagagttttaaatgaccagagggaagtcagctgatacagtactcaagtaaacctcagcttaatcattgtcaatgcttaaatattaattatattaaatataatgcatctctcagatgcgggctctgatagccccgtggtactcaatggcatctatcttaattagaaaagtatttcagtgtgtgtctttctgaatagaattttgtttttctcatcaaacaggctggttttggttatggattgcccatatcacgtctttacgcacaatacttccaaggagacctgaagctgtattccctagagggttacgggacagatgcagttatctacattaaggtaatagctgtagtcttcttgatttaatatttcttttgatgataagaacagatgtccatacttaactgtaatgaaatttaactctaccacatgctgtttaaatagaaaaaaactatggttttttgctggggatctcacccattttgatagatgatcccctaaaactatggggaaagagatttgtatcctggagtgattaggactctgtctattaataggaaaaaaattgggttaaagtagagaatcataagttatatatcatacaagtttaattttaacataaaacacatgaatggacattgataacgccaaacttttgatgtactgccaaggctttttttttgtatatgggtctgcagattggagtgtcacattgtcttttttgcaaaagctgtactgacagtgcatcattttagtttctttaaaccaacaagtgcatactctttttggacttttatgcagtcctttacagatacctcctgactgatttgacagcaagttttatgtgactttccttcatgagtctttccaaaacattcatcttagttttcaaggaaacattcccctttttattctttgcttatgtaataaattttgtaattatcatgacagaattgtacaaacagatttgggaacaagcacaagtgactcttggtaagcatatagcttacctaatggacacagaagcacttagtctgcttgcctggagtgttcaatgcattaaggagggttccacacattttacatggtggaaaaacactaggttccatcattccccttcttcggctaactggtggctgtttatgcctgatttagtgactctagtttcttgttctggccactagatggcatctattttataggaaatgttgaagaatttatattggaaaaaatatctgaaaagactaaattctttctagatggtattttttgtttttttaaccatgtcaattgcgagggaaaagggcaacatcaatgcaatgtttttcttttttttttttttttgagacggagtcttgctctgtgtcacgtaagctggagtgcaatggcatgatctcggctcactgcaacctccgcctcccgggttcaagctgttctcctgcctcagccttccgaatagctgggattacaggcgcctgactaattttgtatttttagtagagatggggtttgaccacgctggctaggctgatctcgaactcctgacctcaggtgatccgcttgccttggcctcccaaagtgctgggattacaggcatgagccaccacacctggcctagtgcaatgtttttatgacaaaatgtaacattttgatctagcccaggagtgtccaatcttatggcttccctgggccacagtggaagaacagctgtcttgtgccacacataaaatacactaatgatagctgatgagcttaaaaaagattgcacaaaaaaaaatctcataatgttttaagaaagtttacaaatgtgttgagcttcattcaaagccatcctgggccgcatgcagcctgtgggctgtggattggacaagcttgatctagcctgtagatcaagaaattctggaatatttagagaaatatggaggtgaaaggttttttgttctaccttagggaaaatagaagataagaagtcttagagaatcattaaaattgtcaacatcaaagactttagcattatcagaatgagattttcttgttcagggtgttctgcatcttaggaaatgcctttggcctgggatggaaatactactgaaaaatcctaacttgaagaagataactagaaatgtagtttatctcaggttccagtgacttataggaagctgaaatacaatggagaattactggtaataatatatggaaaactgaaatcatgcatgatgcagaaatcttgtgcacagtgactgaaattggaggccggagaagacacagattcaaacccagggccaataaatgttcacgaaaaagctaagatgccttagacatagatttctatttattaataatgttataatgagtttttaaatttttatgtatttatagagtcaatatcttgctttgttgccaggccggagtgcagtggtacaatcataattcactacagccttgaacccctgggcttcaagtgatcctcctctctcagtctcccaagtagttaggactacacccatgtgccaccatgtccagctgatatttttattttttgtagagacaggatcttgctatgttgcccaggctggtctccaactcctgagctcaagcaatcttcctgtgtaagcctcccaaagcactgggattataggcataagccaccgtgcctggcttgtgatgagttttttttaaagcacagtgactatgctgaaaaaaacactatttcttctagtaaataattaaaatagagttcattaaatttatgtgcatctattaagatacatatatcgatttgtatgcttttacatttaaccaacttcttcagttagccaactctgatctgggtcatgttttgtgtaaaatttcagtccagcagcttccaggatggctggggaattactgtaagcaacaaactcagtcaacctgcacatcagtcagtgccatagatttcataaataacacgtttcaaatatacataccatttaaaagtatatttaggtggtataaggattaataagatactaatagaatattatttaatttgtcgtaacctttttgccattgtctattttctcaaataatgaattctaaaaaatgccagacttaataggtcttaggtttttctttttcaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaa

SEQ ID NO: 36881 - DNA, 895651 bp, Homo sapiens; identical to SEQ ID NO: 36080

SEQ ID NO: 36882 - DNA, 80049 bp, Homo sapiens; identical to SEQ ID NO: 36570

SEQ ID NO: 36883 - DNA, 25304 bp, Homo sapiens
ccctaacgacagctcgcccgtgcttcgccctcgcagctctcctgtgtccccaaaatgcctttcccgcgtcccccgcccttcagcggtgactgcccaggggactctgtaacgcgacactcagactgccgagcctgccaggcacttcgcggagggcgctaggggccgggacgcggccgccgagcgtaggttccggcctttactccgagttgcgcacggagccccagctgcggttgtccgctctggggatcacaggccgcggagacccgggagccacccgccgggccccttcagacgacccgcttccgcaaaccggccgtgggactccggcgccgggcggacgaagcggctccgggaagactcggtcttccccgcccgcctgaggtcgccggggcggggcttcagtgacaggcccgcgcgctaccgcggaaacaggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttgtatgtattcttgcgcccgtgtgacaacatttaaacttctaaaaacggaacctccttccgtgttaggattgcaagttaacctaggaaaaacagcattctgcaaattatttgctggaaaatctcggtgacttaaggcccatgtattactttgcaggggtctctcactctagtttgctggtgtagattttttaaaaaatccatcttatcaaaaaataccgtttaaggtggaaaatttcaaatgcaagtcgcagttgatgagattgcaattaatatatttaagatagtgaattagagaaaaactacaggtcagtgcatattaagtatttttttcatattttggggggattagatttttaacgataactttgaagttaaaaattaaaagataggctgggtgccgttgcttaggcctgtaattccagcactctgggacgctgaagtgggaggatggcttgatcccagagatgcgagaccagcctgggcaacatagcaagtcccccgcccccaccataacaacaaaagtaccaaaaaaaaaaaaaaaaaaagccaggtgtagtggcacgcacctgaagtccctgctactcgagaagttgtgggggaaaggatcgcttcagcgcaggagtttggggctgcagcgagctgtgacgcagcctgcggttgacaaaaagtcaaaactctataaaatatttgaagggattaattctgagccaaatatgagtgaccatggctggtgacacagccatttggagaccctgagaacgcgtacgcaaggtggtcggggcccagtgtggttttatgcattttaggggagccatgagtcatcagtcaaatacatgtaagattaagatgtacattggttcggtccataaaggtatgacagctgaggaggtgggtgggtcgggggtttccgggttataggtagattgaaaattttctgattggcatttggttgaaagatttattatcaatggaaaggaatgtttgggttacaataagaggctgtggagactgaagttttatcatgcagatgaagcctccaggtaagttaagtgtccagcatgttaaatgctggtctgcttttcctgaattctaaaagggaggaggatgaaatgtgtcaagttccacccccacttcccatcatggcctaaacaagttttgcttaaaacaacctaaaacaaggttaactctggaatgcccttggtggggtccatgcagatggttgaggggtcttaggatttcatttttgatttacaatgggcggtggagtgagaccctatctctaaaaataaataaataaataaatacaaattgaaaagttcaaagataaattttttttttttttttttgagacggagtttcgctcttgttgcccaggctggagtgcaatggcgcgatctcggctcactacaacctccgcctcccgcattcaagcgattctcctgcctcagcctcccgagtagctgggattacaggcatgtgccactaccctggctgattttgtatttttagtagagacggggtttctccatgttggtcaggctggtcttgaactcccgacctcaggtgatcacccacctcggcctctcaaagtgctgggattacaggcatgagccactgcgcccagcctaaagataaaatatttggctcccaattatggcttgcagtgattattcacacatgttgggcagaaatgttttatataatttatatataaatacaggtattttatattgtaattcaagataggtattcttggccactaacccaatgtcttgtttctttagcttctcagcttcttttttactttcaaagttggtcaggtttcctgttaatagttaactaaatgaaagctcactcactgacaaaacacacatttttggtttcatttcagataaatgaattctgattttggggagcagatgccaacttagagcctcgtaccaatctctctgtctttaaaagatgaggtgacttggtgattttcctggaaaattataggtaatatataatctagcttccatattttacggatatgtctggaggtaccagagaggtgcatctctgcctttccatcctaggccagcctgaactgtcttgtggaagctgtacactgttcctgctgggttatcgtttgatgatcttaataagactgataaattgaacttgggagtgaaaacagtaacactttaagaaattttgaattttaaggctgaggactaggctctgattttttttctatcctcacagaagcactgaggtggacactgcgggttgtgaggttcaggaggggtaagtggctggcacaaggtcacagagcagcgctgccatttggctactttccaattcagcatagctgccctctctgctggtggtattcacagcatgcaagataaaatactcaccaaggaacaagtggctaactcctcacagagctctcacggtttcctctttcctgacaaaaaggtagggctcaccggggtgggggtgtctgcagagctcccaggtgctggtggtcagcaggtttccttcagctgagtcagaaaatggggaggcagaaaatgaggaggctggggtaaggtttggcccagcaagtgagtgaaacaagtcaatttatacccttgggaagcaagccgtccggtaggagtgaagcctcattacctaatgctggtgccatttctggggagagaaggaatctcttcccccaccctatcaggcctacaagttattctgtcttcatttcaggtaggaaaagagggcatgttttggccataacattgaagacaaccttgggaatgctaattcaatgagtctttggtagaggaagaaaaggaatttcccaagatttgagcaaaaggtgttttttgttgtttttttttgttttgttttgttttgttttgagacagtctccctctgtcgcccagactggagtgcagtggcccaatctctgctcattgcaagctctgcctcccaggttcaactgattttcctgcctcagcctcctgagtagctgggattacaggtgtgcactactacactaggctaatttttgtatttttagtagagacggggttttgccatgttggccaggatggtcttgaactcctggcctcaagtgatctccctgcctccacctcccaaagtgctgggattacagggtgtgagccacctgcccagaaggtgttctgtttaaggatctgctgtcaaaagttttctaaataggtttttgttctgttatctttttttttcttctttttttttgagatggagtctcgctctgtcgcctaggctggagtgctatggtgaaatctcggctcactgcaacctccgcctcctgggttcaagtgattcttgtgcctcaacctcccaagtagctgagattacacgctcactcaaccacacccggctaatttttgtattaaatatatttagtagagatggggtttcaccatgttggctaggctggtcttgaactcctggcctcaaatggtccacctgcctttgtctcccaaagtgctgggattacaggcatgagccaccatgccccgcacagccactcttatcttttaaaaaatgatcatgttgggctgggcgcagtggctcatgtctgtaatcccagtattttgggaggccgaggccagtggatcacttgagcctaggagtttgccaccagcctaagcgacatggtgaaaccctgtctctacaaaaaatgcaaaaattggtggggcgtggtggcacacactcacctgtaatcccagctgctccagaggctgaagtgggaggatagcttgagtccaggaggcggaggttgcactgagctgggatcacactactgtactccagcgtgggtgacagggcgagaccttgtctcaaaaaaaaataaataaataaataaaaaagattatgttataccagatagctgcttcacatggttattagggtcttctcaggaaaatatgtaacagtgccagccagcttgcttgctctctttctctgtcctgtttgctcccccatccccttctgctcttctctccttttctactgtcctccttccttctttccttccaagtcttcctctggttgaatggctctgtgtaggatattttaaattcatttttggaaaaaagaatgttaggggtagaaggtatttgatttacaagtggcaaatccatacagatctgcagcaacctcaattcttgcctgctcagaaaaaaataattccactgaggggcataaggcagaaaaagagactgaggcaagtttctgagcaggagtgaaagttattaaaaagctttagagcaggaaagaaagaaaagtacatttggaagagacccaagagggcaatgtgaaggtcaagtgcagtgttttttgtttttgtttttgtttttttgtttttttgagacggagtctcgctctgtcccccaggctggagtgcaatggcgcgatctcggttcactgcaagctccgcctcctgggttcacgccattctcctgcctcagcctcctgagtagctgggactataggcacctgcaaccacgcccggctaattttttgtatttttagtagagatggggtttcactgtgttagccaggatggtctcgatctcctaaccttgtgatccgcccgcctcggcctcccaaagtgctgggattacaggcgtgagccaccgtgcccagccaagtgcagtgtttaaccgtaatcctaggactttataggctgacccacttctggcgtcttgcacccctcccttctccatgattcatcccttagggtgggctgcctgcatgcacagtgcccttcttaagcttgggaggtgagcatgagcagtgtgtttaggaagttgtacgcatgcccatctgtggctttctttttcctgtggagtgcccccagaaggtcatactctgccattttgtctcctgatgtgtatgcccaggaagttgcccctctctggcatctgcatttaattaacactttaatgtggcagctgtggaccctcaggagattgtctctccttggcgctggctgctaaatgatcgtttttagagaggcaatatgttaactgttgaatgggcacctggtgatcacctgacattcctggtaggtgggaagagccctcacctgccccgctcatgcctgcctatctgtaacaagaacacagaagtttgagggaagcgccagaactcccctctaacccggtttgtttgcagtaaggtcgcttatctgcaaggagtaagaggccatgctgagtgagctcagtggggagttggggcagggagagcccaggttgcctggaagtgcaaacccacaggctgtctctatgtcctctgtcctgctctcttcatccagggaagctggaggactgcagttttgcatcctatcctgccctgagcctcactttgggctgtcagccagccttgtctccagcctgctcaccactcactgatgctttttgcgcctcttagtcataactgctcaaacaaggctcactctgatgaagagaagggggtgtagaagaggaattatcaaggtgtcattctggtatttcatcttgggaaaccagaaacctaccaaacagcaagggtttgcatactggaagactcctcagcctgccccagaaggtcagcattccttccctctcaactagttctgtacagctggaggaaacataaggtgttagaaagtttcagctatggttttgggtttagcttttaggattttaggagattctaggccttttgaaagaaaaatgagatagtaagatcgaatggctgcctttgacatatttgatttaatcacaacaaaggaaattgcctggcgttaaggaacctgttatttatccctcagaggctctccagcagagaacccaggcccttcaccatactggtgcatggttcctgccacttgtgcagtccattccgaagtttcttacagatgaggtgggtgactgcaaacaggcactgctgcttctcctctatgtcagagtaagcacaggcagcacagggtggctgcacatcctgagttgtctgggacagtcctggtttacaccattgccctgttttaatttttattagtgatatttttcactcaaagctgtccccagttggaagataaaggtatgttgtgactgcgattatgcggcatgtgtggtttgccttagagaaaagagaggtgacaaaagttctaagtgaagaagataaagtacagcttgaccagctgataaagatgttgtggggttttggaggagaatttcagcaagagcagttgactccagatgatatgcaaggctgcttttgacctctctgtctgaaaggacatagttaaaatccagtatttgtttgccgttccccctttatttatttattttgagatggagtctcactctgttgcccagggtggagtgcagtggcacgatctcggctcactgcaacctccacctcctggattcaagcgattctcctgcctcagcctccctagtagctgggattacaggcatgcaccaccacacctgcctaatttttgtatttagtggagatgaggtttcaccacattggccaggttggtcttgaactcctgacctcaggtgatccacctgccttggcctcccaaagtgctgggattacggctgtgagccactgtgccaggccagctgttcccttttaaattaagtacttagtctgggcacagtggctcacgcctgtaatcctagtactttgggaggccgaggcgggtggatcacctgaggccaggagttcgataccagtctggccaatgtggtgaaactccatctctactaataatatgaaaattaactgggtgtggtggtacacatctgtagtctcagctacttgggaggctcaggtaggaggattgcttgagcccaggaggtggaggttgtagtgagctgagagcacaccactgcactccagcctgggtgatgggagagaaactctgtctcaaaaaaataaaaataaataaataaataaatcaagagttaatataggtaatgccattctaatgaaacagaggaatgacagtccccaatggaagggccgtccatttcaccattgcctaccctttcatcttctgaaaagccagaaatagtaatgaatacttaatagtaccacatacccattgccaatgctccattagaatacttatgagaagatttcttcatttatcagtttctgaaggtattgccaatttttccgttaggttttaaacttttgataatggctcaaagtacattttcacacctatttatttttctttttctcttactttttttttttttttaatgagacggagtcttgctctgtcgcccaggctggagtgcagtggcgcaatctcggctcactgcaggctttgcctcctgggttcacgccattctcctgcctcatcctcccgagtagctgggactacaggcgtctgccaccacgcctggctaattttttgtatttttagtagagatggggtttcaccgtgttagccaggatggtctcgatctcctgacctcgtgatctgcccaccttggcctcccaaagtgctgggattacaggtgtgagccactgtgcctggcttatttttctttaggtaaggtttaaaggttttccacatcttaatggttgcttatagacaccagtgtaaaacaagctagggactcttatagggaatgggggttattttattttatttttttgagatggagttttgctcttgttacccagtctggagtgcaatggcatgatctcagctcactgcaacctccaggtcctgggtttaagtgattcttctgcctcagcctcccgcgtagatgggactacagacgcccaccaccacgcccagctaattttttttttgagacggagtctttctctgtcaccgaggctgcagtgcaatggcgtgatcttggcccactgcaacctccgcctcccaggttcaagagattctcttgccctcagcctcctgagtagctaggattacaggtgcacaccatcaccctggctaatttttgtacttttagtagagatggggttttgccaggttggccaggctagtctcgaactcctgacctcaggtgatccgcccaccttggcctcccaaagtgctggattacaggcttgagccactgtgcccagcctaatttttgtatttttagtagagacagggtttcaccatgtgggccaggctggtctcgaactcctgatgtcaggtgatccacccgcctcggcctcccaaactgctgggattacaggggtgagccactgcacccagccaggaatgggggttattcttaatttccctatgcaaatgtagagttctgaggatgcatttcacagaggtgattttagaccctggggaaatgaggtggttcttgactccatgcctacgtgtgacatgaagttcctagattcatgttagaaaatcatcttcctagaaagggactttatttttttattggttcagttagggtctctggtcagtgtctcccaaagctcccaccccgtaagacttctggggcttctctgacatctgaactccctataccctccctgggaaggtcaccgcccttctcagatgctcatcttgagcgcagttgaagaacctggaagtagaatgccaccatttatagcctatctcagggcagccttttaccaacttttctcttcagaggtctccaaaatagatgctttctttacaggatgcaaagctcatccaagatttgggatgaatccataaaaattttgaaggttcccttacagaagccactatacataaatagcttataaaagaaggccatccagagttttaaggcacatttgcagggggaaacccatttttgtgaaaacatataatctggttgcagtactcaatattcatattcacagatggtggctctgttgcaatcacccacaggttcttcctgcccactgcacagacaaaaccattcactgagactatggtactgcagtaaataagtagtttgggctgggctgggcacggtggctcatgcctgtaatcctagcactttgggaagctgaggcgggtgaatcacttgagctcaggagttcaagactagcctgggcagcatggcaacaccccatctctactaaaaatacaaaaaaacaaaattagctgggcgtggtggcacacacctgtaatcccagctactcgggaggctgaggcatgagaatcacttgaacctgggaggcagaggttgcagtgagctgacattgtgccattgcactccagcctgggtgacagagtgagattctgtctcagaaaaaaaaaaaaagtttaattaatgaaggctggccactgagagatggaattattactcaaatcagtttctctgaatctcagaagttagggtttttatggacaattttgtgggcagggagctggggaataggagttgttgattggttgggaatgaaatcatagggatgtggaaaacagtccttgtgtgctgagtccacttctgggtggggtcataggatcagttgagccatgaaatatgggtcccagcagggtcagtcaggtagggtaaatcagttgcccgaaagtctgaaaaatatgtcaaaagaccaatcttaggatctacaatagtgatgttatttataggagaaattgaaggaagtcacaaatctttgttacctctggcctcatgactcctgagcatttagggattatagaaactacattcagcagaattcaagcccctcccctaatcctaatctcgatacctttcattagttttcaaaggtggtttcagcctcagaacagggagtagactattatcatcatccttgcttcaaagttaaactataaactggcctggcaaagtggctcacgcctgtaatcccagcactttgggaggttgaggcaggtggttcatttgaggtcaggagtttgagactagcctggccaacatggcgaaaaaccgtctctgctaaaaaaaatacaaaaattagctggacgtggtgacgagtgcctgcaatcccagctacttgggaggccgaggcatgagaatcacttgaacccaggaggcggaggttgcagtgagcccagatcacaccactgcactccagcctgggtgacaggggagaccccatttcaaaaacaaaacaaaacaaaacaaaacaaacaaacaaaaacctataaaccaaatttctcccaaagttagcttggcctatatccaggaatgaccaaggacatcttggcagtcagaaacaagatggagtcaactatgtcagatttctgttactgttataattttgcaaaggtggtttcactgtcagatcctggcctctgggtccaatgtggaatgaattccttggatctttgaagcacattgtccatgaatattcacttattttgtggaaaagcagagtagaaaagtgatgaattaacaccaaaagcaacacattacaggcggcttgtgacctgttgatttttaaggtcaaggaggggtggtggggaatcctgggagtcaaaattacacttaaataatactgaattttcccattatgtctcctaccttgacacacatcattctcatggattcccatttgatgatttctagaatattaatgaaactttatcatcttggtgagaaaagcattctaatagctttattctgacatacggaggtatggagagcttgaaggagtcagagaggtcagttgttttccttattagtaatctggcatattattattgtaaaagtataagacgattaatttggaaatgtagataggattatgtaactcattagttcttaatagagggaggtcgtgatacctgtattattagggaacataactgaattcttttccttttcccgtaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaaggtaagaggtaaaatcaggaatctttctaaaattctgtaggcaaaacggtatagccctctcctcataggcaaggcttatggctttaggttactcttagttattttcctctcaaaggaggacatttagggacatttgacttttccttgaatttaccatttactgaggatatatacagggccccataatttgggagtcagatctgggccacatcgctttgtgactttggacaagttgttagggcccctctgagcccctgcctccttgtttgtaactggattaagacaagaaacatcacaagatgtgccacgcaatgacaacaagatgctacacaatgcctggtgcctgggactggtcccctgggcaggggaggacacagatgtgggttggtggtcccatctcaccttcattgctgtgtaactttgagcctattgggtttcagcctcctctaggcagcagaggagcagagcagatttgtggctgtcaccctggggaaggatcaggtcctatctttccaactcacacctgcccctgcatggtccattgtttttttcaccaggaagctttttaaacaaattatttttaggccaggtgcactggctcacgcctgtaatcccagcactttgggaggccaaggcaggtggatcacctgaggtcaggagttcaagaccagcctggccaacatggtgcaactccatctctactaaaaatagaaaaattagctgagcatgatggcgggcgcctgtaatctcagctactccggaggcagaggcaggagaatcgcttaaacctgggaggcagaggttgcagtgagctgagattgcaccactgcactccagcctgggcaacagagcaagattccatctcaaaaaaaaaaaaaaaaaaaaaaaagaataaagaataagaataatgaaagagcagctatacctttttactaagagttttaaccaaaggaggcatgagctcaagaagggccggtggggggcctgcagtgtcttggtcttacaaattgatcctgattgatgtctggtctcgccaagtagccttctgtaccttcttcctgctgctgtttctagatttttacttcccatggtgaataacattaaatcaagagagactgagaagctgggtgcagtgcttcacgcctgtaatcccagcactttaggaggtggaggtgaagaactgcttgaggccaggaatttgagaccagcctgggcaacgtggcaagacctcatttctacaaaaaaacaataaacaaaaaccaaaaatagctaatttttgctctttatgcccgcttgtagtcctagtgactcagcaggctgaggcaggaggatcgcttgagctactttgagcaccagagtttgagcctccagtgagctatgaccatggcactgcagtccagcctgggcgacagagcaagagcctgtctctaaaaaaaaaaaagtaaaataaaataagaaaaacggagaaatgtattttgagagagatcttgggtaaaaagcctttcaggggtgatgtgtaccattcagttcacttgggatctaaaaatcttcctctgaccagaaattacattgactgattaaaatggggtctagctctgttgcccaggctggagggcagtagtaggatcatagctcactgcagtctcccaagtagctaggacaacaggcttgtgccactacgcccagctaatttttacttttttgtagagatggagttttgctgtgttgcccatgctggttttgaactcctggcctcaagtgatcctccctccttggcctcccaaagcattgaaattacaggtgtgagtcactgcacccagcctactttcccctatttatatatcccaggacatagcatttcccttttgtagaggaggagcagccaggaaaatgccttaaaaaggaggaaaggtttggattccttagaaaaatgacataggctggatttggttaggttgaagacggggagggctgagcaaacactgacatttttgagcacctgctgtgtgcctgtgccatgctttacaaatgctgtcttatttaaccctgtaactatcctgtgcaagtagggtttaaaatccccatttaccggccggccgggtgtggtggctcatgcctgtaatcccagcacttttgggaggctgaggcgggtggatcaccagaggtcaggagttcgagaccagcctgaccaacatggagaaaccccgtctctactaaatatacaaaattagctgggtgtggtggcacatgcctgtaatcccagctacttgggaggctgaggcggaagaatcatttgaaacggggaggcagaggtcgcattgagccgagatcacaccattgtactccagcctgggcaacaagagcgaaactgcatctcaaaaaataaataaataaaataaaataaaatcgccatttaccaatgaagacactgggcatcagaataggcaattttttcaaagcctcacagcttttcaatggattgagctgggatgttaagccatcatctgtcagattgcagatcccaggctgttttttttttttttttttttttttgagatggagtctcgctctgtcacccaggctggagtgagtgcagtgtcatgatctcagcttactgcaacctccgcctcctgggttcaagcaattctcctgcctcagcctcccaagtagctggtaccacaggcgcatgccaccatgcatggctggttttttgtatttttagtagagacagggtttcatgatattggccaggctgctcttgaactcctaactttatgatctgcccacctcggcctcccaaagtgctgggattacaggcatgagccaccatacccagcctccaggctcttttcatttgcttgtcttacctctgggaggattactcgcatgtctgaaatctccaggatttcctgttttgatattggttcctgttttgatattagctagcctatttctcttgtcatctcccctccaacttggaagcaaagaaggaagttgaagtccctttaataagaagctaaaattaagctagatacaataatctcctctgtgtggtacaaaatcagtctacattgagcatctttggaagctgcattaggctctctcagatcccagttgctgtcttgaccgagtgatggctgcagggtgcagagtggggcctgttcctgcacaccacagtgtctggggtgtgtggaagggatggccggactcttctctgatacttaattccccacctttaatcagatatggactctttggcccttcaagccagggatgggaatgcaagagtggggctctggaagaaggagagtggaaccatttagtttgctgtttaaatggtgcataatacagaagtagcctccacctaggaaagagactgatgccttactttttcctattggcatcaagggaatggcagatggagagagcgttccagacagctctgtggttgctgcagccggaagtcgtcttcatcctgggggatatctttgatgaagggaagtggagcacccctgaggtaggactctgtgttccaggtgccctcatcctgctgtgaggtccagcacaagtatcccagagaatccacgaatcagtgtcagcttgagctggagattttatggaagttgtacttactactgatattaaaaatgcgtaggctatttggaagatgattagaattcataggctatctaagattattagaacaactcaatcttgagttaggttggctaattgtaaacatttgtctatgtaggaaatatgtcgattagccagatatcatttagttggaatacactgttttgtgaacctcttgggaaagggagaaacgggcaagatagatgttatttcagttgtcaccgaaattgcaaaatacatattgaaatgtacatttaatttcacactcttattgaaccatgacattatgagaatcgtgctgcaaaagagacttgctattctcctctgattttcttttttctgaatgagagatgcagaaggagcgctggggacttgatgtgaggatcctctgctttcagagggggctgagacccctgcctgggtattggggtaatataagactttccacaaaccaaagagaaaagctgttctcaccttagttgtcacagtgttttgcttattatatccttggaacaaaacgaatgaagacatgagctgttcttgctgcttaaaaatgttcagtcactaatggtttttggaaaatcttcaatttggggtatagtataaaaaacttcatcacatgcccgtagtaccagcactttggaaggccaaggcaggaggattttttttttttttttgagatggagtttcactcgttgcccaggctggagtgcaatggcgcaatctcagctcactgcaacctctgcctcccaggttcaagcgattgtcctgcctcagcctcctgtgtgctaggattacaggcatttcctgtgtcaccacgcccggctaattttgtatttttagtagggacagggtttctccatgttggtcaggctggtctcaaactcctgacctcaggtgatctgcccacctcggcctcccaatgtgctgggattacgggcatgagccaccgtgcctgccctttctttttctttttcttttttttttttttttctttttggtgctatgggggatggagtctcactctgtcacccaggctgcagtgcagtggtgtgattttggctcactgcaacctccgccttctgggttcaagcgattctccctcctcaacctctcgagtagctgagattacaggcacacaccaccatgccctgataattttttgtattttagtagagatggggtttcactgtgttgcccaggctggtctcgaactcctgagctcaggcaatctgcccaccttggcctcccaaagtgctgggattataggcgtgagccgctgcgccagacctagtccaaggcaggaggatcgtttgagcccaggaattcaaaaccagcctgggcaacttagtgctgtttctacaaaaaatacaaaaatcagccaggcgtgatggtgcacgccgctactcaggaggctgaagtgggaggatcgcttgagcctgggaggtcaaggccacagtcagctgtgcaccactgcattccatcctgggtgacagagtgagacgctgtctcaaaaaatcaagataaaaatcaaggaagacaaacaacccaaacaaaaacaaaacaaaacaaaaaaaaccccacaacaaaaatccaaaaaaccttactggcatttcctaggacaattcaatagctgcacaagagaagtcttgtttcagagttgataggaaccagtttacagagttgcaatgtttgttattatctaggctataattaaatgtgagatagtggaaatgttatatgtaaaaacaactagttacaaaatgaggttggatagatatgttgcttttccaaattaagggcaacattttatgtttttctatgtctgttattctgattttatgttactctaactttatatttttttatttttttcagctggtgtcttgctctgtcaccaagtctggagtgcagtggcgtgatctcagcttactacaacctctgcctccctggttcaagtgattctcctgcctcagcctcctcgagtagttgggattacaggcacccgccaccacacccagctaatttttgtatttttagtagagacaggtttcatcatgttggccaggctggtctcaaactcctgacttcaagtgatccgcctgcttcagcctcccaaagtgctgggattataggcgtgaggcaccgcacctagccatctaactttaaatgttatttgttaaagtggaatctttgtaaatgtattcaaggactctatccagcatatttccttaagttttgccagatttacaacatttaggataaagttggttactatctagaatagaggttttttttgttttttttccctaccctagggtgtttgtacaattgatatttttagctttataaaataagaactacactaacataactctgaagttttaatagttaaagcaagtatcagaataattttgaaaaattttttacaataagtattttttgtctttctttctcccacatctcattagttctggtttccacagttgtagccataggggaatgccacctttaaagatgttctcatccttgtcttagttgagacacatgaagaacttactggacattttgtcagagcctgttcttatagcatgcccagatctgaagcatttctccaccagggtctatgaatggtcttcaggggatcttgaaataataggtgtatgaaccaaatattttttgggattgccagttattgttttaagatgggagaggataccatttaaaaatttggcattaggctgagcttggtggcttatgcctgtaatcctagcactttgggaggctgaggcaggtggatcacttgaggtgaggagttcgagaccagcctggccaacatggcgaaaccctgtgtctactaaaaatacaaaaattagctgggcatggtggtacacgcctgtaatcccagctactcaggtgactgaggcataagaatcacttgaacactggaggcagaggttccagtgagccaagatcatggccactgcactccatcctgggtgacatagtgagaccctgtctcaaaaaaacaacaaaataaaacaaaaacttggcatcaaattaaataacagtaagtattaattgtaattttaaaaaagacatattatggccaagtgtggtggctcacgcctgtaatcccagcactttgggaggccgaggcgggcggatcatgaggtcaggagatcgcgaccatcctggctaacacagtgaaaccccgtctctactaaaaatacaaaaaattagtcgggcgtggtggcgggcgcctgtagttccagctactcaggaggctgaggcaggagaatggcgtgaaccccggaggcagagcttgcagtgagccgagatcgtgccactgcactccagcctgggcaacagagcgagactccatctcaaaaaaaaaaaaagttctacatcatctttatgggcatctgatttgaacaggggaattcattcacttctcacatcaaaatagggatcattggctgggtgcgttggctcatacctgtaatcccagcactttgggaggctgaggcgggcggatcacgaggtcaggagatcgagacaatcctggctaacatggtgaaaccctgtctctactaaaaatacacacacacaaaataagttagccgggcatggtggcatgtgcctgtaatcccagctactccagaggctgaggcaggagaatcgcttgaatgtgggagatggaggttgcagtgagcagagatcgcaccactgcacttcagcctggagacagagccagactcgtctcaaaaaaaagcaaaacaaaatagggatcctgtttttttagccacagggcagagatggttctctggctctcagcagtgattctttttccctcaggcctgggcggatgatgtggagcggtttcagaaaatgttcagacacccaagtcatgtacagctgaaggtagttgctggaaaccatgacattggcttccattatgagtaagtagttcacaaaagccctgcaccctgagagctcttgttaactgtaattctaaatctgttggaattcaggtgaaagccctatttgtgctgtcttgaaatttgttttcttcaaaagatgtgagctctgggatattaaactctttaaggggtttttacttggtgcatagtacaccctcaacaaatatctgtggaatgaatgaattgtatgtgcccttgggaaacatctaacttgaaatgtacatttaatggccaattattgtctttgggaacgaaaaaccaagatcatttagactttaatagctaacatttatatagtgctctagtgcttataatgtgccatctgtttcaagtactttacttccatatattaacacattaatctttaccatggtcctgttgttttacctacggtaccaatgtggaatctgaggccctgggcagctgagtaacttgccccaggcttcatagtaagtagtggaactaaaatttgagctttgctatcctggggccaggtagagcccttaactaataatgctagtctgaaactcaagtgttgaaagttattttgtgttcatgatgactctaggagtttctaaaatggcttgtcctgaaaaatgtttcttctcacaattgaatataggatgaacacatacaaagtagaacgctttgagaaagtgttcagctctgaaagactgttttcttggaaaggcattaagtgagtattatttgtaaattcttccaagacctttagtccttggaaacttcattttttaaaggtgcctgccatactgggatctatcatctacctgcgttctgtttagcctggtttatgatctttaaacagcagtgccttaggctgtccttgctggtgctcaccatgggagccgatagatgggaaacctcaaaccaccctggttttccttgacaaccccataatgaatcggtcagtttatgactctgcccagccactgtgggaatgatagtctttctgtctgcactgtctctgggtagcacaaatttcatcagcccactttgtaaaagagtctttatttgatcaaaatatactaatttcacgttacaaagactgttctcgtagttatggtgtcataactactatgggatttggtggcaagtgtgtcacagttcctctgtagctctgtgccacccatctccattggcctgggcttttagaccagagcatcctgacccttagcctgaccatgagcagctcccgctctgcgaggccacctcagtgcccatctctacatcctttctgggctgtgtatgtggctgcagcacagtggacaggactctatactctatactgattatagacgcggtggagaaaacaggtgggagtggaagccttttctcttttaatcttgtccttcctgtgggtgcccagcactctgttgaccttggacacagcaggtctgcaggtgaggtcatttctgtccagtggcttcaccaccaatgctcacctttccctctgccaggaaggcagagtctctagtaggtggctttctctgctgactcataatagaagcatgatacagtttgaattatttccctctaagtgtgtgtttaagacacttcaaacagcttatcatactgctgatcacttgataactccactccttatctctaaaacgagttaaatttcaagcagtctttactgacaggtactttcgtcattccaagatggtatgcatgtaggagataaaaccgtatttagtgggagtctttaaaaaaatgtggctgctgagtctaaccacaatggactttgttattaccctagtttgggattatccatacccagttagctctaaccggcaccctaccctctgccttacttgctgtgtgtgtctgtatgtcactgatgcactctgtggttccctctacctgttagtcacaatatctgacacgtactgagtactttctagtggcaggctgtgttctaaacacctgccatgtcatttcattgaatcctcacaaccagctgatggggtgggcatagggttcttagccctgcatggaagaggcgctgtaacagatgaggttctggttggaggatgagcttagacatagtctaactgcagagcttctgtaatctgggatttctcacaagtttagggtcaaaaacccttcgatcgtgtcttagacagaactcccagtaatgctatttttgttaatattgactcatatttaaaaatacaccaaattattctgggtgggattgaaagctgctctgggcttgtttctttgcactggatgcttagctttcttttcatgggaacagtagggaaaagaaagcactgatacccccagcggcctcacctgcgtttccctccgcttcagctttgtgatggtcaacagcgtggcgctgaacggggatggctgtggcatctgctctgaaacagaagcagagctcattgaagtttctcacagactgaactgctcccgagaggtaggagagcatctgaatgccacaggtgccttctgtcccgtgttgctccgcttcggttgctcactcagccccctagcgcttcttgccctttgatgagggtcaggtgtgcggattaatggcctgacttgtacccagcaggcacgtggctccagccggtgtggacctgggcctctgctgcccacgtctgcccctgtcctcctgcaggtgagctgggggaggaaagggctcatggcagacagcaggcagcctgtggtttcacgatagccgcctgaactcctctctccaccccggacagcattatcctctgtatcggagaagtgatgctaactgttctggggaagacgctgctcctgcagaggaaagggacatcccatttaaggagaactatgacgtgctttcacgggaggcatcacaaaaggtttgccagggtgtcgtgatgctaattcatgtcacagtgtgactctcatcaccttgcatgtcaacaagcagagtgcccaggctagagcaggtgtttgctgaaacgttcatgacttagttatcacctggggggacaggggtggaggcctggctttcacagtatctcagattttcatttaatcgctttttttttttccagtaaacctacttctgtttcctaccctcaagtcagtaatagtctcagctattctttgtattcagagtttttcaccaacttaaatgtatttagaaatgtgaatggaactgaaaagtcaattttttagggacttaattaaaattaaaatgcattttcttatatagatttatataatacatattacattatacataatatataaatataagaaatatttataagataaatgtataaaatatttataaagataaaataccgtaaaaagtatataaaatctgggatgagaacaaagggctgaccttacctttgatttagtgtaaataaaccaaaggatttttaaggaaaaaaataaaccagtccttcaaaataaggatttagtatgtaatttaaggaaagaagcgatggccagcggccgtctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatggtaacgtgaaagtttatttttgtctgaaagctttcataagtatttaaatcaacacagtaatcaactatttaattgctgcaatcggtcaaaatttacaaaagccacacacaaatttctctccttctacacgtagctccatacactgccccttgccaaacacccttccgggaaccaatcagcatgacattcctgggcagttaatgtgagaagcgagggcagggcaccgtccaggtggactttatccttcagggagggccgtatcctctcctcttacactctgtgtgtgtttaattttctaaagaaacaaccatttattcattagctatactcagccatcttctcttattttctaaacatgcccatttgacctggcagagaacgctgcagcttttgcaggttgataaaagatgtttcacttaatgaccactgggcgttttaactcctttcagccatgggctcctgcatccagctcatgatgctggtacgacaggttcttttacttcataaaaaggtggaggaaaccctaacattttcaaattcaaagtaaatgaaaacatttgccactgttgttccacataaaagtatctgcaaagaaaagcccatggagacgacctggacacatgtatttctagggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacaggtcagtgtcccagacattttccactcaggcacacttgggccttacttgtctctcctgctggagcctgggctggtcgggggtgagctgtgcagggagaaggctgggcccccttggtctcaggtgaggagggcccgttccctgcctcacctgagggggacctgagaaggcagtcttccctctgctgtttctaagactgcggtgttcaacgtgtgcctggtgctctcagcataactttcccttctcctttccagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccag

SEQ ID NO: 36884 - DNA, 6953 bp, Homo sapiens
ggggcgtgaagggagccgggatcagccaggggccagcatgagccggagggagggaagtctgggtaaggggctgagggaccggacgccgggtcgctgaggggcgcaggagtcagagggattgggagctgggggtctgggtttccgccacccccgggtccgggaggggagcggccttggcggggaagggcagggctccggtgtcaggtaacgagtgagcgggtgagttgtgagaaacagcaggcgctagggtttagaggaggcctggggctgaggtttcagggacctgggctcagggcttagatcaccggttcgagtacacccagggggaggactggggtcggggctggggcaggacccctgcgtccactgagtctcgggaaagaatcagagctggggggctgaaggaaggggtagagtaagggaaggcagtcttggagtcacaggaagtagtgagtgacaacaggagacgaaagtctgggctgctgaggatcgcgactggtgctgggaaacttcgggggtggggcgggggcggggcaccgggtcaggactacattccccagcacgcatcgggcgcgcgctgtgcgtttcgggaaatggagtccctcccggggcgccagacactggctcttgcggaccttgattcgctgactagccaggccagcgccttgcatggatggggcatcagggagagaaatggaaatggaagtcagtctccctatctgtaaaatgggccttcaaggcacattttgatatgaagttctgtacttcgatgatgttgaagtccactagcagtcactgaggtagaaatatgtaagccctgtcttcaaagggctctcaggctaaggcagatacacacagaaaagccgttaaaagagctaccctggaactcatgcaaatggccttaagtcaaaggaaggagttcgtttataaaggagaagtgattctggaggcttcactgaggaggcagtacagtcatgcactgcataacaacatttggtcaacaggtggaccgcacagacaatggaggtcccataagattctatgcatttttagcctgggcaacatggcgaaaccctgtctctacaaaaaaatacaaaaattaaccgggcatggtggcgcatgcctgtagtcccagctacacaggagacccaggcgggaggatcgcttgagcccaggaggtcgaggctgcagtgagccaagattgcaccactgcaccccatcctgggcgaaagagcaagactccgtctctctctctctctctctttctcttttgggatggagtctttctctgttgccaggctggagtgcagtggccttggctcactgcaacctctgcctcctgggttcaagcaattctcctgcctcagcctcccaagtagctgggactacaggcgtgtgccaccaagtccagctaatttttttttttttgtatttttagtagagatgaggtttcatcatgttggctaggatggtattgatctcttgacctcgtgatccacctgcctcagccctccaaagtgctaggattacaggcgtgagccactgcgcctggacaatttttttttttttttttgagacgaagtctcggtctgtcacccaggctggagtgcagtgacctgatctcagctcaatgcaacctcctcctcccaggttcaagcgattctcatgcctcaggccccctggtagctgggattacaggcacccaccatcatgcctgactaatttttgtatttttagtagagacagggtttcaccagatggtcccgaactcctgacttcaagtgatccgcccgcctcatcctcccaaagtgtgggattaaaggcgtgaaccactgagcccaatgcctggctaatttttgtatttttagtagaaacggggtttcaccatgttggccaggctggtctcaaactcctgacctcaagtgatctgcccatctcgggctcccaaagtgctgggattacaggcgtgagccaccacgcctaaccgatatatattatataataaaatacatacctatatatgtattttaactgtagcttttctatgtttttatttatttatttatttagagatagggtcttactctgttgcccaggctggagtgcagtggcacactcacagctcactgcagcctcgacctcccggggttcaagtgatcctctcatctcagcctctcaattagctgggactaccggcatgtgccactatgcctggcttatatttgtattttttgtaaagatggggtttcaccatatcgcccaggctggtcccaaactcctgggctcaaacaatccacctgccttggcctcccgaaatgctaagattacagacatcagcaatctcacctggcccttttctatgtttagatacacaaataccactgtgttccagttgcctgctgtactgtaacatgctgtccaggtctgcagcctaggaacaattgactaacaccacatagcctgggcgtgtagcaggctgtaccacctaggtttgtgtaaatacactctacgatgtatttacgtactctacgatgaaatcgcctaaggatgcatttctcagaatgtatccatgttgttaagcaaggcatgactgtctttgaatttgactttaataggatttcaacagtgatttggggacaggcaatacatttcaggtagaccacctgcttgacaaagttctggtgcctcattttccttcagttggaatgggacagaccctgatggggtcaggaacaaagagccagcgtgggagaggtgatcaatgagcaggaggttggccatcctcattcctcccccctttcccaccagaagacccccagactgattcctcagtctcacttcttccccacttggaggccaagatccgtcagacacacagccttgcgcacctcctcaccaaatacgctgagcagctgctccaggaatatgtgagtgggaatgggggtgggggtgccgggggcctggggaatgggagcagacatcacagaggtcctcgatcacccattctctcaacctcattttccaactgtggaaatcagggctcctgagagggacagcaacttgcccctggccacacagcaaattggaagaggaccctgtctgtgacccagatgccactctgtcctctccagcttagaggcaccctcctcagtgctttgtttttgagaggaggcctcgctctgtcgcccaggctggagtgcagtggtgccattatggctcattgcagcctcaacctcctgggcttaagcaatcctcctgccttagcctctcaagtaggtggggccacaggcacacaccatcatgcctgggtaattttttcattattttgtagaggcagggtcttgctgtattgcccaggctggtcttgaactcctgggctcaagtgaccttggtgctttaagtcagaggtagccaggtagcctggggcagtgaagagaactctgatctgtatctcaggaaaccgaggttctaggctctgcgtgaccttgacacctcccctccatgggccttggtctctccccaacagtaaaaggaggcagctaaatatgattaactctgaactctcccacctgggatattcagggaagccaagaagaggttccaatctggagcaacagttatcccaagagggcactttcacagaagacagggatctgctgacatctttagttgggcagaggaccctgcccaaggaaagaaaatatttccccaaattaccctcgtgtagtgaagggagggtatagctttgaatcagactgcaggcctgccaacttgttaactgtgagcttgggcagtaacaataacattaaaaataataatgtaacaattatggcagcggatagtgggagaatagtggcataatagaactagctttgggctgggtgcgttggctcatgcctgtaatcccattgcttttggaggctgaggcaggaggattgcttgagctcgggagttcgagaccagcctgggtaacacagtgagccctcatctcttaaaaaagaaaagaataaaagaaaagaaaataaaaaggaaaagaaaaaaatagccaggcgtggtggtgtatgcctgtggttccatctactcaggaggctgagtgtggaggattgcttgagccctggaggctgtgtgatcaaaccattgctctccacccttggcgacagtgtgagaccccatctatttaaaacaaacaaagaaaactagctttgtactgctatgaactttggttcaaattccagctctgccacttcctagggtaagtcactatagtcactgtatctccagcccaacattttttttttttttttgaaatggagtttcgctcttgtggcccaggttggagtgcaatggtgcgatctcagttcactgcaacctccgcctcccaggttcaagggattcttctgcctcagtctcctgagtagctgggattacagtcaccaccaccatatctggctaatttttgtatttttagtagagatagggtttcaccatgttggccaggtgggtcttgaactcctgacttcagctgatctgcctgccttggcctcccagagtgcctggattacaggcgtgagtcaccgtgcccagccccacatttatctttcatttgttcattcatatgatgttgattcattgagcccctgctcaatgcaggtacagaggttggggaggatagggaagggaatgaagcccccttggcccctggactatcttatatgatttccatgaagacaggacaggaagcttccccattcattgtacagatgagaaggctgaggctcagagaagggaagtggttttgccccaaactgcacagctagtaagtggtgaagataggatttgaactctggtctgtaaggtaactttaataaaagagctgacatttttactgaactcttcctgggaccaggccctgtcttgaacacttgacatggtcataactgctttatgaagttgctgctgttattaggtcctatttatttatttattgagacagggtctgactctcacccaggctggagggcagtggtgccatcatagctcattgaagccttgacctcctgggctcaagcaatcctcccacctcagcctcagcctccggaacagctggaactacagacatgcgccaccacactcgctatttttttttttttttttttttttagagctgtggtcttgctgtgttgcctaggctggtctcgaacccctgggctcaagtgattatctcaccttggcctcccaaagtgctgacctaaactggcccagtctgggtccagtttagggaggaagaaacaggcattggtgtcaagcgcatgccactttgttttgccttaaacagagcagctctgttaggagggattatcatctgcaagatgaggaaactgacacccccagagagcgggttggagagcccagttaacagccccctgcccgtgctccggggccccgctgacccgccggccgtgtctccgcaggtgcagctccagggagaccccttcgggctgcccagcttctcgccgccgcggctgccggtggccggcctgagcgccccggctccgagccacgcggggctgccagtgcacgagcggctgcggctggacgcggcggcgctggccgcgctgcccccgctgctggacgcagtgtgtcgccgccaggccgagctgaacccgcgcgcgccgcgcctgctgcgccgcctggaggacgcggcgcgccaggcccgggccctgggcgccgccgtggaggccttgctggccgcgctgggcgccgccaaccgcgggccccgggccgagccccccgccgccaccgcctcagccgcctccgccaccggggtcttccccgccaaggtgctggggctccgcgtttgcggcctctaccgcgagtggctgagccgcaccgagggcgacctgggccagctgctgcccgggggctcggcctgagcgccgcggggcagctcgccccgcctcctcccgctgggttccgtctctccttccgcttctttgtctttctctgccgctgtcggtgtctgtctgtctgctcttagctgtctccattgcctcggccttctttgctttttgtgggggagaggggaggggacgggcagggtctctgtcgcccaggctggggtgcagtggcgcgatcccagcactgcagcctcaacctcctgggctcaagccatccttccgcctcagcttccccagcagctgggactacaggcacgcgccaccacagccggctaattttttatttaattttttgtagagacgaggtttcgccatgttgcccaggctggtcttgaactccggggctcaagcgatcctcccgcttcagcctccctaagtgctgggattgcaggcgtgagccactttcccagcctctctttgctttgcctgccccgttctcttaactcttggaccctcctcgtctgcatggtaactccgtctgagtctaccattttcttgctctccctccttccttgggcctgcctcagttccctttggcctccccctttacccagctcttggggtgtctctgttttttccatccccacttcctgccttctcgtggccctgtgtgagcacatgtgtacatctcagccttatctcaaggaggtgacaccttctctccttgtccccatctggctgtctctctgtgcttccctggccaggggcgtgcctgctggtcctatggggggaaggctactctgcatctcagccaccttcctcaggctcactccacctacatccccagtctgccacaccccatccctttgggcctcagccctgtccctttgatgtcctcctttccttcagcccctctgccctgtccctgcacacctccactgcctcccagcagatctgtggagacaaaacaagcaacaccttaaaagagttttatttctgaaaataaattaattttttgtaaataaaatgtttaaaaataaaaaagaaactaaagtt

SEQ ID NO: 36885 - DNA, 9613 bp, Homo sapiens
agaggaggaggagaactcaggcagctctgcagagggggccaggagctcgggtgtttggtacccccagccccaccgctgttgctgctcctgcagcggggacacaggtgaggacgccccgagagagagggggagggggaccaccactagcgctgtcctcatccttccctggtccagcccccacgccctaacccatcctgggatagtccccaggggtcccactggaccttgcccttcccaggcctccttccagggaccccgcaccctccccctgcctatgccaccttctctcctatgcctggctgtggttgcttctcttcctcctgctgccgctgctgctactgccactgcccagtacacaccgccagcccctcggggtgtggtttccccagacctgcccccaacggtgggacccagccttctcccggcgtctcctgccagcttcctgcaaagcccaggagcccccctccctggagacacacccaactccctttcaacaccccacccccctcttaatcccattttggggttaacccccttcctcttatttagtcttcatagatcccctgggtgctctgggattgtgcccaacttcctaacatttgagtcccggcccttggaattccccaggcccctttttcctccctgtagaactcctgagagtgtcgaccaggctttgttggcccgtctagatacccacctcccccagataactctcagcctctcaaaaaataacccagccccctgtctacccctttagataaccccttcccctctccagccctactaggaggctctggcctctcctttcttccccagaactcctgtagagtatagacacccccccgggctattcttggcaactctaggcagtcccaagacacctttcagcctctttacaacctcctggatccacagccacccctcaagatgcaccagctccctttccagatccatgaggggggtctaaccctcttatgcttcccctagaagtcttgagggtgtggacaaccctcctcacctgtctcagcccctctagaacccccacttccaggcactctcagtctctttcaagcacctctggtcccatttctacccctctggatgccccagtctcctctccaccactgcaaaggaattccaggctcttctgccttccctgagactcttgagagtgcagagaattccccacgtgtttcttggcccctctagacgcccccagacacctctcaggcacaggctgactcctttagaatcatctcagtctctctaaaccctccctcagctccttcttggccccatccccacaccccttttctgctcttctccatgtccccaaggcccttctcagtccctcagaacattgcccaggcccctcctaggttctgtaaatgtcccccagactccttcccatctctttagttcttcctcctggttcctcttggcctctctagacacccccagtttccttgtttgggtggctcaaggtgtctccaagcccccaccatcctggagacagccacattctcctaaacgccaccctcactaagtctccctgggcttggggagtggcacgatggcggcaggcctggccacgtggctgccttttgctcgggcagcagcagtgggctggctgcccctggcccagcaacccctgcccccggcaccgggggtgaaggcatctcgaggagatgaggttctggtggtgaacgtgagcggacggcgctttgagacttggaagaatacgctggaccgctacccagacaccttgctgggcagctcggagaaggaattcttctacgatgctgactcaggcgagtacttcttcgatcgcgaccctgacatgttccgccatgtgctgaacttctaccgaacggggcggctgcattgcccacggcaggagtgcatccaggccttcgacgaagagctggctttctacggcctggttcccgagctagtcggtgactgctgccttgaagagtatcgggaccgaaagaaggagaatgccgagcgcctggcagaggatgaggaggcagagcaggccggggacggcccagccctgccagcaggcagctccctgcggcagcggctctggcgggccttcgagaatccacacacgagcaccgcagccctcgttttctactatgtgaccggcttcttcatcgccgtgtcggtcatcgccaatgtggtggagaccatcccatgccgcggctctgcacgcaggtcctcaagggagcagccctgtggcgaacgcttcccacaggcctttttctgcatggacacagcctgtgtactcatattcacaggtgaatacctcctgcggctgtttgccgcccccagccgttgccgcttcctgcggagtgtcatgagcctcatcgacgtggtggccatcctgccctactacattgggcttttggtgcccaagaacgacgatgtctctggcgcctttgtcaccctgcgtgtgttccgggtgtttcgcatcttcaagttctccaggcactcacagggcttgaggattctgggctacacactcaagagctgtgcctctgagctgggctttctcctcttttccctaaccatggccatcatcatctttgccactgtcatgttttatgctgagaagggcacaaacaagaccaactttacaagcatccctgcggccttctggtataccattgtcaccatgaccacgcttgggtgagtgtggactctgcgttgggggctgcccgattacactcaccctttctgtaaaattaggaagtttaaaggaatgatctctttctttctttctttttaaatggagtcttactctgtcgcccaggctggagtacagtggcaagatctcagctcactacaacctctgcttcctgggttcaagtgattctccagcctcagactcccaagtagctgggattacaggtacacgccaccatgcccagctaatttttgtatttttagtagagacggggtttcaccgcgttggccaggctggtctcaaactcctgacctcaggtgatccgcccgccttggccgcccaaagtgccgggattacaggtgtgagccaccgcgcctggcctctttctctttttgagcttcagtttgctcatctgtacaaactgagggagctggacttaattcttcagatccctcccagctctgacaatgccttgattttctaggtcaggagacttgggttcaaggattgtcttagctgctctctttctgttgatgtcgttttctcatggcctcagttttcccctctgtaaaatgggaaatgctgatcccttcatcatctagagaggattcaatgacatcatagttgtgaaagttctctgaatgtttctggtgcaggatacataggtgttggctttctagcacctttttctgttttggggacccatgtctcccaaccttctagaattgtctgctgtgtggggcactacttctgagcctttgtgattccttgatgtttcccagaacaagatgttttcagcatttttattattattatttttttgtcgatccctgcagaagaaacagagttgggataaaagtatcaaatggaatcatcgaactcatgagctttccaaagatactgtctagggcagatgctgtgatccttctctaagtttccatcactgggattgggtatacagttggtgctcagtatctgttgaaggaatgactgaatgaattgggtttgctcagtttcttcatagaggtacaaaaaaaagttgatttggggtttctaaagcgtagaaaccccaattctggttggaggtccaggatcagactgacaaacaaatactgagcgctgacagtgggctggaactgagtattttgatggcttttactctattcaagtcctcacaacaactctgtgatggtggatggctgcccatgtctcacagttgaggacacgctctgagatgacacatcacagagccagcaatggccaagttggaaagacttttgagcagagtcctgaatgcttaaaatgagtgaaaataccgaaataaggaacagccatcctagggcacagcctgagaaaaggcttagaggctgaagactgcagaggctgtgtttctctggaggagttctgattggttctgcggtcagaacaagagtatgcagtgtgatcttgggcgagtcagttacagaatctccctgatcttcaggggagctctctgtgaacaagttagtaaggttggctctgctctgtctctgtgggaggtgggtggcatggagaaaggcaggagggtttcaaggctcctccctattttgtcatatgtggacagttttcaaggattcccctataggggaatgaaaaggggtcctacctagagcaggtaagacagaggcagccaaaaccaacaaaacactcctcccgggacttgaagcccttcggctggcctgtggtgctgggactctctccccaggaggctgtgttcactgcctgtgacttcctcatgctcccctctgcttggttttcatagatttctagctgactcaggtgcttggtatgtagcttggacaggggcagcagatggtaggggttgagggccaggcccatttctcacttggccacccagcattttacagagcaagaaactgagggactcagaaggtttgagtgcctggccagggtcacagagctagtccggattagatgggatggagtgggggactgaaaggtaggtgggcacttttcctgaccttggcctacctcccctcgctccagctacggagacatggtgcccagcaccattgctggcaagattttcgggtccatctgctcactcagtggcgtcttggtcattgccctgcctgtgccagtcattgtgtccaactttagccgcatctaccaccagaaccagcgggctgacaagcgccgagcacagcaggtaaccgcactttccatccgagcacctcctactccccacaccccaagccagtctactttggggcttacccacctgaccttttatctcctctctctgcagaaggtgcgcttggcaaggatccgattggcaaagagtggtaccaccaatgccttcctgcagtacaagcagaatgggggccttgaggtgggtcggggcctggatagggttggggtgagccataacggggaggaaggtgctgcccttatcgctctgctccatctactccaggacagcggcagtggcgaggaacaggctctttgtgtcaggaaccgttctgcctttgaacagcaacatcaccacttgctgcactgtctagagaagacaacggtgaggcctaatgtgaggtgatatagcagaatagagggggtccctctgcggccatgccagctctctcccttggatgggaggctcactacaaattgtggaaatcacacagagcttcctggaagaggctacaggagagccaagccttgaagaatgggcaagggaagggaagagggaacaatgtccagaaaggagaaaacagcctgagcaaaggcttgagggtgggatcagctcccatgggatgccccgtgaccctgcctcccttctgcccatagtgccatgagttcacagatgagctcaccttcagtgaagccctgggagccgtctcgccgggtggccgcaccagccgtagcacctctgtgtcttcccagccagtgggacccggaagcctgctgtcttcttgctgccctcgcagggccaagcgccgcgccatccgccttgccaactccactgcctcagtcagccgtggcagcatgcaggagctggacatgctggcagggctgcgcaggagccatgcccctcagaggtaagcagccctcctacctgctagccacacctggggaagctcagagcttagaccagtagctctgagatttcataactccaggcctagcaagtcaagctcgaacccaaacccctccatgctggaagcttgggcttatcttgtctggaactcattcttcatccattcttttttttttttttttgagacggagtctcactgtcacccaggctggagtgcaatggcgggatctcagctcgctgcagcctccacctcctgggttcaagcgattctcctgcctcagcctcccaagtagctgggactacaggcacgtgccaccatacccggctaatttttgtatttttagtagagacggggtttcaccatgttggccaggatggtatcgatctcctgacctcatgatccacctgccttggcctcctaaagtgctgggattacaggcgtgagccaccgcgcctggctgcattttttttttttttttctgagacgaagttttgctcttgttgcccaggctagagtgcagtggcgtgatctcggctcactgctgcaacctctgcctcccgggttcagacgattctcctgcctcagcctcctaagtggctgggattacaggtgtccgccaccatacccagctagttttttatatttttatttttttatgtttatttttatttatttatttatttttgagacagagtcctgctctgtcgcccagactggagtgcggtggcgcgatcttggctcactggaacctccgcctcccgggttcaagcaattctctgccttagcctcccaagtagctgagactacaggtgcgcgccaccacgcccagctaatttttgtatttttagtagagacagggtttcgccatgttggccaggctggtctcaatctcttgaccttgtgatctgcccactttgacctcccaaagtgctgggattacaggcatgagccaccacacccagccaattttttatatttttagtagagatggggttttaccatgttggccaggctggcctcaaactcctgaccttcaggtggtccacctgcctcggcctcccagagtgctgggattacaggtgtgagccaccactcttggctggtgatgcagttttagtagtgtggtcagagaaggctttactgaggtgacaactgagccaagacctgaaggaggcaaaggagtgggccatgcagataactagaggaagagctttctaagcagagtgaacagcctgtgcaaaggccttgaggcagatgtgggtccacattagagacatagcaaggaagctatcatgggtggaggagagtgagctgggggagactggtaagaggcaaactcagaaaggagcgagggtcccaccttagatcctactatggacagtttgtaaggacttggacactgttaggagtaaccatgagagatagcattttcatatgtatgcacattgtgttccagacactgctctgagcacttcgtatcatttttaatctcatttaatctccacagcaaccctatgaggtgggagatagtgttcgtcccatgctacagatgagagaagagagaggtttggagtggttaaagtgggaccaggatttgaacccaggactatctgactctagagtcctcactctttaccaccataattggggatgcaggagaagtacttaagtacttagcacagtgccagggacccagtaggtgctcaataaatgccatgattgctgtggcaagtattaattttttttttttttttgagacagagtctcactctgtcacccaggctggagtgcagtggtgcaatctcagctcactgcaagctccgcctcctgggttcacgccattctcctgcctcagcttcctgagtagctgggactacaggtgcctgccaccacgcctggctaattttttgtatttttagtagagatggggctttaccgcgttagccaggatggtctcaatctcctgatctcgtgatccgcccgcctcggcctcccaaagtgctgggattacaggcatgagccacagcacccggctgataactttttttctttttttttttttgttgagacagagtctcattccgtcacccaggctggagtgcagtggtgcaatctcagctcactgcaacctctgcctgccgggttcaagcaattctcccgcctcaacctcccgagtagctgggattacaggcatgcgccaccatgcccagctaattttttgtatttagtagagacggggtttcatcatgttggtcaggctggtctcgaactcctgacctcagatgatccactcacctcggcctcccaaagtgctgggattacaggcatgagccaccgcacccggcctaagataactttttaagagccttccatcttctccacccttgtccacagccgctccagcctcaatgccaagccccatgacagccttgacctgaactgcgacagccgggacttcgtggctgccattatcagcatccctacccctcctgccaacaccccagatgagagccaaccttcctcccctggcggcggtggcagggccggcagcaccctcaggaactccagcctgggtaccccttgcctcttccccgagactgtcaagatctcatccctgtgaggggtaggcctgctgattcagagggtcctcttcatttttgggaactcctttccaaagccatatttttgggaggcagagaggggcaggcttgggcaccccttctgccccccccactgagaactatgcaatggagtttcatgaaatggtccacatagtggggaagtagccaggaaatgagaaacttcctcccaccccagacatttttcctggtgggagctgaagcactgggcttccacaggcccctggcctccttgccctagcacactgggactggccccactctcccagctggactcctgcatgctcctccccttgggctctcagatgaaggcaaagctttgatccgacatctgagctctagcctaagaaggagagttgagatttcctcctccctctggctgggatatggagctttggaggttcagagaagagaaccctcacctctgatctggcctctacgagaggtcctcatctccatctggcccaacaattcccagattctgaagcttggaatgcaaacacaggcttcatgggctgtggcctctgcagcgacctgccatccccaggccttgcctgaggggtcaggctgcctctcccaacacacactcagatagcacaaattctaccatccccttccctggctgctggaaatggaccccgcaaccctgtcctctgctgggcccccagcaaactctagcaatagcagctgctgccgtgtcattatgcaaagcctctgaccagtttgctgcagcatttacatctgccctaatcagaggggccacctctaactcctcctcctcctctcttctcctctggtttgcgtccttcctgggttgggctggagtctggactggctgagataagagcctggcaaccagcaagagctgggctgtatttggagatcatgggctgattccatgttcttgggcaacagtccagaagcatcaggggctccggcctgggatgtttctgaactttgggagttataggagacaggaggaacttctcctcctcctcctcccctacaattccttttcacatattcctttcttctccctcttgggtgaccttccaaaactctgctctcaggctgaaatctggcatcatctcaggttccctgtccccagcactgtccccatggagctggtggctgacaaagatgtagtttccatcagtcaataaaacctgagaggagagatgagg

SEQ ID NO: 36886 - DNA, 38691 bp, Homo sapiens
cagaacagtcctccctgtaagagcctaaccattgccagggaaacctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcggtaagtgtttccttattggttcaaatatgtaactaatggtccgtggcggtttcaagaataggacagcagcggcttctcttggttagggagaagagggggctggcgagagggtgggcgcgtagttaattatggggaggaaaattggcggggggagagaaacggggttaaactggaataccggtaactggtagtggggcgattgtgttgtcctgatgtcactgtgtgccaagttgggggtggggaggcaagggaacagcacctgtggggctcaagccggcggtctagggcgccagctctctgctgcccactgtgtcagtacctgcttattatagatcttcggtctcttggctaatggaactgggtcggagcggaactggaagctcaagctccaggcaggagagagaacttagaggctgtgcccattgccccctaagcaaagttagccccccaacccccaaacaaactttccagcttcccctccctgtctggcagccccctccctcccagagagcgcgactgctagagctcacacatgcgcagtgtgggcccagggccgggccgccgagcaggaagccggcgcagctaggcggccggcggggcctgttaattggcaattaggggggaggctggtggctggtgcgcgtcagccgagaggagagcgtctgcccaccccctgctcccgcccccactcgggcggatggaagggtgggaggtgccctgcgttgggtggagggtggaggttgtagggtgggggtgggggatgctgtactcaaaagccatcttgtgctcagagaaaagaggcctaccggctttcccttccggggtccggcgcccctcacccccagccgcggccatcccagccgggatgcccactggaccgggatgcccgctcgccacgcatggctgctctgggctaggacctgcctcgcctcggggggaggtggaaatggggaaggccctaggctgggcggggacaggcccagtcctcctggtagagtctcctaggtgctgtggaggcagtgaggattccgggggctgctggcttatggggtagaggcgtcagcctggggcggcgggagggtcctgggcactcgggatctctctaataattggtgctaatggcctgttgtatagtcttaacccgacgcatatggtttcataacacagtggcttaatttcttccaaatgtacgtggccctgaatgtgttgcagtttgatatatgaccccgccctgctccccggcctgggtccgaggctccgaggcggccccataagtgtgaatttctgtttataaacggcgacgcacacgcaaacgcctacacacccaggcagacacacccggaggcgtgggggaacatattccagacgaggtccgagagaacctgggggccagacttaccttaatctaagccaagacaccccctctacccccaccctctcccagaggcgcgactgggattctgcgccaagtcccagtgggggaggggatcgctccacgatttcctgtttaaaccctgacccgtcgcctgtgggggggcggggatgggggaagaaacctgtttttatcaaatttttaaaaatacagtttgcattcagatcaaaccgtttgggccagagctgacggtgaattttatctcccctccccccacaacccccttcccttccttttctgcccccgctaaattcccctttcgcagccatcataaaggcctctgaggtattctcccgcgggaagaaatggcattttctctccccctcccccacccccccacccccagtaggacttgtgtgtcggcagaggcgtctgacgaggggctaatttcgctttccttgtttacgatcgagaaaagcgcttggctctccccaaatgggcccagcccgccgcctgctcaggctgccgcgcgctctcccgccgctcaggcacggcccagtggctgatgccccgcggatccagcctgcggcaggccggaacccggagtctgtgggacctgaaaagggcaaagggagtgcggtgggacacaagaggggcccgagaggcccgaaaaagggagcctttctcctggagtaatgtgggaatcgccgaccggtgaggcctctatttctctctttcgcctgcattttgtccgcccccgcccctgtggatggccgctgatgggggggaacacaagtgtcctttgtccgtccccgaaagaaaaccttttccagagaaggccattcaggccagtggagattcacctagaatattagaagggccccctcccacccgaggggcgggcctgggcgaggctgaggtatttctcttaatcctagaacgacctcactgagtgtacccacagcgagatttggaggtgctagagttcgaggttggccgcttaacagcaccatcctgaggtgtctttatataatattttaattgattttctgtcccttcctggctacagccctgcagctcccccacccccatcctatgcccttcacccctagacccatccttacaagacagaggcaagcagagaaggcatagcagcagcgaccggcgctctgttttcattttccactctggccaggggataaactggaccccagtggactccaacaccaactctctgcttcccagttactttcgattttctttcccttctccttctttctctccctctctggcattcaaacagaagcacaagaggacccaccagtggcaactctaagcctccttgcaggccacattccctgctgacgtggtccttcctgcaggagagcccttctgtgattatctaataatagccagggtggctgagaatagaatctggctcaaggactctgcacacccggggcagagacactgaatctgtgggtcagggcctggcaacattccttggagcctccccctctgagcccactctttgggcacccttaggcttgcctgccccccttataaggggctttgtcagccctgccatccgctgtatttcatgtgctggttcctagctaaggagaattgggcagagcaaaccctttctcaccctggtctgacagttgtgatcccgacagaatgcgaccttgtttggagaaggcgaccttgttgggttggctgtgttctgaaaccaggcttgggagtgttatatatttattatatacaggcttaaatatacagactcaggcttatgcatgaatatatacagactcatatttccttggtggttaattgtatattaccatgcctatattcgctcaaacaccattttatgttcatgcaaaattttgttagtcctcactagatgagagtgggctcatggaggcaccgggtgcactgagcaggccctctgtgcatgctctgctggaaatatgtgctcactggaatcggagtatgcgggttccagtaaccaatggatgccataaaggctttctcagaccttattgcttttgttgcccaagcagctggactggggaaatactaaatcccttctgctttctctccacacctcctggcaaactctcccaacttagaaattattttacaagggagaccagttgtcttgaaattgagttctgcgggattcttttcacgggcatggtggggctgcaagcagttcggagtagtcagggccctggcgctggaagcctcactggagcgatgaagggatcagagtggttaataaggtggcctctggacagtgatctggggcagctgctggccagggtgcttggagaagcttgtggaaaaggcaagccaaaaggggtagggatgcagtgaatatctgtttctccccctgcttgccccagccggccgctcaccccgccccagcccgatttgcctgcatccgtggcggcagattgggagttctctaaggtcccccaaatacccagatctggttactggatgaactgcgttttaatcctcgtcgctatctgagccaggacaagacctggtcagggagacggctggtccgggcagcacgggagaggacgctggacccgctgcctgtggcctggagcactgagtatgggctaccaaggctgagaattgatgggcctcctttcccagcctttttcccttccagagacacaaaaagacagagcagaggggaaatatcaatgtcagtggaaaaccccataaaagaaagcagggaccagagcggggctggaggggttttccgctactctctctaggtgatcgggttcctcccaagactcttgtccagacaggctgcaccaagaggtgtgcagctttcttccaccttcctcccgcccttcaaggagggcagccttaggctttctgggccttggtcaccccaggcactggggtgacattactccaggattgtgcccctcgcccagcccacggcctctgccacggcgccgcagccgctcctgtttattgtgtctgtgagttgtttacttgttttgtctgctgccaccctgcgtcagaaacccgccaaaccagcgaactcgcccaggagaacaaagtgctgtgctatccccggactccctcccctttccagcaaccccctcctgccctcacaagctcctgcattctccctttcggaggggaggaagcagaaatagtcttaaaacagggcagctgtttatagggtcaggggaattatggggacaccataaacctctgggtgtccctgtggtggacagacttctgagcagcccttcccttgcctaggcttttcttccttcccctggtgaccacttggttaagggggccacactcattgagaaagttgagcccacccccatcaacccagtcccccactaccccactcctttctgcaggagtttccctgagacacaggttgttgggttttaaatcagggtaatgttggtggattcataaagctagatatagcatgtcattcttctcccacactccctctcctcagccccccaaaattgcagtgaatttaagcaaatcctacaaaattaaattgcccctttgctaaagatcctatatgtctccaatcctgccaggtgtagagtcagatagttggcttttggcctttaattttgctgctagctattaaatttaaaagagtatcattgaagtaagtaatattctcatttctgaaattaattttcccctcccagtctctctctctctctttttgccagcacagattaaatggttctttcagatctgcaaacaataaaggataaaattatttatagggaaatgaggatgctgttttattgttggcatattgttccagaacataacaacattttattttcaagcaggagaggttagaccagggggagaaagagggggaaaggaaaaaacatgaaaggagggcaggaacccacacacaaaactcctgccatgtataactggtaggacatttacaatttctatatgacaactcactgtgatgtcataataccgagttcttgaattttataattctcatgaacctctcaaatgggtccaagcagtgcttcatgtggaggggtatagaagaagccaggaggctggggatcctttgacccagtgcagagcagcacaccccctattgcggcttcttcctcatgtgacatcctcttgaggccctattctgggggctgaaaatattctggatattctgcattttaatttttctcctgggccaagcagggccacttgctttgcccccctcaagtgtccctaggcatctaagctctctccccattcccagatcacagagagctgtgtccccaggctctccccaagccccctcctcagctaatactcagctgcttggaatagaggtgggaggcttgggcaccagcccccaaaaagccagaaatgattttttccagatggagctggaagggggctcagggctgagcgtgatggggtagagatgtttgggacctattttacgttttaaccttaagtcagagaagtgaattgagaagccaaacaaatgccaatgtgagagtttgtatctgctgatggtagcagcaataagtgaagtgctggtaaggaaaggtcaggcagaaatctggaaagagagagggaggagaggaaatgtgacatgagttagcagagcccttccatatacctttcttctccgtttaattgtaataaagcaaaagcagctcgggtagcctctcaacctcttagctcaaaagaggaatcaccagcgcaggccttggaggtgtttgggggcagttctcagcagcttaacatgcccaatctgccctcttcctcctttccccctccctgctgatccccagctcccttcaactggtcagcccgggccctgtccccaaaatattagcacccccaaatgatatccatttctgtgttaggtgtgtcaaatttcacttctctccatgcctaaactttgaaaggaggagtgtacctttttggaatgcggtgtgtgtagcgggggcaggtatgtgctcagacagcttcccccatcatatctatgggaaactggaagccccttaggtgagccatgctttggtgttcccaaacagcattccctgcattcaggttctctggcagaccaggaggctctttgcgatctgatcctttgactaggagttccatggagatcaaaggagcttatttatacacaaaacaccaggcatttggagtagaatttattttttaatttctaaataaaaaagtctaatcatagaccaatcgggccaactgagcagtcgctccagaacagcaaagccttaaccaaatagtgtgattatgaggggagctgagcaattactgaaactcggctttctccgtaagagggattttagccctcgcccagtggcacaaaaggggccagcggggcaaccgttcttctcttgctcagaaaagtgagacttgggggtggtgggggcagggtcgggcagctgcggtcgcgtccaggcagctgagcacccaggccaggcgctgaggctgagcactgagtcctgaggctccagtgcttgggtccccgagcagcctcaggaggcaccgagctgtagttgcagcgcggcagtcaggaatggagtatgtgtatctgtgtgcgagggttggtgagttacaaacatccgcgcagagttaggggatctggggagagagaggagacagggagaacacaactaaggaggacctctggaaaatattgtccccaaataaaaattccagatctcatccctctcacttcaaatatccctccccaggaaattaatatatttcccagagctgagtggaaagcaaaggccagcaaggtgaggcctgcccacgaacttcttcaggctgggtccagtcccacccaccctttccccagttcagagctcacatgcccccagcctttccctggcctaaaggggagtaaggctggagtggtagcatttaacttgcctagggaaatccccaagtgcccaggctgcaatgccacccttatccttggggactccaggccagtgactgcaccccactcaggtccaaggcgcaggcagtaaatttctctcctataattagcgctatcaaaagcatgtgttttgcattggagaggactggagaagcaagtggcaatttttcccttgtattctttttctgtgttttttgaattctgtttttgaatccactaattaaagcttctctgaaagtgaaaatctgctcttgacaccaagccccttccgaatgcctgatttgggaggctaaggggccagagcagtagcaaggagacctgcaagcctgatggggttggggggtagtgttctctgatttctttaggctcgttttatagaaacaaagaacaagttctctcccctccttcccaagacttgtgcatatttacagagcacaactgcagttttaataaaacatctgttcttgcttctgctgatgagtttccataattgttttcagacaaatttaacaggaaaatataaatatatttagaaaaatctaagtcccagctttccccctatagacagccattcttttgccaaaaaaataaaattaacatgaaatgggaaaaagaaaatataatccaatgtagggaagatcgggctcatctgacctgctctccccccttggagcgaatcctttcagcaaatttcagctgcataattaaagatctaagagaaagaagagggcttcttctttcctcaggaatgaaaggtaattgggggggggggaggtgttgaaaattaattttgccaaaggtctttaagcagtggaggaatttatttgtatttctgtttccccttctctcccccttccagcatttctgcctttttcacccagcagctggtttctgttcattataaatcggcgagacctttcagtctctgccctctgtttagggacgtcataaaacacttaactttctggggctgaggctcacattctgcctctcaggtcgccaacctccctgagcccaccgactttaggccccaatagagaatctccccaactttggggcccctttcctctccagacatggttgaggaggggctcaaggaaacctaggcatccttgctgggggctgtagtccatgctgccccagaagccccttctttcttccaaggtccttccctcccccacccagacataaaagagatttttaaatacatagaaaatcaacactcattgaaagtgaaacctcattaagacatcctatcttccatcattcaatttgttgtacattgcaacaatttaatatcttgaaggaaatatcactgacatgatttatccctctagcaatctctctctgaaattggagggggggacagagttactctctcttccggcctcttctacttgttacaccactacccttagggcagaaaggaggctgggaactctgagagaggctacttgtgtccaggggtgcactgacttgttccctagctcagtccccagagtactcctgccttgttgtctctcccccacctcttgccctccagggggcctgaagcctcagccagctgttggaaacctctgctcaggcatgccatgaattcgaggacagctggattctagggcaaaaagcaactcacattggtgtctatgtttgtgtacctgccaagtcaccccaaaaatgagataactcatctaaaattttttttcttaatttaaaaatcctcctctaccctttccccttcatttccttggggagaagaaagtgtgatctagaaggaggaacctttataattataggagtctttccccttcccttccaaataccgacaaatttctgtcctttctggaggattggggctgtattttctaaaaccaacacaaattgtctggcaggaagactcttcaaccccctaacgaggttcatgtattaactaacatgttgtctccaccagctcctgcacactgtctgcttttgggttcgaaactttatttttcccccctagcgacactccagggaaaccttaacgttacagaagatgaataaacgagttttttctcagcatagtcccgtttatggctttattgctacccattgattactccgctttgttacacagaaggaaaagatcataaaatccggcgacatccgggttcttgttatagccagctttccccccccccaacccacccaaaaatggtggggggggggggatatgagctttctctgctccccgcacactccccaccacccttctttgtcaactcaaggcattttcagcctatatcacgatatcaaattaagtttggactaatcaggagaaaacccccatctgcacactttccgctgtttcagttcgcctactgcggctccctcacaagcctcggattcagctgccttttcgtaaccgtctcttccctttttttagccccaagatgggggaataaaatgggcgttgaggttgctgagaggcccatccccaccacgggtgactggcacttgggtgagagctccttagaacccctttctgaagtctccaagcctcatagctcaggtccaggggcgcctccactggcggtgccctgagtctggagggggcaggggggcttctgaccaaggcaggggcttgagcctgcaggaagctaactgtccatcagagccccaccagccttctctttctggctggatcctatgtgaattaccccacaggccctcactggctccaaataataaattctcaccaacataaacaggagttgatgtctctagaaagattctcagagttttcgttcttcctctctctctctttctctctgtctttccccctccggtgccacctccctacattttacttctttttctcctttttctattgcattttttatacattttcccttttaggcaaaaatgctggaagagttttcccaacagaggggtcctgagaaggaggcagaagggagccaggaggcaaaggagagcagatgcgtggcccatttgcccactccagctctgccactgtaccctgaagtcttgcccctttagacctagttgttccccacatccctactacattcaagactctcagccacactctacttactcaggggaacaggttttatgaaatttctttctacttttgatttttttttaattattggtgaaaaaaatactagtttagtgatgggactcactccatggagtgtcaaaacaggatttcctgcaggatttctagggacccccctcctgtgctgggagggagttcttcccttggagaaatcaggatgtaattttagaagggggcagatataaaacatgaaaccagattgaaaatacaggggtttctctagccctggctctggccacagcacagcaaagttagctggggctgagagatttcctggtagtacagctctccttccctgagtcccaaggccctgctcagggacatgcacccctccttcaccaccaaaccagttcccttacatatatatatatatatatatattttttaaaagaaatccaagtcttactttcaaagcacacacttagtctcaactagggaatcaacagaagcagaagcgatttttttcccccttcctgacatctggcttgcgattggctgggagggggtcagctgactttgtcattttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggtgagttttacagctccgagatataaattaaataaactgaactggctttatgaccggcttccctagaagaacgggcggagagagttttttatggccccataaaaacaatcacgctcgtctcctcaccgagacagggccccctcttctgccccctcagctcgcctctcgctcgcttgcaggggcctggcccccttggcccctgacggattggagggccccaaggcgggctgagggggcaggaacagggcaggggatgaggggagggagcagaagataggggagccccccaaagtggagtcagtctgaggagaagggagggggagaggagaggcagataagtggggagaagtttccaaggaactaggatgcttggggagatgggggagcccagtccttgagaaagggggccctcatccccattatctgggatttttcaaaaatctgcttttagacttgcagctttctgtttgccttttgccccgcccccccgcccccccccccaccacacacctttctttgggacacacaggtcccaccttataggaggtctgaagttggggtcctcgctgtacccccagtgggggtggggcaaggcaaaagggagaaggctagagccctaaggaggctgtgagctgctggccaggttgggagggtcaggactttgctaggcgaaacagtctgcagaggacgctttgctgattgcttttagtgtgttttgtgcccggatctttaggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttataccgggaattctgttaattcgctcgcccgccggcctcagggtgagagctggagcaggctccaagcgctcccgcgcctgccggccccctgcaagcccccagccctctgcactcgccttccccggagcccaggcgcccggccccggccttctgttcgttctcgcgatcgcactgaggggctgggaggcctctctgggctccctgcgcggagcaacacacacaccctgcgggaaaaagccgcgtaggattttgttgcggggggagctgggatcagtcggtttgggcaccaaccccacgcaggcctttcttcctgcctgtggcagccggtgtcctcggcgtccgaaccctgaggcgccccgaaagaccagtaaagaagcactatccaggcaccagggtctcctccacccactcccgggagttggaggcggggggcgccgtgagagcaagccccaggcccgcgccaagctggctgttgcgaaacgtagcggaggcggagagcggagggaaagagaagaccgcgggactggagccctgtcggcagggattgagcgattcaaggacatctcgagagagaaagcctggaaactgagctctcgcctgctctggtactcctgacgtggccgggacaaaattccttcttcattacagctccagccgggctggttccttacttttctctcctcaaacgggtgaagaggcgggtgaggagcgcagccggaccctaaccatttatcaaccctggccttctctctccaagcctggccagagaaacctgagtgggcctacagggagaggtgttgaggagggtctccggagggaaaaaatccgccagagttttccgggcccttcagattccctccagcgcccccaccctcgcctccagtgcctccaccagtgaggagggggccttctcctggcggggcggagatttcctgggaagaagcaggcagggaagtatgagacttggggctacgggggaagaggatggggccgaatggctgcagataccctgcgaaggctacccaggcgcctgccctgcccaccccccaggtccgccccattcctcttggtagctcagaaattgctctcttgtgaaccttatggattcaggtccctggaaagcctagcccagagaccttttccccaaagggcacataacgggccttttcctctgccatgctcacgtaatatttgtggaggcttcaatcttgcttctccatgtcctcaattaacatctattttctgtctaaaacctctggcataggtaccacataaggatcgcacacagggaaacagagcagtcctctagaccattgtctggctctgtccgtgtccacacacacacttgaaaattgccttgttgccactctggggaccctagcatggtgaggtctagccaactccacctggctcctcacctccagatccatcccaaacagcctgcaacaccctcagcttcatgacccccctatcttgttctgaccactcaggatccctcctcctgggcgtcctgtctacctcttcagaagctaattctactttctcttgctgataggcacctcttcagcagtagtggagccttagggcctgagaggcaagggacttctacctttggtttagggaacctaagttaaaccccattggttctccagcctgggcataggccaccttacctaacttaatcccctttcctcagccatttttgaagattggaagaccctggaggttgggagaacgggactttcattacaaaaagcactctgtgcgttataagtggggcctcgtcttttcccaattttaaatagaatttaaaaggctagctcaggggttgccccaacaaccagcttctccttcacagtgtaggaaatccagccaccggaaagcaagctggcgctccaggatgcaattcccccacataggcaccaggtgtcgctgtgggcttgttgtcccggctacccccaattccaagaacctttttttttttttccctcccccttccctctttctctctctcactccctctcccccttggttgggctttgccaacatatcgagatgcttttcgccggcttccatcactaacctcccggaggtcatcaagccaaatttatgagtggccgctcgagtcacgtgactctatttaaggctcccttatttgggaagagcgcataggataaagaaagagatatctccacctataaattgtccactttggagaacaaaaaacccctcaacttcaaagagtcacaaatcacccttaatcaaaaagggtgcagaaatttttttgggccctccccgccatgagctcctacgtagccaattcattctataagcagagccccaatatccctgcctataacatgcaaacttgtgggaactatggatcggcctcagaggtgcaggcatccaggtactgctacggcggattggacttaagcatcactttcccaccgcctgcgccttccaactctctccacggggtagacatggctgccaacccccgggctcaccccgaccgccccgcctgcagcgccgcggccgctccgggacacgctccgggcagagacgaagcggctcctctgaaccccgggatgtacagtcagaaggcggctcgcccggcgctggaggagcgagctaagagcagtggggagatcaaagaggagcaggcgcagacagggcagcccgccggactgagccagccaccggccccgccacagatttacccgtggatgaccaaactgcacatgagccacggtaaactttaggacttcattttgcgctctcgggtccgcctgggttttataggccatgcggggcaaataaagaaaaaaaacctgcggccataaattttacgatccaggcatcaatggctcgtaaaactgtccactaaaaggcttagaggctgtgtgcgcccaaatttacgacgacataattggatcataggaacaaaacgtgtataaaaggcaatattcaatttttgggggagagggagggagttaaaaaaatagagggatctgaagggtgaggagcgcggggctccagagcggggatccccccgcggctccctccctccctcccctgcggagccggctccgccggcgcttgcggctccggaggattccagcgactcgggaggggcgggaggggggtccccggtgctcggatctcgagggtgcttattgttcggtccgagcctgggtctccctcttccccccaaccccccctcagcccctccggctgcagagtgaaggctgcggtggaaagtttcctgcctgggcggaggcgcctctcccggggctgggctgggctggcccgcctgcggcccgcgtggcctgtcttgcggctctcgcctcctctccctccggccgcgggtgggggcctgggctggggtggggacgggggaacgctgcaagctattcaccccttcctggcttggggtggggtttatgttccagagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggactaaagatgcagtggctcctgtctgtttggggcatgtattgggtaaaattgtctaaatgggctgtgagatgtagaaggagacccacaaactttaagccacccctttaaaaaattttctagcttctaggggcagtgagtagagggaggtgaaattgagctcctttcctgttccttggctgcaacaagagcctctgggggaagagaagggcacctaggcctcgagtactggcttttcccatgctgtggctgtccaaggccttcacgcctctgcactccaggaggcctctggactggcagcagcccccactgtgtgccaaagctgcggtgcaggaaccagtggctccaccgtgctcagccttaggaccttctgggcctctgaagatctttcctgggcctaggtggtccctgagaggccttgctggacatagagggagggctgagccctcactctagggacccatttggtctcataagggcctctagagggaggtggtattgcttggtaagggggtgttgggagagttggaggaggtgtgcctcagtatctaagatactggggaagagggagcagggaggacaatctgcagtgtgtatcagcctggcaggaaatgttcagactgtttccaccaccttctagggcctcgggctatgcaggacaattaactgggaaaggagctgcatagaccagtgctggagtcacgtctgtctgccatcatttatctcagtctctgggattttgtgtggaggggaggatgggttaaaagtgggggtgggaggaggcagataattcaggtagtgtctgaggatcaggtccttctccaggctcctgggatgggctgggggaggaagcactttacagtagaaacaaatgtgggaagggtccataaaactttactgcatttcctctcccacctcccacaacagggtgatttcctggagccaagcctaggccccccacactggtggggtgagggtctggagcttggctaagggattgcaccagcagccaagaagaaaggggagcagaggggctctggggaggggcaggggaatatttatgattattaatgctgatgctccttggatttattataaggactaacttcgctgcatcccactgcctaagctacccatcagtcattttttaaaagacccaagagcctttcctcaccccatgcttggcacataggcagtctcaacaaatgcttattgaacagtgcccacaactaccacccttccccttcgcactgcactcaggccaggttagggcgcctgttgtctctcctcaacttgcacacagcagttaacccagaccagtgctctctctctctctctctgaaataaaatgtgtaattttcttcagggagttattttaattttttctccatgctgagtaaaactattgagtgagcagtgaagcgtggagaagcactggcgtctccggtgggtaacagttaactaagaaagaggctgtggcacccgcacccacctgttccagcctcccaggctgcccaggccctgtgcttcctccccaggggacaggcgcaccaccccaggggaaaaccaagggctttgtcatagataggggcaatgttggttagagctgccaggcagggcacaccagccccaccgtgcactgactgcctcctcccggcagggtttgggcctctccttccctggaggagctgaaggtctgactcattttggcttgggtagacacagagtgcctgcctgccctcctccttcctgtcacaatctgcaggtctgcccaggcaccagccttggcttctgcagcatcgtcgggagtcagcggcggcaaccaagccagaggcctcgtacctacttccctacgctgagggtgcataaggcccagatccctgatttctccctgaacaggggcttctgctttggggcctggggtagtttccccaccagccagcctcctagaacatatttccaggtaacagggtctggcattgctctgggggagtttatggaggggtcttctgggttgcaagcagagactatggagcctgcctctccactttgccctggaacccaccccctctggcagcaagaaagaaggggaagaagcatgacttaccttcccgggggagtgggaagaggggggacacggcccactctgagcaattagaggaaagaggaggaaaaaataagaggacaaaaagatcaacacgacctcgaaggcgacaggtccttatggaaataagtaagtaaataaataaataaggatccaccctctcccccctctccaccctgcaagggggatgtgggggtggggcaaaggaacagcaccagggctttttagtgtaactgagcattagagaaataggcatgcttctatgtgaatttaggagtttgaaacttttggaggttatttatgtgaatagcctgaaggcaagcccgtgagtggctcttgggggaccacgtgatatcattaaaccaagttttatggtgtagggagagctgacaaacccacaatatatttacatcatatataatcttaactgtccagccacgcagctgctggtgaggtttaatgctaggacagagggcctggcagttagaggggattacggcgctggggacgatggtgagagaggttacatcttcgcaaatgaatcccaggcgaacgctgtgagttaattctctctttctctctctcagaccctttctcccatttacctaaccacccccctcacttgatagaaggcagctcccacttattagggggagggggaaaaggccttcccaggctggggtgggagaagagaagaagcagcagaaaaagctgctgggaagtaggaagatgggggagcttgtctaccctgagcagccctccccttcccactccttattctctctgactgcaagtcaactggggtagagaggccttggttgtttagagatttgccaggtcttcctgaccctttcagttgagaagaaagcaagcggcagcaacaagggtgtttggtgtctgtacgggtatgtaaactctagacacaagctcaaaatgcctctggggcccactgttccagggaggggtgagttcagcccttggccagtggcccaaggtgggaaactggggagaaaggcagggaaggagggttttgtggcttctacgcccacaggctactgctgcctgaactggcaaaagtatctcaaaggtggctgtttgaacccagaggtcccagagtgccccctccctccctcactaccaggcttggatgggcagctgtctcagcctccgtagtttggcatcttagtccgtctgaagccagtgtggtttcatgcttcctcctctccttctagctgcttgggtcttcctggcattcccagcccttgcctgagataaaactaggctctaagagccctagaggttcctgctgtgagtggagtgtaattgtgtgttgaatgggtgagggagcagaggcaatgtctttgctaggctgggaaagtaagtcccccaaccttaaggacagagtagcccctcggggatggagctagcagggcccaatatgagcactgcaccctggggtcaatcctcaggctagggcgcccttcaggtttctaggaaggagcagcagaagcgttgggcatgagaggcacatgtcttccacacctgcaattgctatccctccctgtgcgtcaccgggagctaagccaggaaagtgacaacatgtgaattcaggctcctgtactggccagccatgaatagccagggctttggaagcagggctgaatgccagcggacccataggtgcaactcctccaggctgggagaaaggggtggggagcagagggagtgagccagatatgcaccttccagaaggggagcatgcctggggagcagcggtgtctgggcatctgctttgtggagaggtgctgttgggggatgaggagggaatgctgttagcctcgcccccgctgctcaagggactggggaagaagcgagaagcaggcagactctgggagaaggaagggggcacagaggcccaaataaatggggagtcttagctgagccccattcttcagtctaggggtctctcacttgcatgaggagctcgggaacccgacatggaggattcccttgacgccatccctcagggcctcagtctcggccaagattcagcctcccccaccctcctccctgatacctttattttcctaggatcccagggaattctctccagcaacgcattggaaaaaactaattatcagtttctcccttcctcattacccgtccttcttggctctctccttccctctagtctgtgattttgagagtttctggaaactttcctatccaagcagcggagacatgggagtttctcttggtctgtaacttgactcttccccaccctccagcctccccagggctctagggagcgagtgcagtggtctttaaccgggaatttagccagggccgaagtcccacacccaggcaagactccaccctgacacccgccctgactctcggccaaatctcagtcccattcccttcctctctgtgtagacgggcattcgagggtgtttaaagatttacatagcgtcccttgagccctttgatgacttcttcacccccttttctgttctttaggctcaaaagttccatttaaataccacccctcttcctgtgataattgattctccttcccctcaaatagtttgcctcagttttttactgttttctaaaaagtttctagttccacctggaaacagggcaaacgcaaaggaggcctgaaattcttggttttcccacccactaccccaaaccctaatttggagtgtctctggagcggagggtgggcaggcaatcaggtgccaagctttccagccaacccgggaagcttttaattttgttcctaggactttaacccaaggagaggtcaagcaaccaatcagaaatgcactaagcagggtcacatggtccccaccaaccaatcagcaaaaactacttgggtctctgtctcgctcttcccatccggccctgttccttcctccctccctcccttcccaccacagccttagctcctgggtttatcctatctcagatttggaaggctggagtgatacccagcatattctagcctcctctgtcagtccctgaaccaactctgaggagtctttggcttgtctcctcagttgcttacaaagttgtatctgggagtcaatctcaaatgcacaaggatgtgaagttgtgggggcatcctctggattattcccacgttcgccagcgtgattctacccaattttctgggtgttgtagttgtagactctaaattagactatagagcaaatacagatatgaactccagccctgaattcaaattctggctgtgattattccccatacacttacaagtattcattctcttctgattttcatgagggcaggtggggtgagaggagagcccttttgatttctctttctggaaatgctccaatagccattagctttatcagactgcctcaggcatggttagggaagggagcaaaagtggagattttttgaaagttctgattggtacctttcgtttgtcgaataactttgagctagttaagggttctggaaaggaatgagcacagagaattccgactttcctcactctccacattaaatagttgatggatttgtttaaaccccttcccttccattcttttaacaggatataataatagtaataataataatagactaggtgatgatcctatgtcctggccaatagccatcaaaaggtacagccactgaaggtgtggatttcagtgtttgagtttacatggattaggccaagaacaagcaataggcgagaaactattgctgagtaagagcatctgatggcacagggagtgcacagctatgacagaaatgcttgtgtttcctgaacacttgggctgggccctgagccagtccactgctgggtccagacccaggtattctcccccagccacttctctagagctttgtttcagagtgaattttctggttgggttctcctccccttctcttcctgatctcttgccctctttgagctaaggggcaggagttctgatggactgtggcacctggacctctaagcacccccctgggggcattaagagtacaagaatgggaaggatagtccggactgagctgggctttgtcaacaatcccctcattgtttgtcttctggatggagctggtttggggacaatgccacaggccaggtgggaaggataaggatgagaagccagaaaaagagcagctcttctcagaaatcattgagccctcacttttcaagttaccttcaaccacactgctccatctgcttattttgagactaagtttcactcttgtcgccccggctggagtgcaatggcacaatctcggctcatcgcaaactctgtctcctgggttcaagtgattctcctgcctcaacctcccaagtggctgggattacaggtgcccaccaccacacccagttaatttttgtatttttggcagagatgagatttaatcatgttgcccaggctgacctcaggtaatccacacgcctcatcctcccaaagtgctgagattacaggtgtgaaccaccgcgcccagccttttcttttcttttcttttttttttttttttttgagatggagtttcactcttgttgcccaggctatagtgcaatggcaggatctcagctcaccgcaaactctgcctcctgggttcaagcgattctcctgcctcagcctcctgagtagctgggattagaggcatgcaccaccacgcctggctaattttgtatttttaatagagacagggtttctccgtgttggtcaggctggtctcaaactcctgacatcagatgatccgcctgcctttgcctcccaaggtgctgggattacaggcatgagccaccgtggccagccccatttgcctcttttatgagttagaattaaaggacacacttattcttccccagtgaatggtgtggcagattgttggagaccaactctcaccctcaatgtggacttctcacactggggtaccagatctcatgaagagttaggaaacaaagacagggggagattggttctatccacacaggcactgggaaaagagattttgtgagtgcctcgacccctccttgtgagtgcctcaaaaaggtaaactttctctttttgactgtcgttctctgtaactgctttggactgagtttttgagagggggaatgctgaaacatcattgttctaggatttaattaggtcctttttgctgagaagacaagcaccaccaccctgagcctcttctttagtgggactagggcccctgaagccctttgaggtgaaggagaaagaaaatctgaaatcagggtgccaaactagggttttggggtgaatgattcaatttaaggagaagacgatgctgtttgagagccaagaaagtcacatcctttcctacccctcccaacttttattggctccttgtgacccacattggtgtgtctgtactgatactatctctgctagcagctttgatggggctccaggagcccaaggaattgccagacaaggtctgggttgaggaacttcggtgatacaaatctctttatttttgaggcctacacaacccttgtaatcatctccctctcccaatcctaaggttcactgagaggcaaaaggggaacagagatacctcagaggaagcggtatgggtgtgcaatgtgggacttgggaaaattggactcggttatgcaggaccttgttcagcctctaaggaccacattttagcagctatgagaagaggttgaacacttgggctgggccctgagccggtccactgctccaggcatgctggggagcaagtgcagggagaaggctgcttctctgcatctgtacacatgtacagagaaagttctacagtgatctgcaaccccatatgggctgggtgaaatgtgtagcctggtcacctaggatcctttcagttctgcaccacaggtctcagagaggcagttcaggcttggttctgccctctaaagattctcatttaccccagcccctggccctgaacaccagaatacctgaacacacagaaacacatatatgtgcccaaggatggtatggtagaggtcagaagcctgggctggacacagtaaccagcatggaaccaacttcccactcctccctcccactccattcttcccgtcagcccagcttggaaaccatttgtcctccccaccccacccccacccctcaagccctgcgcagctgttgagtttccttccttctgcctttctggaaaactcaaacgctagagctgactccagggatggtggcagccaggctttctgtgatcttcagtgttgtgttggcccagattgagttgtcaggagttgaagagacatggagggtccaaggaggccagaatcttatctgatctaatccccctctccttctgttccaagctcaaactccaaactcctcagggctcccttgctcagacattagagataaatcttgtctagtaaatacttcttttaaaagtcaactttctggctggaaaacacaggctgtgtgtgtgtgtgtgtgtgtgtgtgtgtgtgtgtgtgtgtgtgtgtgtttagggagtagtaagggtcaggtctttcattttatgttgtgtctctccccatcccctgggtggaggatgggggcacaggctgaggttttattgagggtgcttttcctgttgggagtaaagacagggtcataaacgcctagagtagggtgttttgatctggtgacttctcaggaagtagcatctgaggttttgctttgtaaatcactctcccccaaagctggcttggcagattggattgcacttccccaagcccacctgaggcccctcctttcctcccttccccagtaaactaaaggagaaatataacagagcatctggagtcttcaaaatcctctgactccaatttcttttttaaaaggctaattggtgatttttttttccctcaaagttttcccctaaaaaataatgcaacgtttcatttccttttgcccatgcagtccctggtcccccaacccctcagtcacaaaggaactaacattgacagtaaatagcctcagagcctggctgtagatatcaggactcttctgttctggggctgatctctccctgtcactctttccccaagccccaaaccccctttgacaaggtagaacttcagatgtataagacagagttcataggagctaggaataagaggagatggcagcggggcataggggaaccccatcgtgtaccgcatgaatggaggaaactctgcagtctgtcactgggtttttttgtaattaagatgggtgcaggggtgtgtgagtgtgtgtgtttgtgtgtgtgtgtgtgtgtaagcccccagccttctcacatctctatgtaccaaacaaacaatatattttacctaaataactccatttcctaatgataatgagtcttcccctcctaaggatcccccaccccctggctggcaagtccctcccttgtgcctggggctacagagctgaaggaaaacaaagttaagagccctctaattcagccttagttcaagccagatcaggtcaggaagctttcaggcccaggcatcagggcttatattcattgccagcaaaatgcccctatatgctggaaatatgtcatagattatatgagttccgggccctcttagcacttgcgaagtctctagtccaccctcatttctttctcagagaagcctgggctgggataccccaaacccacaagcactagagattcctcttcattcctaggactccatgcaaataatcttcacagagagctgagcgctcccatagttatatatgtgaaaacgtatttatagatcgttctatgtctatatcaggatgtatgttttatattcctttttgttccacatttaaatgcagatttatagatccatagtgaacataacagtcctcggtcaaattcctgtgtgcactttaccaatctttctatagtggttggatgtatatgctaggatgtattggtacagctctcttgaaacacctaagtgaatatttggaaatttttttctttgttggaaagaactatgtgtgtgttcaatgtctattttgaaaattttatctagatttatgcaaggatcctaacccataaaatagctacatattgaagctacatatttagagatctttacagtctttgcatttttgctgaaaaacttacatgtttgaacatatgtttagagatggtttcataatgcatgcatctgtgtataggggcatagatctcccttctagaaggacttaaacttactgcatctctctgtctccctctctatctctgtgtctatgatataaaaagatattaggtgagtgggggtagggaacaaatatattttggatgtttggcttattaaagcaagtaattctgtctctatttctaaggccatctccaaaatctagtcccactaagttatctgtccctcgaaaacctactctaggggtcatagactgcctccaggctgcctctgtgacctgagatccaagccgaagctccctacctctcaaggtagccactaaaaagaagggggagagaagaaaggggagagtcctccagcccagttcctgttggatccccagggcaagaggctgacaggggcttgtatatctccctacaccccccactgggcctttgaaatgtgggggaaaaagggatcaagtccccaactgtttttatagggtgcccaaatgatgccagggttactgcacaacccataggttcctcctccccagttgttctcggtgcccagggcccaattaagcggccgccttgcgcccagcagccccgctcttatcggctgggattgatgcctccgcgtctcctgtatatcatttccaagattttttctgtccaactcctcggctcctttggcttccgcggctttgactaatgattgctacagatgccaacgtctccagaatcctaatagccaggcaggcggactcttatttacccggcaacattgctgtgggggagggggcctgggggacaagtattggggtgtcgtaggtcaggggacagggagaaggttgtggccaactcaagtgtcactgaacttcttcccagtcagaaagacattcccaatccccttctctccttgagggaaatatatatatatatatacacagttaatggtaactcattgctgcctcgttagaaaagatcaaagaatgaacacaacgtggtagaataagcagagcaatgtttatttgttgtaaataaatgagagaataagtggaaaaccagcagtttggggaggaaaaagagaaagggaaagaagtcagccacagtgggagaaggggctccttttcttcatttcttgtcttcccctttctctccccaccctaagtctacccttctcatcaatttctcccctctttcccttccttcgcctcaccttcaatcccttgggtggaggggctgaacagcgtgttcccgggcggaggtgcgcgcagccaccccaggctgctgccaggtgcccgctggggctgccagggcgaggaggcctctgggctgtggagcgaaagtcagatccaccgcctactgcggggtaggggccgcagtggggaccgccagccctgtggtccctctcgcgctgactggcgtaaagttgtggccgaattcgcatctcttctggtgcttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagccggtctcccgagcaccgcggcaggaccatttcgttggaatgtagggcgaggccgaagcccgccccggacccaggccgcgaggtgcgcgccggccgccgaggggccgcctgtaaattacagcccgccgggaggactcggaaatacacaaaaggagccgaaagatttaaacagtcggaggcagaggcgtcccgaggcggccaaagcggaaatcaatcacgtaattaaaacagggaggggacgaagcccaaggctgggggtcccgggttcggaggaggcggccaaggtgcaggccgaggctggcgagcggcttagggacgtggctcgcccgccaggaccagagcgcgcggaggggcttcggggaagtttataacacatcgctattgattcccgcttggctaggaagagcagactctggtgccctctcccaggccagaccctgaagcctccgatggccccttctccgactttcccgtttttgtggggttgagacgcgcagttgcagttgaaggccgctccccagatcccactggtgccacgattttgccaaggcaagtttgcgaacccaaatggcatcaagatgctgcctttgggtttgaggggatggagggaggtgacaccccagtttcaggcactaagaaatctctctcggccttgattcctccaacccaggattcaaagcatgcccggaaagactctgatctatgggccgaggcttggaaggggtgtgcgaggcagacggggttattaaagggagagcttggggctgagcaaactggacccctttgggctggaaaggagaaagaacagctcctggaagagaaaaaaaggcacaccgggagctgtgttttgtgaggggaagatcttattattgaggttaatcatggtaatgatctggtatggctgggtcagcccaggagaccgcgctctccaaagttctttctcacagaggtttctctgggggagtcaagggttccccaacttcactatggttggggaaaataaaataaagacctccaatcctctcctctgccttttcctctccctcccttaaaaactccagaaaaagggaaaccttataaaatctccatcaccccacttatttttccttggctctctccagtttactaaaatgcacggtctttgggaattgagtttttctggagcacccttcttgtgaagcaacagaggtgacccgaccaagtcctcatgaattctgatgctgaccctggagaggacccaggattcccttgcctactgtagaattctctctctatccttagtttttcccagtctctgccttctttggtcttgggtgcataatctcatgggtctctggcagttcagaggccaagaacagattaaggcactttgagataccctcataaactcttaaaagtgtttccagcttcctgtcatctctttaatactgggagtaccaggccagggacccctccataaactaacctaaggccagcctgatttctagatcttttcaagccacatttaggttccttgaaaaataaaagtccccctccccagcaagaaattcaggtcaccaacctgccgcacagcaaggttcctgcatccacacatcagaattttcaacaacaacaattttcataataagaagtaaagcttgcatcaaagttagcaagggacaccccaaaccaaattttaaaaaggatatcatccagcagtcttgaagaggggtgggggtcaatgaggctgggatgagggaggaaggtggtggggaacccaacctctaactaacaatttctccagcataaaaatgaaacatcagattcgttagcccagggccttcatttttccccttccacattataactagttattgaactcgctggaagatctaaaggccatttgcgaagagacaaatttcaatggagtttccccatcaataaccccatggcagtgaactattggaacaagtcaaacacccgaggtgaaatgcaggtcactctgtctaaccaatattaaaatgcggccactttttaaaaagccactttaaacgagatttgaggaaaattgaattccaaggaaggcaaggcaaggcaagagaaatccatgagaggaccttgcctaaggtctccaaacaaacaagagaaattcatctttaatattttaaaggggggcaaattaacattccatgattgctttttttttttgagactataagcgattccaggagaagaaaaaaggttgagtattttctggtgacacatccaggttattaaaatcattttagaccaattcattacttttactgacaagagatttaagaaaaaatcaattaagatttgcatattcttttgcatacattagccctggctgccggcattagaaagggacaaacacatacacacacacacacacacacacacacacacacacacacacacacacacacacgaaaaaaatgggctatgagccttgatttagttttgggttttcaagttgcccaaaggaaaaaaaaatcaaagtgaaatgaattgcctgattgcataccatctaaaattcaatttatatgagtgaaaggaaacagaaatgttgcaatttttaatccctaaaacaacaacaacaacaacattcacacacataaaccctgcatttcaaagagtagggaaaggaatgaccctcattttccttccctttgccctccaaatcctgaattggttcacccatttatttttctcccttggaaaaatcagagaggggtacgattttaatgcagcagagaatctatggagccgctgagctctctcagccggcagcttgttactggggaggggaggaatatgggttatccaacggtcagtatggtaatccaggcacaataaggcctcacacacaatggacacatatttttcttcagcgatgtcagaagggaagcgctttgtactgaaacgtgtttccgaaagagaaaccaaatcgagatttagaaaggagatggggtggaggggcaattgcagagagcatttggatgctggcaaaaggtagtcagaaaaaataaaaataaataaaactggggcaaagtgaggttgaggacagggcagaggtgcagcccctgggccagcaaggcgggaggcaggagggtgaaacacaaaagaagacaggaccagatacaaggattcatcacagatgagagctgctttagtacccccaccccctcccaattaagccattgctaagtgcaaaagcccttccaacggattttatttctgtgcttgtaataatatccaggtgaaaatgtttgtgtgtatgtgtgtggtattttacccatgtgacaggcgacttccttgctattaagctataggagcccaaagagagttgctgttgttgttttgtaaatgatgtagatgagtgtgggcacatttgggggaatcttggagatttcactttctggatgtgcatgttgaattagctgcacgaacctggaatgaaaactctacatatttatagctgcataaagaggcatttaatatattaataaatattaatagtgtgcacgcatatatgttaaccataataaccaaagacagacttgacattcagttgggggcatctgaaccctctgtgtctactacttatactggcccaaagtcagtctccttgacccccctgcagaagctcagaaacctggcgggggtgggatgtgacaggcaacatattggggaggactccttaacaagtacaggagggtgaagattgaagaaaagagggttagcgtcagggcacggatggtaaaaggtgagtgtgagggctgagaggatgagagtcaggctcacagctcacctttccaggtgaggcagccgcatccaggtacaggcctagaagggagactgggagtggggccgggaaggtttcctccctcttcatcaaccctctccacatggcaccaaagtttgctgagctttggacttcccggtggagccatctgggactacagttcagacttaggtactaggattcagcactggtttccctttgccctcttccagcaatttataatgaacccacccccaccaccaatgattaagacaaccccacacaacccaaaccactattaaccaagcagtagccttcctccgccccctcactcacagtctcaacttcctctccaaccaaaccagcctgtcctcacatgcagagagttccggacaagagtgggcaagggttctcagccaactctgagaatttgggaatctccattagaggtgttcagcctctggggaactcctgttccttcacctggcctggttacagtggggatgggcactgtcctcttggagagagagtattcagggaccaccaagcaccagctccttgggagctaagccctggccctgctgagcctggggtggggctgggggcctaagcattggaggagggaaggcaacgagggcccaggcgggaatccgcaccctttgggcacggctgtgggtccagcttccctctcattccagccctttggggaagccctaatttggaagtggggaccctctccaacatcccaaaggtgatgagaaaaggattggaatctcttgccttcagtctccctctcacaagggctttattttttttttccctttcccctcctcattcccttaattgcagatgttctaattaaaccctcaaatagttgttatgccgttttaaaaggtacttattcaagtgtcaaccaggctgggctgggaggaggtagcgtagggcggcgaattaaaggtagattgactaatcacggcggcgatcataataataaaatcagagggaaaaaaaatcacattacgacttttcgtggaaaggagggagcaggcagccagcggccgccagccctgcgccgccgccgacacaaagagtgcgggcgattccgcgagactgatttatgacgttttacagccctataaaagctgtagcgacgaggcaagcgctcctaccaccgctggcagatttagtctaataaataaaacataaacagttaactttatgtgtcacttttattgttatcaagtaaaatatagctgagccctggcaagctatgattttaaactataattgttatcaagtacaacaaggggacccggctccctccctgggctctcccctccgctaccccccgcaactctgagttatgggcgatcagttaattggaatcggtggcatgacaggaccacccctagctggggggggggggtggtggttaggaaagcagcttttcctggccccctccctcctctacggccctgtcacccccctccatcagagtattactgtgagtgggtggcagagagagagcagggggtgtgaatgggctggagaccccaaaggctggccgtgcctccccaacttggtgagcttagccttccgtttttggaaagcagcctggagctggcctttaggaattcgtgtttacatgtaaacacacgtgttacatggatacagctcctagccagaagcaagcaggctctacccacacaggcctccctcttagctaggtctgccctctgtggggacagagaaagaactctcaggatcttggctgggcaccatcacagggcactgactcctggcagaaagctctcctccttgccccagctccttggagataattgtcagaaaatagcaggccgggctgaatggggagtggaaacagaagccagcagtagaagagatcctctgctctggggctggggcagggagggtcagtgggtagcaggggaaggcgagacttctgaactctgcttttgccaaccacttcctgtctctcttcagcgggggctcaacccccagacctccagaaatgacgtcagaatcatttgcatcccgctgcctctacctgcctggtccagctgggaccctgcctcgccggccgcatggccagagggttgggtgagtgtgtatggggaagaggggctggactctggtatccttggatggggggcactccaggctctccagcctcctcggctcagcctgggcccctccccatccaacatccactccagtcctcattcaacttcctcttcctgcgaaagaggggcgctgccccgtgacctacacagactgagacacgatcgccatgaatggagacctctggaaaagctcaggagccgaggcccacggggcccagcagaggcctgaggggagaccctgggcgggggctgaatcactgcctcccgacagtcccccaatgcccgggctttggaggggagccgggagcttcccatctccttttgcaggggagggttgtcagtctggcgggatgtgcactgggggcactccaacctctgctagctaaccccacatcaccacccacccccgcctcccagcaccaccaccaccacacacacaaaaaaattggatacattttgaataaagcgattcggttccttatccggggactgggttgctccgtgtgattggccggaggagtcacatggtgaaagtaactttacagggtcgctagctagtaggagggctttatggagcagaaaaacgacaaagcgagaaaaattattttccactccagaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacgggtaggcaactttgctttttgctccccccctccctcccttcttccctagcgctccccaccctcctcggccccctctggcccccgtcctcctttctctccttccccctctctctccaggagcgactctgggttagcacaattgaactggatttacgagcgagaatgggtaattacatcccccataaattttatggcttagctactctgggcagtccgagccatgtgctacgatctgttatgtatgtgtgaaaactatgctcgctttctaagggcgcataaataattcagtgtcgttacaatgaggattcccctcttattacactacaaagtcttcagcttccttcaacttctttataacccatttaagcttgatgactttatttccaccactccctcctcctgtttctcagagctgaggatggggtgagggtggggggcggggagcctgctgcctctgaaccccactatttgcttttcccctccccccagtgaaccccaattataacggaggggaacccaagcgctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctcttcctctcaccttgtcccttgtcagttccaaacagacaaaacagataaacaaacaagccccctgccctcctctccctcccactgttaaggacccttttaagcatgtgatgttgtcttagcatggtacctgctgggtgtttttttttaaaaggccattttggggggttatttattttttaagaaaaaaagctgcaaaaattatatattgcaaggtgtgatggtctggcttgggtgaatttcaggggaaatgagg

SEQ ID NO: 36887 - DNA, 78174 bp, Homo sapiens
cctcggtggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaaggtaagtgactggccagccccagcccatcccgctgctcaggggggaaggaggcagatgtggaccactgcgcaccagctgggaaaacggaccagacgggcttctgagactacctgaggctctcggagttagaaaggcttgggttcaagtctcacctttgtcacttaaccagttctgtgaccttctgttgcattcccatacaaacaagtctgctagttggctctttttaataaaactcgcctctgttgcttcctggatcttgccacaaaggcaagatacttaacctctctgaacctcagtttcctctcagctttagaatgaggaccatagtaacaccaaccttacggggtgatgaggttggtgttattgtttacatagcaaatgtatgcaaatccaggagataatgtgtgtaagcttcctagcaggatgcctggtgtggagcatccacacaaacaatggtatctattattattattattattaatttctatccatatatataaaagcacatactctgtgctaggcaccactggagctacacaaagacaaaaaagggctggacacagtggctcacgtctgtaatcccagcattctgggaggccgaggtgggaggatcacttgaggccaggggttcaagaccagcttaggcaacataaggagacccccatctccattttttaaaagaagacaaagaaggacatggcttttgtcctcaaagagaatataagaaaagtgacaaatatttaccaggcacctactatatgccagacattgtgctaaatagtcagtttgtcagtaaatatttgttgagtgtctactatatcctggccatgggggatacatgagcacagccgaacccacaagtgtgtgtaaagcatgattccactctcaagaaccaagaaactaatatttatttagtatccactatgtaccagacctaggcacttttaattcattcatgtggcagtgatcctcagcacaacccattgttttcctgcttttatagatagggaaaagacactgtgaatagttaagaaatatttacaaggttgctcagatatgactggcagagctgggatctgagctcctaagtccatgcctttcttgacgctgtgtggtttcccacagtccaacccagtaggaagactttcaaacgactagcctgactgtaagacaggatgaaagaatgctgggacctttgggaaggaaagatccattccaccgggagggacttggagaggtttcacaggaggtcacatttgggctgagcctgaggcttaaaggaagagaagagtttgtcagtccaaaagtgggggaagggcattccaggcatgcctggcagagggaacttcgtgagctagagtttggaggcagtcaaatggtagtgggctgggggaaaggcttctttcgtgatgtggctcaaatgtagggttagagaggataggagcttgagaaagggaagcagagactacttcccaaagggtttggaattaatctgtggattcatggtcctcatctagtaggggtcctgaatgagatttttcaaccatctgtggtggaatgagagaaaagtagggataatgtcgtgcagtgttcataaaactaaattaattcaactcaaaggactattctttatttggagactgttgtgtccttcctgtgggggtggggattcaaatgatctttctcctacaaaatatgagtgagaaattttttaaatgtctgccctcagcaaaattacaaagtttgcgacatgctgattgtttccctatttatttatttaagaacactttcctcatccatgaaatctgaaagtctggtgactactgttttggggaataaggggctgatttcagcataatagggatataattaagtggacggttttagaaaaagcactccagcagtagtgggcagggatggtgtggaagggcccaagtggagatgcagaggccaggaaggaggcagctgcagtggaaataaggatgggagaggaagaaatgatagagagctggatggaatgataatgacgagggaagggaaaattaaagtgcctttgaggtttgacgcccgagaggcacctctgtcccctaccccagttaactgttctaggtgcttggcatggatttaaatctctttgcactcattaccccaacttctcagatgcccagaaaacatgtcctaacccctgtcagcctcttggaaactgttgggctaggttaagagcagtggctcatgcctataattctagcattttgggaggccaatgcgagaggattgattgaggccaggagttccagaccagcctgggcaataatgagaccctttatgaaaaataaaaaaaatttgctgggcacggtgatgcataatggacacctatagtcccagttacttaggagactgaattgggaggattgcttgagcccaggagttcaaggctgcagtgtgctatgattgcaccactacactccagcctggactacagagcaagatcctatagaagaagaagaaggaggaggaggaggaggaggaagaggaggaggggaggaggaggaggggaggaggaggaggaggaggaggaggaggaggaatagtaattataggtatggtgtcacgcctgtaatcccagcactttgggatgccgaggcaggtggatcacttgagtccaggaaatcaagaccagcctgggcagcatagtaagactgtgtctctagaaaaaaaaatttaaaattagtcaggcatggtgatgcatgcctgttttctcagctacttgtggggctgaggcaggaggatggctgcagtgagtcatgatcgcaccactgcactccaacctggccatcagactaaggctatgtctcaaacaaaacaaaacaaaacaaaacaaaacaaaacaaaacaaaacaaaacaaaacaaaactggtgggctaggacagccccaagagaaggttgaggatctctatcatgggtcccagacgtttgcacgcattcacttatgagtgtgtccacagaggacatacacgtgcatttgtgcatattcaaccccacacacatatgcacaggcacaccattcaagtgtgcatacacacatacatagagacgaacacacatataccctggcacaaacaggcaaatgcacatgtacacacagacagtgcacattcctagcatgatgtagactcacacacatatgcatgcatgcatatacagaggtaagcacacaggcacatcagatacataccctcctatgcacaagcatgagggacacacagagacacagccaggcacatctccaaaaagcctgtagacatacaaaagcatgcacacggcgtgaaggtccacgtgcatgcacatgcatatgcacaggtctgtggttgctcatgtccttggcagatgtgaatcaacacatggctggatctcagggctaagaggcagcctgccggatccacacacttggactgcgtgctcccttttccaatgctgctgctttgaggccccagtcagaaaggcaggctctctgggctcgggagctcagtcaagggcacgggctgctgtgagccaccctccctctctgagccaggccccctgagtgcgggagactgaggggtttgaggggtggggaatggccgggacagatcctgtcagagctgaaagggccctctcagatcatcttattcaaacttctcatggtcctgatagggaaaccgagccccttccctcccccaccatatggagcccttcatcagctgaagaggtatgaggaggggtgaagcacacaaacttgggtttcaattccaccccacacccacaggcacacatactagctgtgtgccttcgagcaagtcttctccgagcctcaatttccttgtttgcagaatgacactaatcagtgcccgcctcacagaaatgccacgaacatttggtgggtgggttaagtcttttttttttttttttgaccgagtctcgctctgttgcccaggctggagtgcagtgtctgctcattgcaacctccacctcccgggttcaagcgattctcctgcctcagcctcccgagtagctggaattacaggcgcccgccaccacgcccagctaatttttttttttttttgtatttttagtagagacagggtttcaccgtgttggccaggctggtctcgagctcctaaccctaagtgatcagcccgccttggcttcccaaagtgcgggaattacaggcgtaagtcaccacgctcggcaaggctgtgtctttaaagtgcctgacatggagtaggtggtcaatacacatgatttgttggaagcagcttccgaaactgtgtactagaggcaccacagcaaagaatgagggttattctatatttgaaaattccagggttagggtctcaggtccagtctgctcctttgccacaactcctcagccctctactttgactatgcctgggtctaggaatagaagtgatccatttgggagatgaaggctgacaccccagaagccagggatggtgggaaggtggcaaaaggccaggccagggctcaggattgctttgagctgctcttgtgttaggggcagccaagggacaagacgtttaagtgtgagatgaacccagtataaatagtccaatacgtgtttgctgtgtcttcccctggaggccagtcagggcccggaaggcatccatggccccttggtacaacgaagcatgcatgagtcagtttctcacccgctcccccgcaacacacagccacacaccccacactccacacacatgaaacacacaccacacacacaccacaaacacatcacaccatacacacaccacacaccacacacatacaccacactcccccacacacacaccccacacaccacacacacacacaccacacaccacacacacaccccacacaccccacaccccacacacacccccacacaccacaccacacacacacacacccacaccccacacacacacaccacaccacacacaccacaccacacacacacatcacacacaccacacacacacaccacaccacacacacacaccacacaccacacaccacacacacaccacacaccacacacacaccaccacacacacacaccccacacaccacacacacacatcacacaccacacacaccacacaccacacacacaccacaccacacaccacacacaccacacacacacaccacacaccacacacacaccacacaccacacacaccacaccaaacacacacaccacacacacacaacacagcacacacacatcacacacacaccacaccacacaacatacacaccacaccacacacacacaccacacatacaccacacacaccacacaccacaccacacacacaccacacaccacacacacaccacaccacacaccacacacacacaccccacacaccacacacaccccacacacacccccaaacgcacaccacaccacacacacacaccccacacacaccacacacaccacaccacacacaccacacaccacacatacacctcacaccacacacacacaccccacaccccacacacacaccccacacccctcacacacaccatacacaccacacacaccacacacaccacagcacacacacaccacagcacacatacaccacacacacaccacacacacaccacaccacacaagcacacacaccccaccacacacacacacaccccacacaccacacacacaccatacacgccacatacaccccccaacacaccacaccacacacacaccacaccacacatacaccacacacaccacaccacacacacacaccacacgccacacacacacacaccccacacatcacacataccacaaacacacacaccacatacacacacacacaccacatacatacagaaccatttctttgatgtattcttttgcccccttccagcacttagcatggtgttatgcacataaggggtgcccggaacacaaatcctccctcatgttactccgcttcaggtgggcatatcaggtcctagagggcactggcttgggaggtgggaaatctgcctggagcgccatctcaaccatgacctctggatgaccttgagagggtcaattctctctcctgtccctcagttccctcctcttataggtagataatcatgcaatatcagagatgaaaaggcccttggaggtcatctattcctctttctctgttcctctctccaaactaccagtgaggaaactgaggcccagagaggggagagatgtggccaaggtctcagagggcatcaggacacagcggattccaatgtggtctgtgtaatacaccataatctccctactcgttctgtggcaaaatccaaacacaacttgtctctggtaaaatctaaaagcagtactgggggaatgtctctacacatgccacacacacacatgcatacatgcacgtatgtgttaacaaccctgccgtacctacccacaaggcttctatgggagttaaagcaaatcatggacagacagtcgtgtggactgggaaggctcatagaggtgaacctcccagtcgtgggccaacatgggatcccatgcttttcactaggcaccatactcacatacttaggtcatgcacatgagtgtgtatgtgcacaagggctttcctgagctcgcccaggcacacattctcaagcaccatctcctgtgaatgctctcatccaagtatgcatgagacttccatgtggctgctcttatacatggcttcccaggcacctgttcatatgggtgtgaggtttcacaccccctgtgcaggctcacattcatgcacacacacacacacactcgcaagtgaggtgagcatgcatcctccttatgtgtgcttgcccataccccagcccctctctgcccccaggccagctctcagcttcccaatctgcctaggagcagcctggcaggatatggggtgaacgtgtgacgatgatagggtgattcagcaatttcactcccagcctccaggatgtctctcctttttcattcctttgcccttgtcatcccaagtaagtccaatttgccacatgcagtgtgtatttgttgtggaaggggcagggggagtatagagaattcaggggttcacatgaatgtatacaaactcctggggctggaaagggacctcagagactcctcgatgccatcactacagagttgcctctatcacatcttaccaaaagaatggccagacacttgcacacctccagtgatgtggagctcaccgcttcctcaggacactattgcagatcccttcgtcagtctgatgtgtgtgtgtgtgtgtctgtctgtctgtgagtggaagtactaatgtacatgtgcacatatgagacagtatatacagccagccacgtcttaattacttgttccaaagaaataaattatgacataagactctcaggtcatggtaaaaccacgtagagggggaaaggcaagggcctatactccatagaaggaaggttcactcgcagggccctttctgcagagttccacagcccactcaaataacctgtcagctgggtgataggtattggccccctatatgtgtgaaaaattcagaccgtggattgtccctgacatggttaattgtaagatgcctagatgctggacatatgctgtgtaactttgaggcacaggcccatgggctagagcaaaataataagttgtggtaaggttattggcatagatggagctcaagagagttgtgaggtggcttctgggtgatctaggaagctttctgggaccagtttttgggaccagagtagaaggcagcttagtgttgccaaaggagcactggacacagagtgagactgacctggatattacgtccacctctgccacatctaggctgagtgctcctgggcctgtcacctctcctcagtggataagacttaatggagttgccagcgagatgatgtctgtaaaagcctgttacaaggtagatgctccattgaatctgaatctgaagggatgatctttggaagaaaagggcaaggagtgttttcaaggcagagtgaggttggagacatgtgagggaagagtcatagatccaagggacttgtcctgagtggaggtgttgggaatgaatggaaatgggaagaggaggaagaacaagagactttgaaatttgtctgtgggagtttgaacttcatgttcttgatgcagtgaaaagaccaaaacatctacatggagtcaagcccttcacctatctgagccacaacttgctagctgtgttgaccatgagaaagttacttcgcctttctcaaaagaagacatttatgccgccaaaagacacatgaaaaaatgctcatcatcactggccatcagagaaatgcaaatcaaaaccacagtgagataccatctcacaccagttagaatggcgatcattaaaaagtcaggaaacaacatcaggagagggtgtggagaaataggatcacttttacactgttggtgggactgtaaactagttcagccattgtggaagacagtgtggcgattcctcaaggatctagaagtagaaataccatttgacccagccatcccattactgggtatatacccaaaagattataaatcatgctgctaataaagacacatgcacgcatatgtttattgtggcactattcacaatagcaaagacttggaaccaacccaaatgtccatcaatgatagactggattaagacaatgtggcacctatacacaccatggaatactatgcagccataaaaaaggatgagttcgtgtcctttgtagggacatggatgaagatggaaaccatcattctcagcaaactatctcaaggacaaaaaaccaaacaccgcatgttctcactcatgggtgggaattgaacaatgagaacacctggacacaggaaggggaacatcacagaccggggcctgttgtggggtggaggaggggggagggatagcattaggagatatacctaatgtaaatgatgagttaatgggtgcagcacaccaacatggcacatgtatacatatgtaacaaacctgcacattgtgcacatgtaccctagaacttaaaagtataattaaaaaagaaaaaaagttacttcgcctttctgagccttagtttcttgctccaaaaaatgtagataatagtacccaacttacatggttattatgaagctcaaatgagttaatatgtataaagctcttagaaaaggggcacatagtaagcattgctcatctttattatttgtacactggggagaatgataactcctaccttatagggctgtagtaaggatcaaatgagaatgatcccaaagcctgttgagatgtttatttgttgttatcttggacaaaatgtgtgtgtgtgggggagtttccttaggctgagaatagccttaagtaattcattctttcactagttcaaccaagcaatatttattcagggcctactatgtgccagacactgtgttaggtcttgaggagataggtaatggtgagcaaaactgctgtaggtcctcatctcatgcagcttactgtctagtggatacaaaatgagtttttcacactcaacccccaagtgccctattggtgggcacgattgatttagtccagaaaatttcagtatatgaaactgttcaatgcgttaacagttttagttaatctagaacctgtgattggccatcccacctagtccttaaggcaaagggatagccatgctgaagtgtgagtaattcctgcaacagcaaagtctggaacaatcttaggctcagcctggaaatggggatggggacccctctgccaaatttgcctgatccgaagctcctaacccttgccccatcagcacaactggtgtgatttactcgagtcatgtgagattggataatatttgttctcgggggtggaagagatggggacgagcattgggaaggtgagatggggagtaggaagcaaggcttcaactctgacttaagtctcttcagatacagattcttactttgcttttagcttctttgatgccaaaaggtgtacaagtgggaggtcccggcggggtggaggatatacttcctatggctatggtggaggttgggggaggcaaaaatgagttggaagaggctgcagattggcaataccagacttctcttttacccctaaagactagagaaagttagaactaatactagctaatatttgcacttgatcttagccaagaggtcaggaagtgatactagctaatatttgtagagcacatactatgtggtgtacactgttcgaaaccctccacatatattaactcatttcaccatcacaataatcctgcaaggcaagctatcattgtcatcatcctcattttactgaaacacagaaaggtttagaaatttatccaagattacacagctattaagtggtgaattggggatttttaacccaggtaatctagtttcaaagtccactatgttcatgtaatctgtgctgcatttctccacctataaaatgaggaggctggattggtttatctctgagtctttccagctctgacagtctcattatatttcacatatacttctatgaacttccaggccaaatgaaaaaaaaatgctgctcccaaatgtcagtgatttccactaaagtccctcgggaggagagtggggagcccaggctcagggaaaagagccgacactggagcttggtcttcccagcagcctctagggcctgagaacagctggggacctgggaagctctgggagccagggcccggcctgcatttccaagtcacttgtaacaataacaaggagcagcagctcaggcagcctctgctgggatttggggtcagaggtttcacagtgggtggaggaacagacctcctcaactccatccctctgggcagcccttgagctgttgctgctgctgctgtcagggcccttagagtccaggtcaatcagcagttccaaggctgaggctgccaaggggcaggggaaaggaagtcctgcacttggggaatgggagttgaggccctggaaatggatgcaggctgactttccctggccctttcctctaccttgggttggttgccttctgggagctggagagaagaatgtagtatgaagatataatgtcatagatggaaataggacactgatctaacagccctggttctgcctcctcttctcttctctaagcctcagtttccttacctacaacatgaggagaatattccccacttcataattgattgtgatgatgacctatgtgaaaaggcctgccacacaatgggtgctcagtaaatatgagttgaatgtaaagatagttgattgattgctctaggtgaccctgggcccatagcttggactctgttttttcatctataaaatgaggaaacatttttacctgccattcccttcattccctggctgaggagagcctagaattggggacatcctgtggaagtgaaaggacagtagaaaacacagatgcgactaccctcagggtcaggaagtgggttgtttaagcaatttcctcattccttctattcccgcccctgctcccacccctggtcagactagtttagagtctggaaaagaagctccatcccacactggaatccccgtgtctctctcctccagccccttcctacactcacccttatagggcgcctctcccggaaagactctgcagttctgggcaggaaggagggtccctgttgactggtgagaaagtcaagtctttgggatattacattcctgagattatccagagaacccctgggggttgcagctgctgctgactctcctccctggccctactcttggcctgctgtggacatgaggactgtagggcccaaggcaggagaaagattgggggaaaggctcaaaggcaaagagtcaggcctggagcagccctgcaggccaggtgaggagtcaggatggggcaggaggaaaggatgtcctggcagcactggcaggaaggaattaaggggaaaagcgtccgagggagtaggaatttttgccaaggggagacttataaaaccatcagcattccttaggctataggttgggggcccttttcgggggtggatgagtaggtattagatcacagtcatcctggtggatagagatggaaagtcaggctttctgagaggccttctgtgaggcccacatactccaagccagtgtgggacagcttgcacccttggggggagacagaggggaggtaggtgttctgggggttcctcaggaggctgtcccagattctgagttctataaaagccttctagaatttattgcttccattgctctttcccagctgggattgttcctcatcctctcctttgtgatagaagactaagaattgtcaggcacctacctctcatttggtaacaagtctgaagcccagcaaagaattggtcaaaggtacagggtcaagcgcagaatgtgtcagtcagtccttcttgaaaccagctctcctctgcccttttcagggacaagattggcatcctccagggctgtagcaccccatccccagcagacatcacatcccgaacatgagcatatgtctccaggtcattgacatggggtttaaaagtggcaccgtgacaccagtgctccaacttaggacctggtggcaggctcaattgagcttcagcccacataccatcctccatctctactcagctgtctctgaactgtgagctgctctaagaaaccagcctgtgtctaattgacccctgtgtcctgcgacaacctggctcaaaacagcccctattctaggcctagcctagagaaagtttgccaagtgcatagaacacacatggactcccatgtacgtacaagtggccaaagccactgcacccaccttccagctgagagaccccaagacagaggagtcagctccagagggctcatgagagcctgctttccacagtggccatggtctgtgctggcaaaactcaggataggcctgggggcggtgagagcccactctggaagaagggagggccaagctgtgaatagggctctgtgtggcccggctgagaaggctgggggaggctggaatgtgaagaacgtgctctcatgactgtggtcctaggcctgggtctatggcacaggactggctaggagtgaggggtggggatgttggaggtggttagagaaggaagggagaggtggggcagagaaaccaggcaaggcaaggaaaaaaagtctctccagacatctcctcagataccagggcaagggctggtcctagagcctggaggctgagcgaagaggatgctggggagagtgagctccatcccagccacttgtggctgaggatggcccggttctggacaaagcttgtccatagcctttgcagcttgtctccaaactacacctctcagacctccctacttctcacccagcaaccatcgttctgtttttatcctccttttggctctggctttcgcatttgcactctttcaacgtgtttcccttttctctgaaaaaactcatgatctgccttttatttttgcctggcaactgtatctcccactagactgagagctcctccagggcaggaatcacatctgcttttgttcatgtttgcatctgcaggtctaccccagtgcctagtggactgctcagagcagatgctccacagacttttttgaattcaacaggtctaaggggaaattcattacaacaggaagatttccccccgtatacccccaaataactttttcctctgttcctgacttcagttaatagcaccaccatccacccagttgccaggccagaaacattggggtcatccttgactcctcgcttatcttcccacatcctatcatttactttggttctaccatgtaaattgtctatatattggtccccttcttcctaccctaaggaccactgcccaacccagaaccttaccactaactctggtctccctttgtttttccttctttctttcttttccttccttccttccttccttccttccttccttccttccttccttccttccctccctccctccttcctctctctctctctctctctctctctctttctttctttctttctttctttctttctttctttctttctttctttctttctttttggagtttcgctcttgttgcccaggctggagtgccatggcgtgatctcagctcactgcaacctccgcctcccaggttcaagtgattctcctgcctcagcctcctgagtagctgggattgtaggcatgtgccaccacgcccagctaattttttgtatttttagtagagacagggtttttctatgttggtcaggctggtctcgaactcccgacctcaggggatccacccgccttggactcccaaagtgctgggaggccactgtgccgggcctctggtctccccttctctagttttgcctaggccccccattcccaatccatccttcactcaacagttagagtaacattccgaaacataaatctgactacgttacctctctgtttaggccccctcaatggctctccattgggctctagataaagtctcaagttcttaagatgacctataaggcccttcgtgatctggcccctaacctgctgcttcagattcatttcccactctctgtctggcactctgctctccagctagaccaaggtcctaaatgtgacagttctgggaaatgagatgaacagacgggtgggacaaaccacaggctttgatacatcctcatccttttctattctctcccttctacctgccaggctctttgcccccttgtcttcttgatgaacaactgcttagctttcaagacctgttctaaacactacttccttcatgagggtccttatgacaatgtgcccccactcccagcaacaaattactccctctgctcagttccacaaggctttatactttccaatagcactcacattgaattgtgatgatttgtgcatgtaatcgactccccctctgagctgagagttcatcaagggcagggaatatgtctgatctatatgaatccctgagtacctagcacaggacttagctctgaggaggtacctaatgaatgagtgaataaataaaggaatatatgaatgaatgacccactggatgagaagattgtcaccactaatcctggtcttcttctagagtggctgtctttataacttttggattcttggcctctgggttcagaacctccaaatcagagggatatgttctacaacaaggaaacaaaaagggccttcactttgtagcagaaatctttgatgcaaaagttcatatgctatcttcccctgtaagtctttcagctaccaaaatagcatcaagattaaggtcaaaagcagagtgggactcatgggcctgatccaatccaggttattctggacctcagagagaaaaaaatagagtgccataaaattgggagccctattgatctcaagcacagacttggttctgacatttaccttgaccttgagcaaatcatttcacttctgtgccccatttgccttatgtgtcacatgaagataataaaatctaccatgcaagatggttgtaatggccaaagaaggtcactcatttgcaacctataaatccctaaatttaaggcctacttatctcctgaactatctgtaattctgttaaaactatgatgggttaggctggtggagtgggggagtaggagatttaataggactagagcatagagtacagtctgtcccacccatcagttcatctcttaatttccaagaactgtcacatttaagacctcacaggggcctgctttgtccttctcttctactctctcatcctttctcattcttctttcctccccctttgtctacactgagaattatattgacttgcttaatcatagttccactttgtagctttgtagcaaactttcatatctgtcgctattggtctttctcctctggtcacgccgatctcattctagaactttttatctccttcacactaacatccctcaagggtcctgccagtgaacactcgggaggacatcccccatccctcctctctcctgtggccaattgtgggctacgagggtggatcagacctttagtcattttagggtaatctaaggctgagacaaatcttttaggattaggaagcattgtggtcaagtgtctgcacctggtatggcagtcattgtgcagagggtaagagatagacacatactatggcaactattttcctgataaccacttggttggtttagaggctggctgtgtgaaaggagaacaggcaagaagacccttctacctctaagaggtacccttctttccttccttctttcttttctctcctccttaactattgaatgaatgtctctacaactaccattttagcccaagccactgacattgtttgcctgaactactgcaaaagcctcctaacagatctccccacttccaccctggctctacaatccacttcctacccagcagccagagtgaccttttgaaggtagaaatcagatcttgtcattctcctgctctatatccaccaatggctgcctactgtaatttgaatcaaagtccaaatccttaccctggccttagcctctcataatttggccttcgtttctctcttcaccatccgcctgaaatgctcttcacctagctcttcacattgctgacaacttcttgccatctgggtctctgctcaaagttcagctctttagagagacccctcaggccacctctctatccccccactcaatcactctctacctcatcctgtctttaaaagtttctccttcttggttcttagtgatgactgaaatttccttatttctttgtttacttatttattgtttgtctcttcctactaagagttcagctgcgtaaggatctcatctgtctagatcactgctatatccttagcatctagcatagtgctctgaagggcactggtattgtataaatatttgttgaatgcatgaatttatagagtgcttaatcattttaaaaagtgcctttatgtacgttaatttgtcacaaagcctgtgaagtcgggattattgctttcctagtcttatgaatgcagatgctgaggctaaagaggttatgagtgatgttcaatgtcacataatcagtaagcaggggaaggtgaccctgaacttgggttctccaattctgaatactgcccttgccaccaacacatcctgtttctagccttgttgatgctataccaaggatggtatgtgccaagcaaatgttgacttattctttaataatctttcttatcaggcctcggaacagtactgtgagctgtggcagagtgtctccaatcccctgacctgggggccttctccattcagggagagtgaagtgaaccagcaggatcagccatggggtagcagaaagtacagttgtatggagtgggcagccaggagtctgggtctgggctccactttgctccttacttcattttccttttctttggacctccatgtgtctttctgtaaaatgggtaatgggtagatcgaacttgctaactttaagatcgctttcagttcagatattgcatctctgcaatgccttgacttcttctctgtttcttttgcagtgcttcccattgctgcaggtgaagaagaacgctggtaagtacacgaggtgggcattgcaagtggcatacaaagagactgagcttctcagtagtcctcatggggcaaccgatcaggtccctgggcagcagagccaacggccgagatgcaaaagccggagacatcctctctgtctccctccactgggcatttgctgtcctcctcgggccctgctttttggctcacgtgcagagcctctttatttctcagccggaggttttgctcttgtcagagagccaggggaggacttccctccagagctttcagcaagtggcagccacccatatacttcccttgttctcaaatgccttctttccactgggaagtgtattaggggtgagagatgcctcaggagagaaaacaggtaagtggagggtaaaggaaggagacttggaatttggggttcagtgtctgttatattcccagcacttgctttatctagaaggcttccaacaggaggtaggctttggagttcattagactgaggtgatatatatagccttttccttttgctctctcacaagtttctgtgagcccaacttcccatcttcctggtgcctctggtgtcctacttgggtgtggataagtggatggcatactgggagcaactaccttccattgagaaggatacagttgtctagagagggataacagctttgtggaggaagagaaagaaggctactggccagggaagagtttggtgctggagcctgaactcctggtatcagctgggctttgctaaggtcatcgaggccatcgtcctggctctagcctgacttcagccattcccattggctccaatttttcatcaggatgagctcatgacttgaatgagcatagcttctaggagacagttaggattggggttgccaaaacagaaaggcatctattaacaagtggcatgctaagggcctgtgcaaggcatcttgggaagacgttggaagagacaaccagaacccttactaataagaaccttccaaagtagttggagctggtttgggcgaatcacgccaggatgcagagagaggattctagtgacttcccaaggacgtttccatcttacggctctgagtttttgggtggtggctgctacaaaacaagaactgataggtgaggggtttatttgcattgccatgacagcagagaagagaggatttattttgaaacaggaacactgctttgatcagcatacagcatacatctgcttctccacttccccaccctgcctttccccgtcatcatcattccaaggcgtcttgctgcgcagtttctgctttgcaacagagacttctgagggcacaaggtctgtgcactgcccatactaggggaaggacacacttctccatttcagagacaccagcttcaaaggctaaaagaaacccctcaggccctgaaatagtgacccccttagatgaatgcacccacagctgccaagttacttctttagaatatctgtgccaggcagaggtgccagcactgagctctgggagggtggcttccagaggagccaggactatcttttactgggtagggtcaggcagaggaggttgccacctacaaagctgagatgggactggtctttctgctatttcttaggttaaagtttgaaaatgtctatttaaaggcaaatgggaacacattgtttcaggctgattcaaaaacaatctgacataaattatgagtttatgtggatgtggaaatggtagcagcaaggcactgggaatcaaagcacctggattttagcccaaatttcattatagattcactgtgtgagcccaggaaagtagcttcctctgtctgggctggcatctacatctacaaaatggagcttattgcatgggactcttgtatggatcacaatagacagcgcattaaaaatgtcaaagtactgaacaaatgtgattgtttctgaaatttaggtcagggggtgagcagaacgcttcatctgttttattacgtattatttgagaaataggtaataccttcacaggtttcaaaattcaagaggtacaaaaatacaaagtctcttctcaccccaagtccccaaccacccagcagtcctcttagaggtgatcagtgttagcagcttcttggccctcgatgagtttagaaggtctgaatcaagtgagctgtgctagatgggactgcgatgggggctggcactgcctgactggcctgggggtggggctgaggggagctgcagaaagggtcatggagcaggaatctcggggcaggaaatatggggtggtagaatcagcattcttttgggacccagtcttgactgtgccactcgtggtggaatgataacaagtaagaggcttcccctctccgaacctcaatgttctcatctgtacattgagcctgccccattctcctaagccatttctcccaagtgtgaccagagcagaacagaagtggtagaggagaggaccagccagggactttttagtgacaaaaaagccaaaatactgactctgggctgacagttgtatataataatttccctctttctctctctttcttttctttctttctttctttctttctttctttctttctttctttctttctttctttctgtctttctttctttctttctctttcttttctttctttcttctttctccttctctttctccttccttcctacctacccttccttccttccttccctcctccttcttctttctcttttttctcctctttctttctttctttctttctttctttctttctttctctttctttctttctttctttctttcttctttttttctttccttccttccttccttcctttttttttctatgagacacggtctctgtcactcaggctgaagcgcagtggtgcagcatagctcactgcggccttaatcttctgggcttaagggatcctctcacttcagcctccttcctcaatagctgggactacaggggtgcatcgccacgcccagctcatcttccttctattaggatgaatcaagcaaagatttatctgacacatcattgcttttgttctagtggtcccactgacagaggaaaccttgtaagggctgtcacaggatcacttggtaccaccttataggagagcattaggaatgtccaactggcttcaacacatgtggtgctgcccaggcccaaaagaatgacctgaattacctttgaagtccctgctatcacagtccaagaagccactagcacagtgtttcccaaatgtcacttatttgtgaaccaacttcagaatttttgccatcacatcatccatgccattaagtacttaatatttttctttaaatcaacctgattttaaataataacctcaccctaagccataatatctatgaaattaggttttgaggcactagttacatttttcctaatatgtagtaaattaaatatatatcatgatgcagatgccaatgtaccaccccaaatcatcctatgccaacatatatatcaaacactgagaaacacagagctagcggtagtaaaaccagcagctcaggaggaggttcaggccttagggactcactccaagacatgctacatgctctcaggctcccagcatcacttcatatttcttccagacccacacaccctgttgcttgagcacaaattgctcctaagatggaaaggtcctggagcctaaaaggaacccgcttcctccaaataaaacccacaattcaaaactgcctcttaagtgctgaagtgagaatacttgattggggccggaagctccaggttccagttttggctgtgacctttgccagctgtgtgtccttgggcctctcgctttccctctctgggccttagtgtctctaactataaaatgaatagcttgctttaaatgacctctaaggtatcttgctgttctgaaattcaatgactccttgacttacaaaccccacactccgcggagctcattagctcgcttaccagcagcccacagaggtgaggaggctgctgaccttccctcccaccgcctttgcaccaaatcttccccaaggccccctgctcccagtgcacaaagctccttttgttgcctggagccattcggggcttcactccaggctcctgctgaagtggctgaggtggcctggtggggtaatagtttgcctgtaacaagagcccctgctcgcaacccaactggctccagtctggctgcaggcttggcctcagcatcagactcatccatcagctgccccagacccctcccccaagctctgagggggcggggagacagatttgaacagtagaaaatggaaacaaatacatttatttaacatgctattgggtgtctgtcacctccaaggctcacaagggcagtagacaaaaatactaagcatatgaaagtcatcagaataataataattcaatccacatcctttcttttgaaaatgaccaaatcatttttataacggagtcttgacagatctggtcatttaacatttgttattttacaaagaacatttgcagggcatggcttatctaacatttgacagatattttacccagcaacttggaatagtataaagatctacttagttagggagcatctggaatttattatcatttgagacaggaaatcttttaaccatgatccacagtgaattcagccaaggtaaaaatgctgggatgtgacttgagagacctaggatctagtctcgtctccatcattaactccttctgcgaccttgagttagtcacctctgccccatgggcctcagtttccttgtctgcaaaatgagaatgttgaactagagggtctcaagattttgattttgcactctgaccccctctcctccagaagtcaggctgaaaggaaggggaggtgggggtagggtcagtggaaagggcaatttcaaggtgttctttgggatggggggaaggatttccaggcctgtggaggagtgtaagggcttcttttgtggcctaaggggctgggaagcccaggttctcagttgctgttttcaagagtgcaagacagaattaggtctaggtttagagagtcaggtcaggtacatctccctaggtatagcctagatgaccattttcacagtgtaggccactccaaatcaggagctggagagggcatgggaacttcaggtggaaagacaggtctgaaaaggacctgggaagtgctactggacacttccaccagaaggtcctgtggatccttcaaactcaacactaaagatcataattctttatcatttctctggaaacctcctctttctccagaatccgctttcttggttaaagcagccccatgcacccagccactccagcaagagtcacgggcgttacctggactccatttttctaatttgctgccatttagttgtgtgcatgggacctcttcataaggcttcctaaatctaccgccttttcttgtcactcacactagcatagccctccatctgggccctagcagctctggccttgatggttgcaaccgctacctaactggtcttcctgccaccatgctcgcccttccagttcaccctccatgctgctgccaaagttctctctttaaaagaaaaacttaggcatcctcaaaaatctttggtcatttcctacctttggtcaaagtccaacttctttgctctggcattcaaggtctctcaagcttagacagcctatctttcttgcttcctttcccacctcgttcctatatttctgagccccatgggacaacttgctatttcctagacagacagtgaattctcatattggactctccactgagtgtgttgttgccagcccccttcttggcctgtcaagccacactctggcctccctttccatcttgtccatagctattacattataaaacatcacactgttctgcattggcctcttttctttcctgtctctcccatagaccatgagctcttggtgtacaatggctatatctgactgacccctggattcccagaactaagcataaggtctcacataaacaatgagtctgccaagaactggcttttatttttgatggcatagcaaaagaacttctggtaatcagactggtgacttcttcctttcagcagactttcttccctatcatttcagctctgaactagctattacagatcaacatagagccccactggctccagatgacaaaacctcttgagacagggccttaaggatccagtggttccagccaatggtgcagatccgtgtaaaacacattttcaccaaactcttgaaatttggaggtcgcccacatctcaaggcaggaagggcacttaaggactatattaacccatgcttttgaaactgagtactgaggagccctagtgtcccctagtgtcttaggggacatgaaaggaagacagagttatgggatatctcattcctgcttcattcaactaaacctatttgactttttgaagtttccatgaacatttcatttggagactggagttggcggcattaaagtttcatttggagactgtagttggctgcattaaatgttggcgatcatagctcgaatctggtgttcaattttcccttttttacctttcctgctacatgcccaacttgagctttgaccaaactcctcaggtatggtgaagcatcctttttcattctatactgttaaaagttctttatattgagccagaatctgccttacaacaacttccacccagtggtcctattttcaccccttggaagtagtgtgttccttcttccttaaggccaatctgctgtcatttagaatctcccaaagtctaaggtaggagagatcttatagctcatacagtccaatgttctcgttgcagctggggaatgaagcccagagaaactaagtgatctgcacaacagcatagagctagttggcagcaaaactgagactagaacccaagtctctactcatctataatgcgctccccagaatctgtcctttcctagctcctaaaatcgtttctcacagtcctgatcactcttcactacacgtactcctgactgacagtgaccaatggctgaagatcagcagctgagcttgtgaaagctccatggctcccaagccttggtctgcctggggagaaggcagagacaaagcagaacaaactggtgtcagaagcagagccgttccctcaccacagcctgaaagtcattctcctcatccttctcttctttccataaaactaaattccattcaaacagcgccccaccccccatggcagggcagccaaggggcagctttcagaggccccttctgacctgtttgctaaagggttcctgctgtgtgaccttccacatcccaagcccagaaacaggaagagttagtttggtttgctttttgggaagaaaaatgaaaacataggaagtagggctcctgagaacagaggcttccaactctgtgttcatttgtccctggagcaggatatttcagggaatacattccacaggggaagggaacagcctcccttattaaaaacaaaacacaaaacccttcaaggtttggaaaaagaaaaaggccaaaaggagacttttaaggaggggaggggcaattgttttataatctccagcccttcacccccttggccacttggagctgtcatactttgatctcactaccattatcagcacatctgttgcccagagatgtcctgctccctttaacctatggcccaagaaagagtccaagtctcctttcttgtttccctgaggatgaccgaagtaggctggcactcagaatcttcaattaaaaccaagaaaaaacagacagtaattaattacacaatgcacaaacagcagaacaacattcaggccttgccaagtacatgctttttgttttaagaagcccagcaaaagcagggaagtgctttgtcagtccccaaatatctcccaggataactatttcatcgtcccagatacgctgccataagtttgcctggctttttcctccctcagctgtcagtcactgggaggcagatgccatcttgtttccctactactgttgctagaagggcaatgcaacaggtcttttaccaaaaacaacaacaacaacaacaaaacaaccttccagaacccctactgttcttttcagttctagtttctgggctgaggaacatggttagttcacagatagttgccagggtaaaagtgtggatcattttggggtgccaaagaaacatatagccctggaaggaaaccagctctgcctacaatctggagcttctacaggtacacatgtacatgtgtcacatgtgtagtgtgcaaacacacacatagtctatttaccaaaattttagtttcatggaataacaaggccttcaccatacaaaaacataccattgtctcccctgaggttatgggtaagcagaacctcttcctagaagatgcttccaagagcatctgcctagaatggcttgtttttttccaaaaagatctggaggcaaaattttcatattaaaacaagcatataattgttgtggaatagcataaaaaattcacatgaattacctgggcatgatggctcacacctgtaatcccagcactttgggaggccaaggcgggtggatcacctgaagtcaggagttcgagaccagcctgaccaacatggtgaaaccccgtctctactaaaaatacaaaaattagctaagtgtggtggtgggtgcctgtaatcccagctactcgggaggctgaggcgggagaatcgcttgaacacagaggcggaggttgcagtgagccgagatcgcaccattgccctgcagcctgggcgacaagagcaaaactccgtctcaaaaaaaaaaaaaaaaaaaaattcacatgaattcataagataaaagtggagacttgaaaaaaaattctcacttgtggttggctgtgtgagattctcctccagctcctcgggcctctgtggggaataaattctttctgttcattggaggtactttggggatgcaaaagtctgagagccacaaagtaaaacagtaggctccttgagggtagaaacgtctcatttttctctgtatcctcacatctgaaacagagccagccacagagtgcttgggaactatttgctccattcatgcatccatccatccatccattcatctatctatccatccttaccaagaaacaagcaaaaaaggtagccttagagtggtggaaagaatacagtttctggaaaattcataaacctctgggtctgaattctgactctgtcacttattagcctcagttttcatcacgtctctaagcctcagttttctcaggtttttttttttgttgttgttgttgttgttttgagatggagtcttgctctgttgcccaggctggagtgcagtggtgcaatcttggctccctgcaacctccacctcctgggtttagttgattctcccaccttagcctcccaagtagctgggattacaggcacgcaccaccatgcccggctaatttttgtattttttttttttttttgagatggagtttcgctcttgttgcccaggctggagtgcaatgatgagatctcggctcactgcaacctccgcctcccgggttcaagcgattctcctgcctcagcctccccgagtagctaggattacacacatgcaccaccatgcctggctaatttttgtatttttagttgagacggggtttcaccatgttggccaggctgatctcgaactcttgacctcaggtgatccgcctgcctcggcctcccaaagcgctgggattacaggcgtgaggcactgctcccagcctaatttttgtatttttagtagagacagcgttttgccatgttggccaggctggtctcgaactcctgacctcaggtgatccacccgtctcagcttcccaaagtgcttggattgcagggatgagccaccatgccttgccctagttttctcagttttaaaataagaatccaaatacccaactcctgagttgatgtgggaccttaagtgtgataatgggagtgggagtgctctataagatcccagacaatacagaaattatagttatttcatgactatcaaattaccaccatgactagcccagacagtagtggggtggggggaggggaagatgttttctccagccagaagtctgatttgagaataagaaagcaggagctgagacctcaggaatgagcccccgggcctctgggatggagagggcagatgttgaatcctagctccagctccacctccactccaggaaggcagtacgcaggccagaggggaacttggggtggagtgatggaaggatcagatgtgcctcatacacttcaggtctccaaagaccagatgtgctttccttctcacgtctgccaataagcccctttgaggcccggtttgcagcaagggtcattcatcactggggctgaaatacaaccaggcatagtgtgttgacttggctgctaacagactctgcctccttgggtaagtcctttttcctctctgggccccaatttccctatcattaaaatgaaaggattggatcgggttgtccctcaggtcctttgagctcctacacgctgtatttaagacttttttgggccttgattttctaaaaatgtgaacaatgtgatttgccaaaaatataattggtctgatcatctgatagttggacactgaatcatggatgggtgaaaaagttcaaagcaattgtggggcaggagacgggcctggctggggccctcttctgtttttaagtctgctggttcctgtggctccttctgtacgtgtctgtgtctggccaaactggcccggctcgcctgaaaatctcagagcaagccaaggttgtagcccaggtagatggcttgtggatacagcaggtgtttcccaagccctgggatccggctcaggtacctcacaagataaaatgaggaaaggaaagaaaacaggaaatcctacccactatatgcaactaattgtttaggaagaattccttctaggcaagcccgttgtctcagaagtcagcaacagctgctgggttggaatggctaacttgtgcaatctctgagattcttaggctccccccaaaccccgtctcaacctgtttagccctctgccattctctgaagctcagctcaaatactgttccctcccactttcaaatccccatcatactgtatatctgtcttatagcatgaatcatgccttgtgttttgagctatttcctttcacctatggattaaaaataaaatacatgttctgagtgaaaattccaacctataatctttcactctcactttccagagttagccgctctgaaaaggttgttgttttttgtttgtttgtttgtttgttttatttgtttttcctttccagaaatcttctattgccaaagctattgaaaatgtgaggttgggcttggtgacttatgcctgtaatcccagcaatttgggaggccaaggtgggaggatcatttgtgtccaggagtttgagaccagcctgggcaacatagggagaccccgcccctaccaaaaaaaaaaaaattagccaggtgtggtggtacatgcctgtagtcccaggtactcaggaagctgaggtgggaggatggcttgagcctgggaggttgaggctgcagtgggccgtgatcgtggcactgcactccagcctgggtgacagagtgagaccctgtctcaaaaaaattaaaaaaaaaagttttgaacagagcgttggctctggagtctaagcacttagatttaagtctcagctctctgcttgttggtcagatcagcttcagcaaattctatcacccctttgaccctcagttgtctgctctgtaaatgggatagacatgtcctcttctcctgtctcacagggttggtgtaagggccaaataagaaaagagattgaaagcaccttggaaactgtaaggggggccctatttatctccatgcttgtcactgcaacttgactgtaagcatctttgaaacagaaacttggcccctcgagggctgtgtccccattgcctcttgttccagtttgtccagaatgggaaggtggtgatgccgggggtatggaactgaatccccagagtcgtgctacacctggagatgctgatgctctgctcctgccctggttctgggtacacagctacttgaccttcctttgaagccaaacccagctgagaggaccatttttctaaagttacttggcttgcaaaatgctgctcctccaccaagtgggcactggcccagcctcactgccccagtgtgctttcattactttgaaaattctgcaactcttgtttcaccccctctacctccttcagctcctagttcctcagattctggctccaagtaatgatttcaaagttccccatgccccccacccacccccccaatgtatgatacatatatatagagagagaggaagtagaaagatgtggccaagaaaattcaattttctgaatggatcagatgtaaaactgttggaaattacagctagaaagctctgcagatagcatttagtccaacctgcatcactccccttcaacctttgacagaagggaaactgagacccagaaaagggaagggacttatgcagggaatttgcggctctgacctccaagtaaaggtgggaaggggcgagactctgcaatttaccaatgcaccgctgaaagggttaaagtcaaggaaactagcctggggaaggtgggtggggtcaaagaagagatgagtgtggccagagaagggaggatcaatcaggagaaacagtcaggaccagctgcaaaattcccctggaaagtggaaatagaagaaatatgagggttgtggtttagcaagttattatgagccttgctgggcaaagagagggaagagagaggaagagaaaagtagagggggcccaaagaggagtaaaaagggaaggaggaaggccaaaccagacgaatggaggagtttgagagtgatagggtcagtgagtgcttaaacacagcaaatcagtagagtcctgtcccatgtggggcatccagctaccttataagttaccactagctctgctgcctggtttcttcttctaggctctgagcacatgagccagtccttactttcttagcaaactcagcccttttccactgtccactgtttggagaggcagttccagactgtaggctttttacttcagtagagttggcacaccaacacaagggcactgtgcagcctggcctggctgccagagcaggctctagatcccccactccacagtcatgatctgattttagtcacacagtcatactatgagttgaactcagcccattttacagatgagaggtgcaataattttcaaatgaaaacaacaacaataagaataaacctaagtatatactgggaaacaatacacgtactgattaagaatgagagtgctggagacaaacggcctgtattcagatccccattttgcccctcattagttgtgtgatcttggacaggttgccaaatttctctgtgcaggtttggaaggatcaaatgagttgatccaagtatacaacctttgaacaatgcctggcacatagtcggtgctcaataaatggcgactattcttgccattgtcattagtatgtgccagatgctgttttaagtgttttatctgtattatgtcatgcaatcatcactcacaaggtaactgaggctcaagtgcaagaagaatatatctggttcattggcttttaaaacttcgttagatgcagacttctaccccccaaaattgaatcctatgtgacaccccaatatataaaacaaaacaaataaaaacagcatggctctgattgaagcaaggtggggtaggggtgggacttggagactcctggctcagtgttccctgttctcccctcccccagcctccctatgataggctttgaggctcttccccacccactgatctagtccatctaaactttttatgctcagataaagacattgtaactctgagagagcaaataacatgcccaaggttaaacaacaagtcaaaggcagagtggggtaccaggcatgaagggacaatcacttggtcaaagagaacagcccccttggttaaactagaacacagaacatcccaagcttgggcaaagaagagctaggaaaggagagtgagcaggagggaagggggatccccgatgtgagcagccccactgactattcatatgctgctggggccatgcagacgtcaagatgagacaaagccctatccacatggggcctctcattgcacagggtttggggttctgttgtgacaagggatgtagcctcctctctcttaggtgtctgttctgtgggatgcagctgactggggccaaatcccaccatctaggccttccgattgggctcctggcctgagctggcattaccacaactccccttctcctccagggttctgggatggcagcttgacttccaacccattgttgttggggtgggggaggtaagaggggtagacttgacgctccgcccttttcacagcttccatgtatgtgcacccctatctgttcaaggcatgccactgccaacactgtttatctaagaaactgtgcgtcgccaacttttgtctctaggactttggcatgggttacctggggacaccgccctgaggagaaattataggataaatttttccagagaacttcttcgagaactcaggacttccctggaatcccttctgacctgatctcgtgagctactcaggctccgtgcaagccttggaagacaatctgcagggccgagcaggggaggggcaaatgctggaagacaaagctcaagtgcaaggccctgagttccttgcctctgtttggatgggcttcaggatctccatctgtcccacgtggggcaggcatggatcagatgctctctgaggacccaccagctccaggctgggcttgtgtggaagccctgaccactcggtgctctctcaggcactggcctagaatccgagggggacacaccaagtgatggaaacaaacagggcccctggctagtcacaagagggcaaggatgaggacacaggaggcagagtactgacctccaaactgcaaaacgctcctctgacaccaaagcagcttttctttctggcaaggccagtttgcatgaatggacagagccctggaatcctgagccagactgcaaggcatgtgttactgtgtgttggtgctgtgccctgccaggtgacaggaagaggaaaaggggcttatgcaagctctgactgaggggaaggtgtgtgtactaaggccaggaagtgggggtgggggccgctgtaggtgggcactgtgactacttcccagataaaggcagaaggaattagtgagcatcagacctgagtggcctacgtgatacaagggcaagaagaaagcagcgaggcagggtgaaggggtaagtggtgacttttctgttgacaaacacttctttccacctaatagttcagggaggtaggtgttactgtctccatttaacaagtgaggaaactgaggctcagaggagttctatgacatgtcatctagtaagtgttgaagctgatgttcacatctaaggctgttttgagagttgcagttcttaggggccccttctctagagctggtaaaatgtgcacacatatacactgtttctgccatccagcaacccttctaagacttggccgcaaagggctaggaattatccttcccattttactaaagcccagaaaaggtgaatgattgggccttagtcatccatagcaaggtagagacaggcaaaaggctgagactggggggccttctgatggaaagctgccgtacgctgctagaagtagcactcccactgtggttccacctgtgtctggtcattttccacttacgaagtgctctcaaatccattatcttgaggtttacagggcagaaaaaaaaatcttccattttctaggtgaagaaactgagcatcagttacttgccaaaggttacacagctactgaatggcagagtcaggacttgagaccagagttgtgtccaaactcccctttacttttctgccaagtgcatgtggccagcaacggaaggacagagtaagttcactgaaacataatgtttgagaccaaaagcaacaaaccccaactccctggggagatatctaagcccttctcttttttccatatgaacctctgaattgcagaggcaggcttgcagcctttgaaggggaaacagagaagccaatgagctcagttctccacagcagactccaagagctgctggctttcatggctaactagatgcctcatcggcccaatggctttgtggtcagggtgccagggttggtccagccacaccaatggtgggactgggggaaggtcttctctctcttcccctctcaccacctgtggttgcatttcatgcttggtcattgagtcatttttatgctcttttcctcagtaacatgggggaaagaaaacctcaaatctctcagccaccatttggtttggtcaaggttgctcctgggctttccactcacccacccacctactcacttactcttcaattttttttttttttttcagacagagtctcgctctgtcacccaggctggagtgcagtggcatgatctcagctcactgcaacctccgcctcccggtttcaagtgattctcctgcctcagactcccgagtagctgggactacaggcgcacaccaccacgcctggctaatttttgtatttttaatagagatggggtttcaccatgttggccaggctggtctcaaactcctgacctcaagtgatccgcccaccttggcctcccaaagtgctgggattacaggcgtgaagcactgcgcccagtgcattcaatcttttaatgaatatcctctcaagtgctaatgctgcgccaaatcccttcctgagcaatggatatgccattaataataaaatacagcccctggctgagagaattcaaacccttattgggcaggaagacatggataattaaactcgatatagaatgattgctgatgtaactgagctgtggagtcacccagaaagggaacaccttatgctattcataggagatactgtactaaactggtatgttggactttaccaagtataggagatagggcaaataatttaacctcttcatgtcttcatttccttatctgtaaaatgggataatagtacctacagggtttctgtaaggactttatgagttaaaatgtgcaaagagctgaggatagagtcaggcacattgaaagcaccatataaatgtttgtgaaataagtaaaggaaataaggatgagcattcttgtgagagagaagtgcacatgtaacacatttggtgggttaaggaggtgtgttctgggaatgccacctgcgttaactgggcagtcttgtgggtgctttgaatgccagtcttagaagtgtggacttgtccctgtaggtgatgggcaaccatttctaaagctagatctttgccacagagtgtggcagaggactcctgtgtgaaatgctagtgctgtatccaccagctcaacaggtgctaggcccaagagactgccaccagccaggaaacagtcagttgccaaatctgaacgctggaccagccctgtgcatggctcagccccaggattagcatcgatatagggaaaggggcagcagggagcccccttgtcactgccctcaaggagctgatcttctaattggaataaggcctgcttctgccaataatcaaatcaatcatcctggtgggaagtggtggaggtaggtaggtaagagaaactccatgtggcctgagaggcagtatgtacagtggttactagctaaagctgacagtccaaactgtatgaccttgggcaaattatttaacctctctatgctacagttttcccattgaaaatggtagcaataataattcagcttatcatagagttatatatgatgattaaatcatatatagaaagtgcttagaatgctggctcacatgacaaacactccataaaccttagctattctcagtgactaagggcctatcttttactgaaccaggtgcctgctacccctggggtacaaggccatggcctggaggcatatgaaggtattagaccggtatgtctcctcttcctggagtgtacattttcctcaaaggcttaaggaaggaaaagatgaattttaataagaaaacaaggatgcatactagagttaactgaaaattcaagtggatgtttaagataaaagctggacttcaaagacattcccacttggagccaacacttcaggtttacatcatcagccccccaaggtttcatcacattcttccctctcagcccttaggggtacttgaatacaaaagttacagtaaaacaaacacttgtgaattcaagtaactctcaagggggtccaatcattctctgggggtaaggatgattaccaccgttatatatgggtgaagatggaggctcgaggtcccaatcctgccactgccacttatgagcaatttggattacctttgctgcttctgagtttctccaactgtaaactggggtaatgatgatgatatatatacttcagagcattgtggtaagaattaaataagcacttagaacaatgtctggtatagcttgtgctcaatccacatcagcttttattagatccattcttgcatctcctctcacagcaccattgtcagctatgtgtcatattatgtccattatctggaggagaaacttgaagctgtggaggttcagtaaggtgccccctctcctcctctttgctaacagcaggcattcctgcctggagtggggaggtggtgggaataaataacctcgaaggtccttcccagcaacagggctctgtgactcaagtgaatcttcggagctctttcatatcactgttctggctggagctgaagcagcagaactcaggaaataggggtgggactggacagggcgggagatgccttagcagggtgggaagtgactgctgccgcccttccttctaggccgctgccactgccgggggctatgtcccacactcccgcccaaccggagagcaaaagggaaactcctctgcttggaggaagctgactgaggcctccttttccgcgggcggcgtgggggagggggctgcccctgtgagaggcgcagtgcagggactactcgaaactcaggagtcaacggggtggcagcagaaagctgggcccagagaggggcatcccagtggctgtttgtcctgcctgggctagtccagaatggggactgctgataggccagagggtgctgggagagacgggcttcccattgatttatggtcatttgaagggaaaaggaaaataattccatgaagtagaaatggcctagtggaaggaggagcagagtcagatctgccttggttctgaaacaaactcactgtgtgaccttggacaagtcctcttccccacatgaagaatgcattcattcagttagtaaatattttgtgaacacctgctatgtgccaccattgccctggggaaaagggatgcatggcatgaagatcaacatgttaacctctaatttccttctagctctgacactgagttcatgaaaagtgggtgcaaatatcatgcaaataagcacatatcaactggaaactgcacttcctttttctagcttatccctcacaaatggagtagcttagctctagattccaggaacaaggtatggagacagtaggggggaggggctgtgaccttcacccatgtacccctttatcgttcacaaagcacattcattattcccatcgtgtcataggaatattaccctcattttacagatgaggaaactgagtctcagagaggagaaatcacccaggttatgccacagttagagcagaggccctattaggatgttggtccctttactggccaccaacagaagtagaatggaaatgacctggtctgagagctgttggtaacttttggccttatctccattgaaaacaaatttaaccaggaccccccaccatccccaagtcaggtaatgcaagtttgcttgcggtggtggggattgcgtattagaaaaaacggttatgtaccttagagtcctagtccaggctttttttgtggtacacgccaggggctaaactctttgaaaataaaagctaatctttcttaatgaagtctatactccgtgccaggcaccatgatcagtccttcagatccttacaacagtcctgcaacatagagataactgccccggcctagatgatggccaagtcatttgcattcttgggcctcagttttccatctgtaacataagggagtctataaggactgattccacttcaggatattctggtactagaaagatttcaaagtgtcgttggtggaacccagctggtcggttgctcaggccagccagtcagagaatgtggttgcagggaggagtgaaaagcagggggcggtaaagggaggccgaggagtgagtcagtctgtcaagatggccagagccattgtttccttctccatctggctgttgcacaaggccttcctccatgtcacatggttggtgagatttgggggcagacaggaggtggaggggctgaccccataactaggaagacacccccactatcttgcaccgaggtatgagaacagaaaggagaggaatcagtggagggaaaactcgcagatgggggccaagttggaaaagtctggaaagaaggtgactccaacctggaagaaggcttcctatggtgatggggaggcggaatagttgagtagatgactggaggctagagaagggggagttcctgctcaaggtgggggcgtggaactttctaattgcgactgagggggcggggaaacacagccatcatccgctcagcccctccctccccgggctccccgcggattcgctcagtcccggggcaaaactacccgaggcgccagcactccggctcgccagctcgctcttgggctgcttagccgcctggcaccgcgcggcgcccgcggacacatggcccaggcgcggggctggggtccggcgttgcggttcccgaagccacggacgtggactccgtggggtgtggagggcacccggtggtacgcgccgcgctgggatccaggtgaactgagagccaggcagccccaggcggggaggtcagggctgagctgcgcttcgcggagagcttcccgcaccggctcttcgaagctccctgctccctctgcctccttgtttggttccagcccggttttcatcgttgagtcctatgtccatttgtctaaaacctcacccctggccggcagtgcccccttttgaggctttccaccccgcacgccttctttcttctaattcttaggcagctcttgccccgccctatgggtgccccatcctcttatcccagcagtctatccggcttcgtccccacccacctctgtctacatcctccgctcaaaaagaacaccactttggttactaacacgtggtaggcgttcagtaaacagtatgtccctttacacccattcctccagcaccttcttcgtctctgcctttggtgtctgcttgttcaccctcctgtcttcctgtcccactatatgtctaaacctcaacctgtattttttccttgtcattgagttgtccgtctgtcctttcatccttttatttttatttatttatttattttttggtctccagatcgttaagtgttatcacctacacagtagctccctacatccccctatcactccaagggcctcttaccttcccactctgtaccccaggtgcaggacacagcccagcaaccctggtagcacctttataatcaactcgcattgcctgggagctccaaaccaaggaatgggtctctgagggatctcccaaagtctctggcattttgtctttttaaaaattgaaaaaaaagttttggggtacttatatttccaggctactacttctgagtaattgttatactcactcactctctctcgagactcgaacttctgagctcaaacaaccctccctcctcagtctccaaagtagctgggattattgcacccagctctaattcgctcttgattccacttaaagggcagggaggaaatagcaaactgggttgggtttctcaccatagatttaacatggaattgaacacgctgaaacacaggatccttggagattctgagaacagactctctgattgtacttatggggacactgagagccagagagggcaagactctcagccaggtcacacagttcctccgtggtagaaacaaagtagaagccagagtgacagttgcctggccctgacccaggagccttgggtgttgggggccaggatcatttccttgggggcctgtccatatagagtcatcaggtcccatccaccccggaagcctggctgcccctccctccctgtcctctgggaactgacctggctacccacctgcctgggatgggcgttctctgtcaggggctgccattgcctcccccactgacatgggagctccaggaaggcaggtacccaggctgtgggcctgcccgccccactctctgaccctgtcccttgcccagtgcccggcacagacaaggtctgggtaaccatgttatgggaatggctgatgcatgtgtgtggggaagttccagccctggctgagggcaaatcagaactcctgcttagtaagtgtgtatgtatggaggggaaaggggggagctgtgcttgaggaaaggcctgttgagagggtagacgagctccaaggccaagttgagcccagagccctttgctgagtggccctcaaccaaccaaacacatcccatgccctctccgatgtcatcctggggcctctgagggctgcccttcaaggtcaggagacaggggggtggttggccagggacaggctcagccagcctgaattgacattgtcaagccctagagacccctcttcacagggctgggctgggccaggctgggggcagggcgtataaaagccacacaccactccacaagcagccctccagcttccagggcgccacgtctggtggcagtgtggggtcaggccgtggcagctgacgatggaacctgtgaatgggaaggaagagcctctctttctgcttccccggctcctcctcgccttcccaggttttttctttgggagctgcagccctggagggacactggaaaggatcccagacaaggaggtaggatcctgagggctgttcaaggactctggatacccatagccccaaggtgagctgggagcaacgctgggggcaaagaccagggctccaggagtggggcagcttagcctcagccctccccttccctgcctttcccccaggctccccacccttcctttttctcactttcctcccctggccccaggtaccccccatcctcagaggaccatcatgccacccccacccccgtgctctgcagaagccctgtgcatgctggacttgcagatgccccacccccatgggaacacacagagcagctcacagaagcagagcgttctggaaggaagggaccctagaaccagggcccaccccattttttccagatgaggaaagtgggcctagccagggagaagcaagctccagggctgaggactgagactaagctgggcagaggggagcactcctgtcctcgcctgttgtgtgtggggtgtggggctgtgtcagaggcaggcttgcctttgctcatctcctctctgcatgttgtgacctttggaatctggagggcaggaatggggtggggcaccggggtggacatcctgctctgggcgtctgtgccactacggtcaccaagtgctctgtccacggtgaccccatctatttgttagggctgggcaggcagacctccccgaggcgttagtggggtgctccatctgcctgcagcagaaaacctctggggaccctttgagatgggccagtaaggtcagtccggagacccatcctgggtgtcaaatggtacctgtggcactgtcatggcccggggggtctactgagtggatgctggggcccagccttccatcaggctggcacattgactggtgttggttgaggagagatgacaggtccccgcgtatctgggaaagagccagggctgggttatccagctccacctgcccagtccaagtgcctggaggcagtcatgagccgccccacacctgtatgtctgagcttagggagggcaagggcagagaggttaggtgacccctgaatctcccctggcctgggcctggctgggcctgtgctccagagtccctcactgccagcccagggctctgagctcagcacagagctcctccttccagggtgctctggggtgaggctggaggcaaccgtgatagtcccctaggctgtgggctgagagggggtgctccttccaggatgtagctttctgtcctctgtccacacttggcaatgtatagacagtgaggtgtttgtgtggccctcaccttttcaaacccctccccaccactgtattccctctgtccacatctgcctctgcttgggctgtcttcttagtgcaaatctccctcctatggccatggctcctcaggaagttttgttttgttttgttttgttttgttttgtttgtttgtttgttttaatgaaccatgactatcctctgttttgggacctgatcaatagccccctttcatgaggctgggcgggggccccaagccaccagggagcaggcttcgttgaggcatgcgggaatgtgcgtacaagtgtcagagcctgtgtgtgaggccaccggtactcatgtacttggtggggctggtctgagtgtaattcattttcccctcactgctcctaccccttttctaaaaacttcccagctgaattccctgaagtgatttgctgcggtttctttagctcctatggaaaagagtagtagaagagtctatctggttccttttggatattaacctagccattccagagtgggggcatgggtctgccagcagcagctcgagcaactcccattcccaggcaggcagggcggggggactgttgggagtcctcaggtaggcccttattgggacccaagggtctcagagtgaggctcaggggaatggtatatggaactgctctttgccacagcgtaggagaaaagggctgataggtcccccaaaggttagctctatagcaccttcagtgtcatcctgccacctgccacagtcctttacagtatactttcacatttattgtctctactctacccagtgggtattatactctagtcttgttatttataggtgaaaaaactgatggctggggtggcacaatgacttgtcctgggtggcataacaagaaagtggtagaactggggccagcatttagctctactaattcctaatccagggctcattctactattgctcagtgcttctcaccatatctgacgcttataagcacttactatgtgccagccatcactcttaagtgtttacttagcctagtggatctgctctgcagccattgaaggtcagggttgtgatgatcatctacactttccagatgaggaaactgaggcagagtcacacagctagtaagtagcagaggccatttgtacccaggccatcttgctccagtgttcattatactccctcttgtggggcttacgtggtctgtgggcatggtagaatgaggaaagccccatgcctcgggcacagaaacacacacacacacgcacacacacacacgcacaaacatacacacagagactttttcttttgccaggccttggcctgcttcaagcactctacattcccctgcctgatgactgagctggcatccaaggtagcaacagcaatggtactataggacacacaggcaagagtgagggcttgaggaaaaggggaagtcaagaacctaaagcctccagttacctccacagccactcaggctgcaacctagaaatgggcctgtgaaaagatactctttctcatccattccaggcactattaatccatgcaagactcaggggcagggagcaggggttggcaggggtattgaaggggatgagctatctttgccctgctgaacaggctgagctctcctggccagaataaaagagggagatcaaaaaagaccaaaagaaatagccctgatatcgcttgggccatttcaaaatgtcacaatgtgcatggcaaatatcatgattgtagcttaccctgacaattgtgttcactgtcattcgacaagcatttttattgaacatctactctatgccaggcactgcgaagttctccttctaagtatttatagcagtgccccattttttggtagttttcatactataccctcctccttttttgtttcctggtttgatggcttttaaaaaaatacagctggtgtctcagaacccatgatatctgattcagttaaatgtatctactaaaagataagttgactttgctcattagtcatatgattgtcatttatttttggttgtgctttgaatatctttcaacatttgttcattcattaacaaacaatagtgaggaaagtactgtaagcactgtgcttggtttcctggagtggatggaattggctttgacaaggtttcttgcccttagggaaatgataaaatcattgcaggaccccactttttgtcctttttagcactgtgcacaggcaagatgcctttggcttcaactcagagccttaaggatgcttacaattgttaaagcccagcctcaggaaggaggtcatatcccttcccacccaccagaaggattttgcttctgggagtaacttctggtgtgcaggcctcatccatagacccacagggacttggcgcaccttgaacaaattgctagaggatacgaggggcagtcctgccatcaagaggaaaagagggatacatgggacacacagtggtggtagtgtcactttatcattgctcctctgactctcatcagggccagcagggaaggaatgtgggagaatttcagtttggcctagtgaactgaaagctagacaggagaggggcacttggggctgggttaggtctggctctgtctttccctgggtgaccttgataaagttgctgccctcagagacagatatttttgctctcatctgtatcagatactctaacaagcaagttagatggatgcagttcctgccttctaggaatggtgtggagaaaataaccagtgtacaggtattgaccctgccatggatttgctgagtaaatcatttgaggccaggagtgtgagaccagcctgggcaacatagcaagacttcagctctacaaaaaatgtaaaaattagctgagcatggtggcacacacctgttatcctagctactcaggaagttgaggcaggagattttcttgaccacaggagttccaggctgggtagctttaagtgagtcatgcttaaagtctgctcagtttctgtctttgtaaatgtgagggatagcagttgaactgcatgaggtcctggatactctcagacctgactaataggagtcctcaattcaacaatgaaatcaaggttgtgaacttgtgttggacccttgtgatgaaaggccagagagaaatcaaagccgaaggctcttgtttcttactgaatttgaatggactttctggtggtgcttactatcagaactcctggaagccctcccctgccacgattaatgttcgtgccccaaattttccatgcatttctctgcggaggtagagttcagacttggggtaggggacagaagcctggggtattggggaagttgcagagccactggggcctgagcaacgtagggatggcagcttcctgctcaaattcctaattatctggttttcccctaccaattggagatttcactgaagttgtgtcttctggacatcccataaattatccgagcaagtcactgaaccctcccgggcacatagcatatgtgtttaaatcccccaaacagtgccggactcattcagaactcaataaatattagcctgtgtgcctggccaagtcactgcttgagcctcagtctttgggcttgcacctcctccctggcagcggtgtgaccggagggaaaggcagcggcgagggccttggaggacctgcaggcagtgccccgcccacccagatttgggtgactttctggcgagtccggtgggccagactgcgcccccattggccgaggggaggtgggcggggcgtccctacagccctactcgccgacgctccctccccacttgagctgagtggactcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttaggctcccagtttggttaggatcaggtgtcatggccctgggccttgggaaagctgttcagcagataaaatagggacagcagatttcaaagatacaagggctttagggtgggaagtgtgagctcccggagatctaggtgagttttacattcttccccaccccacaacagggtagttgggcactgggttgggcacacagttgctggtgtcaggtgtttattaaggggtcttggtttgtgtgtgcgcacgtgtgcatgggcatgcattcgggaagggtcctggtagataggaatcagtggactggaggccacagcctgggcccttgtcacaagtctgaagtgctgtgtttgtgggtggagtttccttttccccagccctgcaggttggtaacttgcatgctaaacagttgctgttcctgtttacctcgaccacacacaggaattttagaactgaatgttaagttccctaggagttcagggtggtgtggagcaaagaacaggggattgggagttgaacatggggagctttaactccaggctctgccgcccccctcaaattctccgactctgggtttctcctcattttttccacttcactggattaaactaggggatccatagctaagtgctttgtaaactaccatgtgctgtataaattattagtcattaagtttaggcttggtgctaggtcttgtggaggacacagagtaaaaacccccagttccagggaatgtaccatctagtttgggggttagtggcataaataatacatgccactaattatttatgtattaaataataataccttggtgaggacttcaaaaaaattattgtgaataatttcaaacatatataaaaatagagataattagtgtactaagaccccatgtacccatcacccagtttcaacagccatttgcccatggccaatcctgccctgtccatactcttatctacatcatgcccttgttattttgaaacaaatcccagaaaccttatcagttcatctatacatatttcaatacgtatttctaaaagataaggattcataaaaacaaccattatcacacctaaaatagtttcttaatattatcaaataaccggtaagtgttcatatttccaattgttgagaaggacttatttgccctggacgtccattctgccctgggaaatccattccagggagtgattgcttttgactgaggggaaggtgacggacagaggcagtggcatttgagctgaaccttggaagagaggcccaggaaaggtcccagcccagatgttagccgcctctagggctccagatctggaggctgacccatggaggcttcttgcggagacttcctgcctttgtttctctagcagtaaatgacagttctcactctcacacttgcttccccagtccagggcacccaggagtttggggtacgcaggtctgggagaattctgggaggctgctctccacctaggcccctcccctgcgcctggcccctgaggccagttcagagcaaaacaggatgcattcaggatgaacgtctttcccagcttgtcatctaatcaccaaggcccagcttggagcttcctctctcattcatgataaaaaccctcactgtctctcttttcccttccgccccagtaagggtgtgctgacttcctccatatccgggccagccctctacccccatgtggggctgagggagagattccctcagtgcaggcctctgcccccacccacctcaccacagcctgtcagagagggagagaaagaccccaggaatgttctccctgactgcaggctcctgctcttgggctgtctttgggaaaagagcagcctccttccaacaagcctggggtcctgccactgcttggttaatcattgagccacataataaccaccttggaaagtcatctctaggggatggtcattaactaactccctgtccacctcaggccttaaagagaccatatcctgaaccctcaccttcccccaagggaacattgacaaacattcactcacgggaacttctggggccagtgaaaagtctgcccctccatcctttacttggcaaacggaagcagttattcacaccatttgaaggacatgggttcagcttggatggtattgagaaggggagcggagtgaattgatggggatttggatgggcagtggggtccagcatcagagttaaaaaggggtaggggggtgtttctaggagtagttgatcgcctcatctcaatttgaaagtctaaaagagcaagaaatgcccacccaaagggtctgccgatgctgggtatggggtgaggctgtgtgaatgtgtgtctgttttcagtacagctgtgggtccctccacaccaggctgcagtggaaatggggacagccaaccacatgattgctgctgagaggctgaggacctctgtaagtggaggaggatgccttcctccgggagcctgtatctggacaagcagtggcacttggtaagggtcgggccaggacccagacccagacccagacccagacccagacccagacccagacccaatttagaaagctccagaccatatgcagtttcctgcagtttcagtaggaagagaaggaaccaccccgtgggcctactacagagttgggaaacggcttctggttctgccccctctatagctttctctcggtgagtgatttttgctttctctgggcctcaatttccacaactataaagtgggtagggcagttggcaggcagactcagtggtctgtgagccttcctttcagctatgcaagtatgcctccccactcaagacccttttcttatctaccaggcaatggtgagctggcttcaaattcaatcaggcccagacactgaatgttctcagctggctgggtcagttggagctggccaagccctgaattgccacagcttgggttctccttgtgcttgggcatttctgcagtttgctctctggcccctccccaagcctgtgtctgtccctagtggccagccactctctgacccattcagccacaagttaatgagtgaactgctccccctgggtcgtaccagcccaaggtgctcctgggatcctaggtccctgtgggaagcagccaagggcctagccagctccagtcacctttatgctctctcccacaacccctctagaggtaggtatgcaggcagagctcagggcagaaggacctttagagggcactaggtccaactttccttctgaagcttggggcttcccgacaggtacttgtgcagttcctgctcactcatgttcaatacctgggaatgtgatatgtttcaagcaagttgctttcgtctttggaatgtgtgaaagttttctcttatgttgaacttaactgtgcctccctgaggcttctaaccctgggttccgagtgtgccctctgggaccacctggaccctgtctgctctctctgaccttcagggatctgaggatggaacccaagtgcacctgtgtcttctctaggccaaacaaccttcaagcgtctgcgctccttctcagacctggagcagcccccttcccagcctcatcactgtcctctgtcctccctacatgctactgtttatggcccccttaacatgtgggggcaggaaatggggcactggaaacccctcactccccttagtttatttatagtctgaacttgttcagatgacttttccataatccttttctggttaccacaacaggtagactcctaacccccagaatcttgggtgcaaataccttagacaacactgatttgtttatggttcaggtccagccagctctcacgattggagagcccttggaaggtagggccttcttattggtgcccccatagtggaggacaagcctggtgttagtaggtgttccccttgttgagttaaatacaatgtaatatgtggggggcttccagcgtaccctgctttcctgccactcggttttatctttggagttggtcaggggtgggtggagggaaggggatattttagggagtactgaagccggaaatgagtatgagccatgcccacagtggggcctagaagagtgaatcagacagtgagaaataccaacgtagccattccttcccctggcagttgatgatgatgactatgagtcctcccatttcttcagttgccaaggcactttcacttccatgattccattgtgttcttagagcagccctgtaaagtagatggtatgatttccccagaatgatctgtggtggtctccacctgaggcccagggaagggaagaacagtctccagtgagggaggatttggagcccaggtctcctgaccctcagccctccctgttttccccaaaccacacccagcagccatggcagccggggctgactcggcagcttccccaccacagaggaacccctgccctggctgcaactctgttcctgtgagagagtgagctccaagggacgtggcctaggatttcctgtcctttatctgggctggccaaaggctggcctgtctgaggtgtgagataggcacctgcagccagcctttctgctccaggctgaggtcaagtcaggctgtggcagaggcagtgagcttgtgggaagagcttgtccccaaacatctgtcctgagcagtgcccacaccagcagggccttctaaatgggaaaaacagagaggggaatgtggaaaaggggtcagagtggagcagaagtaaaatacgtcctgagctgtacacaagctctcatgttcacagtgctgggagactttgggcaaattacttaacttctctgagccttcattttgtcagctctaaaatggagatatgtacccacctcatggagttgttgaatattaaatccaacaatataaataaaattattgccattattgttgcttggtagtaccttctgcagtcctgtcatttggttgtttttcactgacctgggggtgggcagttctcaaacctgccacctcgtgggcattcggtctggactttgcagtcatttcagagtccaccttacccagaaaagctccctttggccatgcccacccacagggctcccttcctctggccttctttagtggcattcgcgacactcaacaggctatagtagtgatggtgacaccaataataatagtgaactcttctaaattcttggcaaattttaacttctttagcattcatggcaattccataaggtaggtactgctatctttgtctctcttttatttaataaacttgcccaaggtcacatatccggggagtgatggagctgggatcaggacccaggtggtctgactccacctcctgacatctttaatgactgggccatgcctctctccagatgcctggccaggaggcaagagctgaggttcgggtctccttccccacctgagtgctcatcacacgcaccagtgatcagtcacttctggacaggcagtccccaggtccttgcctgtctgctctgtgcacttcttctcaccctccatcaccaaggtggacagatggatagagggaagacatggaggagtgggtattcatgctctaaaacagagctgcattggggtggggagggagtgcaggagggagttgggcagtgggggtggcagtgtgggcagtgggggtggcagtgtggttctgacatcagcaccaggcctgcctgattagcaccttctagtactgggggtggagaacagggtgctgggtggcatcagggaggaagagacatttgaatatgctctcttgacaaccaggttgcattatttagaaggcatgggtggttaggggctggcaggaggctggctggattagctcttatgatcactagctggcgtgtcccatgctagaattgggtgggaggaggttgtccagaagctgtagccctccccgaagtgcttccatctcagggtcttgggggctgcaagcttccttccctcaggctgtactagctgccagctccattgcttcagggcttattcccctttatcttgcctccgaagcaagctccagggagtgctacgaaggccagtccatggtagcctgtctccctgagaaggatgggcctggcagcagctctggccgagtgctgcaggagaattcagtttttgttctgttttcagaccttagtacccagcatagggcttggcaccaagtaggtgcttgggtattattagttgaataaattcacagtccatggggagtggattctaaagggagagccgagggaggctgaaatgggaacaggtcaacaggagggctgtggttatttaggtaggcttctggcccaatctgtagtccaacagaagctacatgacctattgcagcctcagttttcccatttgtaccataggcattacctgctttggaggagttcttgtggggaccaagtgacatacaggatgatcaagtgctttcctggctgataggaagttaaattcaggctaaccactcttactacaaaaaccctggtagatgattttgtgtctgctgtgtgccaggccccagcctagacaatttcttttctttaatgaggaagattctaacttggtagctctgactctagagccaaactgcctggatttgcatcttggctcacctcttcttagctgctgaccttgggcaagttactccatatctctgggcctcagtttcctcctctgtaaaatagagatattattggagcacttagctcacaggtttgttgtgaagattcaatgacataatacacattaaaaaaaaaaacttaaagaaatgtctgggatataataatggctcagtacaaagtccatggctcagggcacatagtaagtactgtataactattagtgtctgctatattttattaataattacattcagtatcttaaatattgctgtcattaatgagtaagaagtatagagccaggaccaggggcggtggtggctcacaccagcaatttggaaggctgaggcagaaggattgcctgagccaaggagtttgagaccagcctgggcaatatagggagacacctatctctacaaaatataaaaaatacaaaaattagctggacatggtggtgcacgcctgtagtcccagctactctggaggctgaggtgggaggattgcttgagcccgggaggtcgaggctgcagtgagctgtgattgtgctactacactccagccctggtgacagagtgaggcctcattttaaaaaaagaaaaggaagaggtacagagaggtgacaaataggctacgtcttcaggtggctagcctgttaactcttcccactgtaccctgtaacttctacgcccataggccctacagagctgtaagaccaccatttggggttctccttcccttggccctaccatggcctgagcatgcacgtcatcacccttgcccccagagccctaggctccgccccttgctatgtgctcagcatcacagccctccctctggctctccttggggctgggggaggggtcgtgtctgctcccttcccggggaggccacttctctcaggcccatttcctttctatcagagataattttctctggatctcagggtggggccaggctccttcaaggcatttcctgcccaggagtttatatttggcctgagcaaaaggaaagggaagtaggcaagggggtgggatgcagacgtggtggcacagggtcaaaacagacaagtgccaagactttccagaccaagagagggaggcaggaggtaggcatgccccttctctcaagtgaacgtgggtgccctcccctgagcttggcagagtgaagtgctccttcaggtcataatgcctccaccatcaagcagagttcattttctgttcgcacatctctgagccttggttcctggctatgtggtttctgtcctagggcaaggctttgaggtgaagacatgtgctcaattccatttctagtgctgtggtgataccagacaagggagcagagtcagaggcctctatactgtgtagtgggaagtagggcttcctgtctgtgtgttgccagaacattcggtagcccttaacacactgcagcggcaacacaaagaccaaaagtacccagtgcagagaagcccccagttgaatgggggatagactcacatgctgctgagatgatcatggaaatgtgttaggggactgcttcattgaactgagccactgggtgttagggggttggtgagaggtcaggggaggcttcgcgggagtgggtgtttgacctccagcttgatgaagaaatagcagtttgaagcttcaaatcaggccatgtctagattgtgcagagccttgaatgccagggagcagtcaagactatctgccccaggctgtgggagctctttaggttgtagagtaggggagcggccaggttagagctgggctcttggaagaagcagctggcaggatggccccttgaaaggagaggctggaggctgggaacttggagggctgaagtaatccaggcaggagaacctagagcacagttgggcaggaaaaaacccaaccatttgatggaaaagttggtagaatttggtgcctaaatacatgtggccagaagagagcaaggatgacttgaggtttaagcctaggcagtgggcgtattgggaggcaggaacatatagagagctggtttgtggggaaagatgggtttggtttgcgttgccactgaggttcctcgcttgggtcctcagaagagaatgtgaaggaaggaagctccccgcactgagacagccactacgcatcacacacacctctgctgcagctctagattttggggaacggccattaggagatgtggaaactgaggttcagacagaggtaatggcttgcctgaggttatgcaagttgctcatggagctaaggccagaaggtagttcacctgaccgttagtccaatactttccactcaaaccacagtggagagcagtcaccgctggcctaatatctgccccagactggtttggctggcatcatttatctctaggccagggactggagatggtggagtagcacatggctcattaaaacaactctctctttcctaggcaccatgaccttgtcagagcacctgggactgggttgggggcaggagccccttgggggcaagaaaactaatggagcaactgcagcagagcaggtggcagctttgaccttccttgtcatagggaaacccagtgccaggcaggaatgttagctgtctactttggtcctgccataccaagctcaagcccaggagcccacaggctgggctgcctctggacccaaattctccagcagcctcagtgggcctgaggtctggtttaacctcagggtgctcgtgactctccctcatttacagctgcacacaggagctcaggccactgcttcacggagaggagcggggaaccacagttgggggtttcttgtgtaacttccatttttaaataaaatgccaaaccagaattgccacctcttcctggccgatcctgcaaggtgtccacggtgtgcaaaggctagggaccaccactgaatgttgcacccattcttcacttcagcccccaggacatcctggggggagggtgggctgcccagaggggccggaggccccagataaggcagaggccaaccctcaggatctcgtgcttcagatctggagtcaaccttcctttgtctggggctgtctggtgtggtgtatgatgtttagcaacatccctggcctctactgagtagatgctagcagcatttactccttgacccccaccaattgagatgaccaaaaacgtctccagacattgccaaatgtcccctgggggaaaaattgtccctggttgagaatccctgtggtagagactagaagttttttctggggtgtgcagtgttgagagagggatgttatacagaaggtagaaccacacacctgaacctaccactggccagctaaaagattcagtggcttgtttttcctgccaccctgtcctaggggcccctcctgggctgtttgctttggtggtgcctcatttgtgacagggaggctccagaagtgttgctcgcatgggcctggaacttggcatccagctgtagccccggccaagaccgaggctggcatctgaacaggtgcagcagggccctgagttctgcccggtgacctaacaagccagaggccagccagggtccagcactgccaacctaggctgggtgaaatacagaggcccttcctgcggtgcccctcctgtgaggtttggaatgtaggatgagagctattttggtcctgtctcctttcctccctgtgcctccctctgtaagaatcaagttagagttgtgattccagtgaagagcagcaggagcagagagaggcaccagtgaactggaccgccccatagatagggcactgcagacccccttgcatgtctgcttcaaggtcaggagggaaagtcttggtggccctgtaatccctgacagctcttagtacaggtcctcatgaaggtccctttcccactgtcccccagggagagaggtggcatagccagtcagccacccattacagcacttcttctaggggcactgccaacctagagggtagctttgtgcaaattcaaatgaaacagtgcccctgagggatgcagccctgtgccagggctcaagccttggtgggcaagcttattttggcctgggtcccttagtgtttccttaggggagggtaaaagaagctgctcagagcagttggggccacatgctgaggatggtagcttctgagatacaagccctctgccaaaaggccagcaccttctccttaagaggggtccctctctagggttggagagcgggcaaaggaaatgggccttgtagcaaccaaaagaaatgatctgagaagcagtttgccagggcctagcatttctgagcagcagtagcagggcctgcagtggtaggcgactccttgcctgcctcctagccctgccttgagggaccagcctcacagagcctgccttgggaactggggttgtcacatagatagtggcatcacaggtctttctccgccgctcaggacactggcttttcctcctgcactcactgaaggtgggagagacaaacatggagaccagaccctgttttggaggcccccatcctctggcgagggccacggaggagatgcttttccaaataggaagctaagtcaggtaaaggaggccaccacgtgtttaaagtcaccttaaggagcaggtcagctaactcaatgaccttcacaaacaccgactgcctgccttccctcagccatcatagacattcacactgatgctggtcactctccctgctcctgcactcaggtctagagagaacgtgggcctatgaatagaacaggcctgtgactggtctctgggtagaattttccagggacctatatctgtggctttctagcaggccttttctgtttagggcggtggtctttatctcaggctgtactttagaagaaccgggagagctctcaaaaacaaacaaacaaaaatgaaccctatccccagagagtttaatttaactagtcatgggtggggcccattagtaaaagctccccaggagattttaatgtgcagccagatttgagaggtgagggaggaatgggacgggacacccaagagctccagcagtaataaaggatgctttcatctatgtccctgtgacatccatccattgcttgtcttgagtcctgtatcttcccgcctggtccccatgcctgatactgtctttatgggtaggcatgagcaggctgaacccaggaccgggcagctctcttataacccactgagtgaccagaaggtacaaggactagggttgcctagtagtggtgtgaagagggggtacccagcccaagagtggggttggtgatactggctggctgaggccttacttcctgtagtctagattagatgcctgttgccttctctcttcctcctggctctcttctctcacctcttttcaactggtacacaatctgaactgtgtcttaaagactagatgggtacaaaattcagctcatcttaacaaaaatagccttcattaatgataacttttatatagccactttcaaaaccagcaaaagcccgatcaaatctataaggtaaccacagtggtagacaggaaagtcgttagtctccactgtataaatttggaaaccaaagcttagagaatgacacgagttgtctcagatgacttagtggcaagcatggaagctggcttgattagaaaaaagctttttttccaacttagtgatcatctttgggcattattgcatctcccagtgagaaatgttgctgcctctttcctgggtgcataagccctatgcttgagtgtttctcaagaccagaaggcctgcttttttcctggttgcatccttctcagcatagaaaactgctctgtgctgtctctgggacgtggcctgtgtaaatgtaggtgcagatactgtcattgacctcagaaagcatgtgctgctgctcagcctttccttctttgatgctccctccaggagacctgtgggtttggctctgaggcctgattggactctggagctttctagtatgccctctcccctgactctcccagcctgggtcatctgggcccctcccccaggggcttaagtctcagtggaatccagtttgtgccagctgactgctgttactgacctatcctggcacatcacctaagctttggccagagcatgcactgcctgcagaatatagcctttaaaactgctggcagccatgccttggaatctgcatatctggatacagaggtagggcaaggggccacagacattcctacctcactcacctcagcctgcccgttgtcactctccccaccagatacataagcccatcctcagtccgggccacctgggcttcagccccaggtgaatcgagtctactgggggtgggggtggggtcgctcctggcctcagcctgggtaggctgagacgagtgggagggacaaggcagagcacctcagttcagcctttaatcaccaagacatatgtctctgactgatccatctgggagggagcctcggggcctcccagccctccatgagatggtgtattgtggggagccaatgtccctgacatcctgtttggtaataacccattacattctctagattcctgttaaggagggctggtggggaattcagtctgtagccctactccaaactcctttgctcctttgtctttggagcaattgcagcctctttgaaggctccttacctcacttcccccagccatttggctgcaattctgacagtggtctgggcaaagccattgtccggacccacaggggaacgcagcagctgggcttctttctctaatttcctctttttctttgggacccttcagagtcagagttggggtggaacacatttgttgagtgcttggtattatgtgccaggggcttttactttctgtagtattttatttaatgctctcagtagctataagatgtggatgctggctgggtgtggtggctcacacctgtaatcctagcactttgggaggctgagacagggagacaggaggatcactggaggccaggagatggatatcagcctgggcaatatagtaagaccctgtctctacaaaaaataaaaagaaaattaaccaggtgtggtgtggtggatgctattgtagtcctagctactcaggaggctgagatgggaggatcacacaaacccaggagtttgagcctgcagtgagctgtgatagcgccactgcactccagcttggttgacagagtgaaaccctgtctcaaaaagaaaaaaaaaacccataaacatgaaaaataaaataaaaatagaaaaaagatgtggatgccatggctcctattttaccaagaaggaaacagaaacctggagaggttatacaactcgcccaaagtcaaagagctagtgactgacagcatcaggatttgaaccctgggttgtgactccactagaccagaaggagcaggaaaacagcctggggggctggggttggttcctttgagtctgagctccttgcttggctggcatgagggcaggtggcataatgcaatggcaaagagcactgaacatggagtgaaaagatcagggttatagtctcagctgtgacactttaccctgtatgaccttggaaaagtctcttgggcctcagtaggccttatactgtaacttttaaaaaataccaatgtggagagtcctaccgcagatcaattaagccagccttctggggaaggggccctgggcactggtattttttaaaataacacttcctagctgattcttatgtgcatccaggggtgagaatcactgagcaatgtgatttagaccaagacttttcaaactttaatgtgtttgcccaagggtcttcttaaatatagtggttctgggtgtggggcttgggattctgcatttctaacaagctcccaggtgatgttgatgctgctagtctgggactacactttgagtagcaaggggctacagggctctaggtagtcatgaaagaacttggcattgacctgagtgagatggtccccttctgccaacccccagctagggccaatgcctagcatcaggggagggaggtgcctctcctaccctctccattagccatgagtaactgagggctgcagtgggattttaagggtgtgttcctggcatgcaggcctaccctagagatttgctccctttcctggggtggccatacttgtgaccctttaggggccactgtctgctcctgcgcctgcctctctggaagtcctaacctggtccattttctggcacctcccttttgtcctaataacaggaaagcagagctggctgccaggatgcgtgctaagatggggaaagggtctcatcccaggggcatgacaggaacagggacagggaagtggctgtggcagccagctcagctgtcctagcagcagaaccatgttcctcacaggctccctgggcagctccctttggactggtcttacatcacctagactaccactggcctggagcacaggatcctttttcaggcttgcattgccccctgccagacaggtggaggtactgctagcagggctctgtcagacactttccagggacccctcagaggtcctggcgattcctagatctctatcttaggttaggaagttgcagtaacataaaacatacatgtatgcatgcacacacacacacacacacacacacacggagagaaagagacgagagagagagagagacagagagacagagagagaaagagaggcagatgcatgcacagactgaggtgcctgtgggtatatacaggtgcatggtcccacagtgatcctcatgagtcatggacatgagcagatttggctacagctacatgtagagacagatgctgtggtgggcactgacctgttgcattcactcacagaaatgcagagatgttcatccttgcccttacccccatttgcccccaaaacctgcaggggctccaggggctgcagagccctctcttctttccctcaaatcctcatcagtgtgtgacccttgaggagcccattactttttctgactgacttctgacttcccccactcttccctccactgtctactcacctagcatctctgaaatactgttttgtccttcatcttatctgtcccagccactaggatttcatcctgggtttccttgtgagtgagcactgggaagagagagctcttcctgtcttggaaaaacctcaccagcctccttagagtcctctggtcaggggggccaggcgagactgtggccacaggtgctgaggaaatggaggatgtgttgggggcaggactccatggcaggatcagctctgctgaagccagctgacttccccaaccaacccggtgatgccaggtcccatggtcccagccccattcatcttggcatcacctgggtgggaagcaaataaccgcccaggcaggtgcagggctttgctgctggtatttggcctaccctgactaggagcgcctcctctgtggctttagtccagctgcacatctctgctggtgctggcaggggtgctcagctctgtgccagaactcccagagcagaggcgacaggctgacctagccatggccccccaagaccccgacaggccagtactgtgtcttcatgacactcagcactgcactatgacacaaataggccaagagggctggggcagtactgggaagctccctgaggagggaggactataatgagcatgggggtgctgctgtcagactcagctgggattccaaccctggcactgctgctttgtccactgtgagaccataggctgagcctgtttgtttgtctgtaaaatggggatagcaaagccatcaccagttattgtgtgtgtgaaatgagagttggctgtcaaagtgctgaagaatgttagatgcgatgatgagaaagagaatgataggaatggttgaacatttctacttcctgcctgggctaaggtggtctacccagggccttggaagggggtgagtccctcagaaaggctcgggggtggacacagctgtggcttcttatcccagcaggcctccttgaccccagatgatcctggttcctgggcagggggtgggagagtgggaggggtttggaacaggcagggaatgagactcaagaaagccagggccaggatgcccagacagtagggcttggggagcagagggcctcctggctggctatgacttggagcaaatgtgctaggacctctggccttctcttgccattgctagatcaccagaatgagacatgtctgcctgctggggttgggcagcatgcacctagggccctggtgtcagcaccctcctaaccccatttctttgcctgtttctttcccttgttctgttttagaagccgaggccaaaagagcatgtgagtggcttcaagcaacaggattccctcagtatgtgcagctttttgaaggtaaggccactcaactgtttaccctcccatacttcccctagccctcagtttttcatctgttagatggggcaagtcagattctctttccaactacacacaagcagtgtctcctggccctgctccgatttttttcagggactttgctcctgcagttgcacctttctctcctgcatcatctctaagggattgctctcacaactgccacaagctctgctgttgcccatgcctttaaagtaccttgtcttgaccagggtcatcacgtggtaccaatcctgaggatgccatgtaggtacacacggtgtgaagaatgccgcctggagttgtacaccctggtggcccaggcttggcctcacttgccccacagtgatggcctcatttctctgttttccttcatttctctttcgggtttttctagagttcttcgcacttgctgtttcccttccccttttctccccacacccctactgcaccctggcttcacctccacctcgcctggtcaacttgcctggtcaattcaccagtgacctccatgtggtcacactcagtggtcacttcccagtcctcatcttgctccatctctcagcagcattcggtgccactggccactccttccttcggcttctggaatgcccccctttcctggctgcctctctggctgggttctgtctccttagctgactctgcttcctctaactgatatctaaagtttaggatatcccagggctctgtccggggccctcttctctctcaacatttctttctcatgagatctttgtctaagtactatccatattctgatgacttccaaatgtccagacctcatccccaagctccagattcatatattcacagctgccaattcaatctctctactcagatgtctgattggtgtctcggattaaacaggtctgaaaccaactcatgatggtaccaccatttacccacttgctcaagccccatacccaggagtcatccttaatttaattcctccttgttcccatctcctatctctaacccttcagcaagacctttttccctccagaacgtatcttgaatcaatccactgcttactacctccactgccacagcctggtgtgacccagtgtcacagctcacctgggctagtgcagcagcttcctgtgctcttgcactctcatctctacactgcagctggagggctctttttggccataggtctgactgtcactcctgctccaaaccctccgatggcctcccagcacactcagaatgtaatacacacagacactctgctctggcctgtcagactgcattctccaacttccattgattactcttacctttgttcacagggctcctctctacacttgctcacaccaagctctttccctcttcagagccttgatgctgatgttcctcctgcctggaactctctctgcagtttccttgcacagctggctgcttctcatctttcaggactcagctcggatgtcactgctttcagaaagctctctgctgaccacctctctacaagcagcctccacccctaccagcctccctttacactatcatgctggctgatgtcttccatgactgcaccatcttggttttaagtactgttgcttatctttttcctttaagagtgtaaactccaagaaggcaggaaccgtttttgttgtgttcactgttgtatgctgtatggtttgctcaagtgtctggcacaaagtaaatgctcaattggatactcattagttgaatgagtaaaggaacaaatgggcttgcttcaccagtaaggtagagagctgtgagacttctcagattctctcttccattcccccaactcctttctttcccctctcccctccctaagtcccagggagtgtgctctgggccacagggggatgcaaggtattgtttggctactgtgctgtcctgtcccttctgtccttgctcccaccctactcccccaagttcaccttgggccaaggagaagtttccctgcctgagcagcccaggattcaaaggggaatgggggagcccgtgttgggctcttggcagccacccggggtcttgggcctgctatctcccatggacctgccttactgactgacagagttctttgggtccagctcagccctctaggcctctcccagacctttccctgaactccctgggcaccctcctttattcctgactttttttccttctgctttgcctcttgtcttcctgctccccctccttcctggccgttcccttccagcccaagggctgctgaggctgagtttgtgatataccactgcactcatctttgcttctctctgccatacagaaggttcgtttcccctggatattggctctgtgaagaaaaaccacggttttctggacgaggactctttgggggccctgtgtaggtaggtgggctgagggccaggcctgggaagccaaaggcctggcttgaagcttcctcgtggaaaaaaacatcccttgtaccctctaacagaggaggagcccagcttactaacaaagctcatcttctgtggtcacattgctcattctgttctttgtgtttgtgataccctcaaccacccagtcactctagctagaaagccaagatctggccttgtttcttttctcctaaagttatagcccccaaatattcctctgcttcagtccctctctacttacaccagcttggcccttgtttgaggccaaaccatggcttctccttggatcgatcacaaggcttcagcctaactggctttagtcttgatagcccatctctcccctcccctctccctcttccctcaccctactcccagatcgatctagatccaccagcgtcgcattgtaacagctccaaatggttgttctttctgcttaaaatgtgtcactgcctaaggataaaaatgcaaagactttttagcataccacccaaagccctttgcgagctggctcattagccttagccccattggtctcatgcccacactggtctgtttgctgactgtatacctacagtgtcctgtgtaagcttgggtaagagtccctgtttctctcaccttcaaaatcccatttgcatcctccaggaagccttctctgactgcatccctccttcatggaagttgcttgtctctccctgtgtttgtctgctgtgccttctgtctgctctgtctttgaacacgccccatttctgtagggtttatttccactctctttgtaagctcctggagggcagaggccataatcttcccagcattgtgtctggttcttaaaccttcacgaatattggagcttgcgagaagttttgatggcttgggcatgtgaagtggcaggtgcatcttggtaggctctgccaggctttggggatggggacccttggttggacacttccattttgttacaggaggctgatgaccttgaataattgtgcctcgatgaaactggaggttcattttcaaagcaagcaggtgagtcatggcaaagcgtgggtctgtggtcttgtggtgccataaggaaacccagggcatacgtaaaccatttgtaaaactagctccagtatcccaggagtctgagatgtccagagcagtgcctttccccagctaggggtagagatggaggagatctaggaccccattctttcctgggaacttgctttcttgcttttttttttctggggctttctataccagaggcctgtagtcaggtggggcagccaagtgaccaaagccctgggctgtgagacaggaggcccatggggcctggtctcagctctaccactgattactgagggacctcagggaaacctcttcccttctgggcctcagtttccccattttgcaaagaaggagatgaactagaaaatctccaattccgtccagctctgttgtgattctaatctaagactacagcctagagcttgggaaggtctgtcactgacttaatgtatatcattgaccttgggcaagtggcttctggtttgtaggtttgttttcctatctgtaaaattggaaggggggttagattaattagttgaccattaccattaccatacatctgggctctgtctgtgactgctggcttcctctggcactcccagagctagctctccccacctaggccatgttctcagccagaaagcagggcccttcacctcagagtcccccaagagtttggaagcagagagtggagtacaagcaaggacttgtggcctgggcttctctgacctgatcctgcagtgcctttcccagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggtgagagtttgggttgggatggggcggacgcagggtctcctgttctctctctgtctctgaagctgatttctcagtcatgaggcccagggctaagtgcttggcggctgcgttatcccctcacagccagctcaggagagagagtacaggacttgggaatccagaaagttaggtccagaacctgcctgtgctgtggccttgaggaaatgatgctctcctctctgggcctcagtttcctcatctgtaaagtgagggaggatgctagaggagatggtctctggtccccagctttgcccattcagggtttcttggagcagcccctccacagtagtcttgggatgggcaggggtcttcactgcttattggcactagatgggcctgagctctgtgccaccctccccaagaacttcttggcccctaagaagctgagtccaagctttttccaccctggggcctcagcagcagcactagaaagtgttcccagctccctgcattttttctttggggagaaaaaaggggaccacaataacaccttttctaaggtttagccaaacctgctcctctgggcttctccacccctctcaccgccccccaccaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtgagtggctcctgggccatggagggtggggaactgctgactcaggtccacgtccccaggcagggtcagcccaggaggtgggtgcaggcaggcagggcccacaggccaggggagcggtgagatatgccaggaggctggaggggcttggtgaggctgggtatggggcagaggacctgaggtcctccagctgtatcttctccatcccaatctctgtgctgcaactagtgagattgtcctaaaatgcagctgtggttgtcactctccagataaacacttttctctggctccccattgtccagattccctcccaccatgactccttcctgttctggtcccgctccatccttctggctctttagcctaccgctcctaagcaaccccaccttacagaccagtgggaccagtcatccttccgtgaacgtgctatgatctttttcctgcctctttgcctttgtttgtgctgtgctctctgcctggaatgcattttccccatttctcctctgggacaatgccttcctatccctcaagagcctgctgagttaccacgtcctctccgaagccttccctaactcactaggtacagttcccctccctcaatgggtcttcccctaagttcttggcctcctactggccacatgagttgttactgcctattgacacagttatctccttggccagactgagagctctctgtgttcctctgtgactccctggggctgggcccaaaacaggtgctcaatgagtgttgactctggggcagtggtgtgtgccttacccccctcaccccacctgatcctctgagactgcaggcagagtctccaaactgtgttccccctatctgatcacttgtcattctcccaaacaggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtgagccctcgtggggcagcctgccgggagatggtgcaggggtggggtggtggtgggcattgggctgaaggctgaggagctggggagaggaactgctctggccttccccctcacttgggctggtccaccagaggcctttgctgttctcagcaaggaccagcaaggatgaaactcctttctactccttatgcccagctctgtgctaccttctttctggcccaggctctgtagtccttatcttctgggagcctgaatttgcctagatccacctttttctactcatctccacaaaagcatcttttttcttttgtcctgaagctgtaaaaatccttctctttggttttcccatttgtctcctaccctgcccctcaggaggcctgataagctttgaagtctctggggtggcctaggctcctgacacccagtctagggctggcctcacagtctgcctcctactcatgcatgttttcctcactccctccctcccctgcatggagtaggtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagcgtgagtcgcccactcctatccccaacaacctgtcccattctcaacctccctgaatcccagaacttgtggaagataaacctggtgcaggcaaatgtagctggacctgtgagctgattggaacagttactatctggagttggaatggcccttgcagagagaccattctgcttccccaaacccattatatggaaaggtagactgaggccctgagggaagaactacataaggttacactgtatgttagtaataaagctagatcaagcacccagagacctcacagaactgacattttcccttccctctcaccgctccccttgggactgctgtgccttttgcccccttggaaacaggaggctggctgctaaggcctctggggaagtaaggaaggctcttcttccattgcttcctcacagtcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggtgaaatggtgcacggcatgtcagggccgggctgggtccagacaatttgggccccactggacttttggcttttgatggctggcactgctgtgtctcagcctcaccacaaggagtgagcctgactcctcaggggccctgggctggtgggatgctgtggagcagggccttccaaaaggcagcaggttgttttgtggccaggtttggcaaagtggcttcctggcagctagaaggcagcctgtctgccatcttgtcttgtgctcttgtgccatctctcctctcaccacctcctgctccatctaggatcaagagcaaacgcagcctcattggcaggccaggccctagggacctgagtgacaacatggcagccacccagggcctgtcgcacatgatcagtgactgcaagaaacttttccaggtgagtaaccccaggccatgacacctacttaccagacctgggggaaccatcaggcctgacctcggtgccccaagtcagggataggacccaatttgacacatacccctcaagcttatacccccaactcttcccccacaatgtttctcatctaccttgctgtggtagctgcacctctccactgcccttaacgtgaacctgacagaccccatggggtctcctgctctctggagctgcagcccattgtgtgtgtgccctctcaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggtgagtgccacaccacgggtggctgctatggggctgggagagcatggtgcaggcaagggtagtcagagaacccaaaggaaggagccggggaggagctgccgcctgagtctcgctgtgcctcggcctggtccttggagaatgtcagagagtcaagaaagtaccttaaggaatcaagaaccaaatgagaccaagggaactctctcaggaaccacctgccagaatgaccttccaaaagccccgttccagatacgatgctgctttgatagcctcaactcccatctctccctgccccgcagtccagctgaatccttgcatttgcacctttgtgcggtcctgctgcctggactgccctgaccccaagcattacgtctcccgagtcacctttagcgacaacggaatgtgttcctcctccattcagaaccttctgtcatgccccaggatggaggggatttctctctgttcccctctgggcactggtcatgctctttcttggacgtggattctgagtaagattgcaagcctgaagtgtcctgtgtaaaaaaatggtcataacaaaaccttccatgtaggatcagggtgagtgtgaatgcctggtacatactaaaggttctgtaagtggcagcttttgttgtgcatgtgttttactgcctgtgctagatggcaagctccttgacaatcaccatcttcctgcacctccaagcactgtgcccatcatggtagggcctgagaggcctctgagaatgtgtgccccgtcatctctttatgctgtctaacagactgaaaagcagacatccagaaaagagagagagagggcagggagcatgggagcactgtctcagtctggccagcgctagcagaggagctctgcagcctaccctattaagcctcaggccctgcagtttgaggcctggacttagggctggagtcagagttctccagccctgacagctgcccccatccccactcctgtggctcacaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggtgaggggctgcagctgctacccttctgtgcttggggggccggagaagtggggtggaaaccagcactaggaatctgagcctacgtgtcccttctccaataggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggtatcaggcctgggacagcctgctcgacccccttggccttgaccccctcccctgcctctgcccctactttctgccccatgctattgatccctggggctggggacaagtcctttcttccttctccctggtgagggctctggggaaaaatccattgctcatgcctggtttcttctgcttccctaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgc

SEQ ID NO: 36888 - DNA, 60350 bp, Homo sapiens
gggccttgcgccgcgggagcggacggcggcggaggagaccctaggctcgcggcccgaggcgggagggctcggcttctcgactgcccgcctccgaggccgccggccgcttctctctcccagagtggccgccgcccctggagactcgccgtgacacgggcctaagccgccgccgcgggagtcctgaccgctcggacccgtcggatcaggccgggtgggagcgagcttgcgggcaggtgccgctcccggagggtgggccggaggcgaggcgcccaccgcgcggctcgcgggccgggctcggcggaggggccgctcgcgcagcacccccaccgcgggccggagcccgggtcgccgccccgccttctcccgggaccgcccggccggagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggtaagagggggaaaacgggaagttgtactgcgaaggtaaaacagccactggcctggagtggcgggaggacttctgctcccctggtccttatcctgtccttcttttgactgttacggttcgatgcaactttacttggctgatcatccaaggagtagctaagaagtcgggtttacggtggaacaaaatggggcctggatggagtttaaagagcgattggaaaaggagacagggttataaagtctactctttcaaacttcaaaggaaatgagagtgttctttaatttataggaggggtctggttgtgcccttcaagtattttagaatgagaaactcattgcactttgcagtggatttgtctactgactgcattcgcgtgcatgcttgtactccaacagttctgtttttagggtccagtatatatatttggttgtatctagagctaatacagaactagttgggatcaaagtgattgctacttgcagtctcttcttgagttagttgcttgacagcatactataaaatagaatggaatttctgacaaaatttccaaaaaaccttcatgtggtactagttttaaatatatttatggtaagcattgactagaagtcagtatcagcgcttaagcagttaaaaacacacacgcatgtatttatttcaatagaaagaggcttggcgtttcaacctgaaggcattaatgttaactatttaatatctcctaaggaacatatgaatgatgtcattggagtattttcatcctgaagggcgaattttttatgagacagcgtttaggggaaggacccacagggttgcctagaagtgaaaacgtaagaaaataacttatgtttatacaggactttgaagtttttaagtactttcaaataatttggcccccacaaaaatcttgtgaggtaggcaggtcagtattagtatccacatttcacagatgaagatattgaaattgttcacagtcacatgagtctcagcctagacttgaactcaggtcttctgagcccatatttagtattgttttttattttaacagtcactggtagaaatgagagcattttgcctactactttcttttttttttgagacggagtttcgccccttttgcccaggctggagtgcaatagcgcgatctcggctcactgcaacctccccctcccgggttcaagcgattctcctgcctcagcctcccgtagtagctgggtttacaggcatacgccaccatgcccggctaattttgtatttttagtagagacagggtttctccatgttggtcaggctggtcttgaactcccgacctcaggtgatccgcccgcctcggcctcccaaagtgctaggattacaggcgtgagccaccgtccccggctgcctactactttctaagcaccattacacttctgcctctgccctgcctcaaatgcatcttgtcaaaaccccagtcctcattctttatccaggctaaaatatctactcctctctgtgtgctttcagaacacgttgttcacatggctattatagcacttgtcacttattacaattaatatgtttatgtttctataataaaattaagggccaaaattatgatacatatttgggttcattcactgccttagcgtatagtgatgtgtctgtttatttgttgaaatgaaagaatgtgttttgtctgcatatgaatgctgtcgtggaagctatcataggctgtggaagttggcaaaataagctttgttatttgtgtggagggtagagtatgggcttcagcaagagcttcataagatgcaaggcttcattgtagtgggaagatcactcctgggaatcaagagttgtgttttagtgctggctgtcacaaaccagcgttgtaatcctggacaaaacacttaacttctctggacctccgttttcttagccataatattaactttcttaggagtttagattctttcacccattaaagttctgtgagtatgtaattagcctggaaaggcaaaaataaatgctcaaggcacctagaatcttgtagttagaaggtggtaggtgattatgggcagttttcatggtgtaaataagttttatcgaatataaacagcttagtagtaagagcactggctctggagttggaatataacttagctctctcactcaatagcagcatatgaccttgagcaagtttcttatttgtcctgtgcctaactttgctcatccataagacatcctcagtgtgaggattgaaaaagataatataaggcacatggaaagggctcagtaaatggtagaaattactgttattacatttagagctcatagatgcaaactttgggatgagatagggaaaggaaccaagaagataataaaccattttgttggtttctaatggcatgggcagactgtgtggagatactaaagccctgtgttattctttcatgacactttctgcaaaatgtgatctatcttcctgtactgagacattaattgaaaaatttctgaagaacaagagtcttatttcatgtagttatttgagcactataaaattgtgtcaaggagaatttctgtgatcttgatgactgtattttagtatgatatttgaagagcacgggctggcactattttttcttttttcatttcactactctctgcttctaaggagtagggtatgagttttttaaaaaataaaatttgaaattaaaacttatctgtcttcttatggcctcttttttctaaaagtttttgtttttcaagattccatagaaattgaggatttataaacttccttatatttggaagaaaaagctatggaaccttaacatagtacgtagtagtatgtagtagaaaactgtttataaacttgattctaactatcatttgcttacagaaattagtaactgttacaaagattatattgtaaatagagatgaggttgagtatcccatttcccaaatgcttgggaccagaagtgttttggattttggaattttttggattttggaatatttgcattatacttagttattgaacatctgaaattgaaaatgctctagtgatcatttcctttgaacatcatgtcatgttagcactcagaaagtttcagattttggagcatttcagattagattttcagatttgggatgtgtaacctataggtaatcatgttgtgtatttagtctgagtcattcttccatcgtgtacttgttgtattccttccactcagtccagcactgtacacatttaacagttacttccttgcctgaaaaagcttcactactttaaatttattttctcttttaaaaatagtattatttgacatataaatgaagatatgtaatatccttcacaatattttatctttgggtttctctttttttgttgttgttgttttgtttgtgttttgttttgttttgagatggagtccctctctgtcgcccaggctgcagtgctgtggcgcaatctcggctcactgcaacctccgcctcccaggttcaagcaattctcctgcctcagcctccggagtagttgggattacaggcacgcaccaccgtgccgggctaattttttgtatttttagtagagacggggtttcaccatgtttgccagggtggtctttcctgacctcaggtgatccgcctgccttggcctcccaaagtgttgggattagaggcatgagccactgcccctcaccccctgctggatttctcttgtttttaacagaaaaaaaagaatgacataagattatgaattgaattgcatttctagaaagctattttatctattaaaccagttgaaactaaactcttggctgtgtgctggatgaaagtagtttttatatgacaactgatggctgtgtgccttttaaaaaatagtaaaatatataatctttgtattaaaaagtatggaaacatatacatttagcagataataaagtgaattattattaacaactgtcagtgtcaaggaattctgctaacatccgagaatccctcttgcctcctttctgtatctaatatcttctctctccctaaaggaaaccactatcctatctttaagttattcatttatttgcttttcttaatcatttactatctaggattatatccctaaatgttataaatttagttttgtatgcacttgaactttatatgaatggaatcatattgaacatattcttttgtgtcttgcctctttcaaagtcagtattgtgtttgtgaggttcatctttatcacatagagctgtagttctttttcgttgtagcattgtattctattatatgatgatatcaccaattatttactattgtacaattaatggatatattggttgcttccagtttttggctcttacacaaaacggtagttgcacatatacatgagtttcactaagagttaatccaggaatggaattgctaggttatagggtagtgtatctttaattttaccagatgatgccaaactaattatacaagtttacattcccaccagcagttgaagaatttccttgccctgccaggcgcggtggctcatgcctgtattcccagcactttgggaggccgaggcgggcggatcacgaagtcaggagatcgagaccatcctggctaacacggtgaaaccccgtctctactaaaaatacaaaaaattagccgggcgtggtggcaggagcctgtagtcccagctactcgggaggctgaggcaggagaatggcgtgaacccgggaggaggagcttgcagtgagccgggatcgcaccactgcactccagcctgggcgaaagagcaagactccgtctcaaaaaaaaaaaaaaatttccttgctctgcatctttgctaacatttaatattgtcagaattttaaagttttgacaggctgataatgtgttacatttctcattgtgcatttaattcacctttcacagattactaaaagtaattcttttaatatgtttttggtaatttgaatttcttcttttgtgttcaagtctcttatccatttttctcttgaagtctttgtttgtatgttgattgtgtgtgtgtacaatatatgtgttttgaattttaaccatttgctggtgatagttattgctaatatagtctcattctgagacctgtcttttcattctcactgtagtgtctttttatgaattctttaacatggtccaatttgttagttttttcctttacagttgatgctttttgtgttatgtttaagacatttcttcctaatgtgtgatcatgaagataatcttctatattatcttctaaaagctttatgattttgcttttctttaacaattagatctataatctacctagaatagatgtttgtaaatggtatgaggtaggggtccagtttcatttttttccccatatggatacacaattgtcccagaactatttgctgggaagaaaaataattccccactgctctgcagtgccctgttatgtagcatgtgtctgtttctgcattctccgttctcttcattgatctatttgtctattcctataccagtatcccactgtcttaattaggaaagaattaaaataaatttctgctgcttcttcaacatagtttagtagtattgttggcccttagggcttctatgtacattttccagttagcctggttgagtgccacaaaaaatctgtgtttttttggagagatttcattgaatttataaatcagttttggaaaaattaacctctctttgatattgagtcttcccacctgtgcatgttttatctctgtttaggtcttttttactatcttaataatgagttacagtttttttccctagaagtgggaacacaaactacttcaaggatgttttaaatactttgtttttcctgttagaatttcctccttgtttttgttgtgtacaacctttagtagccttctgagaaaggatccatggaaaacatattttttaagaacttgcctgtctaaatatgtctttattataaggtcacaacttaatatatataattctagttcaaaagtaagtttttaaagaatttttaagatttagaatttgttagttttgaagactttcttccattcattatcttttggctgcaagagttgctgttgaatgtctgatgccatttggcttcctggatcctttgccatctttttctcttaatagcctttaggattttcttttatcctctgttcgtggtgatgtactttgatataggtcttttcttcttctttcgttttgctgtgctcttggttggtcctttcaatccaaagacttatgtccttcagttctgtgacattttcttgtattatttatttgacagcctccacccaccacttcccccaataatgactcttgccatggtcttaagattcttcatgtccctaaattcaggggacacttaccatcttacttgacctgtcattaccatttgagatacttggccattctttcctttaaaaagttcatcttggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaaattagccgggcgtgatggcgggcgcctgtagtcccagctactcgggaggctgaggcaggagaatggcgtgaacccgggaggcggagcttgcagtgagccgagattgcgccactgcactcccgcctgggccacagagcgagactccgtctcaaaaaaaaaaaaaaaaaaaaaaaaaagttcatcttttggcctttttttttttttgagatggagtctcgctctgtcgcccaggctggagtgcagtggcgcgatctcggctcactgcaagctctgcctcccgggttcacgccattctcctgcctcagcctcccgagtaggtgggactacaggtgcctgctaccacgcccggctaattttttctattttttttttttttttttttttttagtagagacagggtttcaccatgttggccaggatggtcgcgatctcttgacctcatgatccacccgcctcggcctcccaaagtgctgggattacaggtgtgagccatctcacctggcccgtcttttggcttttaagtcaccatactcttgattttccttccacctctgtgtctgttcgtcacactcctttgctggttcttcctctttctgactttaaggtgtgggaattccacagggcttgggtataggccaccttctccttttcttaagagaaccggtcttctcccatggcttcaattaccatctaagtgcaatttctatctttaccctaagacctcccttttgaactccagatccacacatccaactgtctattagagatttctgcttggatgtctcacagataccttaaactgcaagtccaaaacatgaactaattcagctcatgatgtcagtcacaaatttgctccttctgtcttcccactcagtaattaccacttccatctaccagttgcataggccagagacctagaggtcatttttaacacctgttgctgccttccccgccaaacctaattaaacaccaaggcctgttaattctacctactaaatatttctcaaaaatacttctttctttcttcactgtcatttcactagtcaaagctgctatcatctcttagactactgcagtcttattggtatgtttttgggcttcatataatcatttacatgattcttttaatcctgtaatcatttaatatattcctttgtgttgggcttcttttgccaaacattatatgaatgagtttcatccatgttgttgcatgtagtagtaatttgatctttttctttgctttatggtattttatgaaatattatagtttatccattctgtagtatttggattgttttcactttttgtatgttaaaaatatgattcacggcccggtgcaggggctcacgcctgtaatcccagcactttgggatgccaaggtgggagggtcacttgagcccaggagttcaagaccagcctgggcaacatagggagaccccatctttatttgttttattattattattttttcttgagacagagtctcacctctgtcatccaggccggagtgcagtggcgcgatcaactccccaggctcaggtgatcctcccaccccagcctcccaagtagctgggactgtaggcacctgctaccatgcccagctaatttttatattttttgtagagacgggattttgccatgttgcccaggctggtctcaaattcttaggctcaagtgatctgcccacctcggcctcccaaattgctaagattacaggtgtgagccaccatgtccagccttaaattttttaaattaaaaaccaaaaaatacgattcatgaatattcttgtgccttttggtgcacatgtgccattatttctgttggatatataccgggaaggaattttctaggtcataggttatacatatcttccaaagcggttgtaccaatttacactcccatcagtagggtatgggagttttcccagttgctctgtgtcttcacttacacttggtattgttattaatattatctttaatgttttttgttagccattctgttgagtataagtggttttatttacattttcctgatgactaatgaagttgagtgcctttttatgtgcttattcaatatttgggtatctttttttggtggaattcctggttatttgcccaattaaaaaaaaaaagctctattttgaggtataatttatataccacaaaattcacccatataattttgtgagttttagtaaatctgtatagttttgcagccattactacaatccagctttggaagctttctgtcaccccccgaaagttctcatgtgcctattttgcagtctgtctctattcccacaccaagctcaagatagcccttacttgctttcggaatggctctgtaattttgccttttctagaattttttaataagtggaaacatacaatatgtattcttaatatgtatggctttttgcacttagcacagggtttctcagtgttggcactacagccgttttggacaggataatccttttttgtggagggctgtcctatgcactgtaggatgcatccctgaccctacccctttgtgacaacctaaaatacttccagacattgccaaatgtctcctggatggcaaaatcagcaccactggttgagtgtaatttttcaggattcatctgtgttattcatttgtctattaaaatttttggttatttatattttccttaatgatttgtaggatatgaggtcctttttccacaatgtagattgcttttcatttatttaattctttttcctgatccatagaggtatttttaaattagaaaataaatttattagaaaacaaaggttgaaaataaacagaatgaacaaactctatttttgcttgccccaaaacctcaataaaaactgttatctggccaggtgcagtgactcatgcctgtaatcccagcactttataagtttgaggcagtaggattgcttgagcccaggaattcaagaacagcctgggcaacatagcgagaccccatgtctacggaaagtagtaaaaaaacttagctgggcatgatggcactcacctgtggtcacagctgctggagaggctgaagtgggaggatcccttgaacttggtggaggctgcagtgagctgtgattgtgccactgcactccagccttggtgacagagcaagacctcgtctcaaacaacaacagcaaacaactattatctcttaaaattttaatattttttcatataagttctgcatttccttgttaaatttttgccttgatagtttatctttccagctactattttgaatgggatagttcttccattatgttttgcaattattgtttggatataagaaagctattaattactattctataatatcttaaccttattgagtgctcttattgtttattttcccctcaacattgaagtttttcaatcctataaaaatgttgatatgtaaaaaaagttgtatagagaacatacacatatcaactacctagattctacagctgttcatattttgctatactgactttattacacacgtctatccatccattcatccatttatccattcattatctgtttctctttttcattttcttaaggattttctcttctttcaagtatttgtacctttgtttttttcacttgtctaattatgttgattaatccttcctgaacaattctaaataattcgacattggaaatgttagtaatttagtgaattattttataatatattttctggcacaattttaaagttttaaactttccttcttagttttctgttttctaccagaaagttattgtttatgtgctgacatagacttctagataaagtggcatattactttattcccatgtttcttatttgtaaatctgtatttaaattcacacagatctttaacataactctgtaacagaagcagttaattcttattttgccagtgtctctatgtcaaggtacacttctgcttgaatataagatgctattgctgttactgtatgaaatgttgcctttttattataaaaatctgtcacttttatgtaccaaaatgagaactgagatggttttgaaatttcagaaaaaattttaacaaaagaactaatcgattcagtgaatatatattttttttccttaaagagcaatcattttcagaagtagtttttaagtgataatctcatctcaagataatgggaagaaaaatgtcaagaccagggcatttattttatatccctgtgtttcttactaacgtgttttttatctgtaaggatataactactgaatgtacatatggagtataaaaacaatattttattgttcttttaatttataagatgatcaacttttccaatttaccagcttatcagctcacatttcttcctataaatcaatgctgaaatattagttaatttgagtgctttctttagaaagggaaggtatttgaatcatccctccttccatcccttcctcctttcttggaaagtgtgagcaaagttaataaatttcatttctctttgtatgttgtcattttagcatctcaattttaaagaaatgtactggaaatcaagatattttattaattttaattttaatatttttttgagacagggtctcactctgtcgcccaggcaggagtgcagtgccgcgatcttggctcactgcaacctccgcttcccacgttcaagtgattctcatgcctcagcctctggagtagctgggattacaggcgcccgccaccacacccagctaatttttgtattttttagtagagatggggtttcgccttgttggccaggctggtccccaactcctgggcttaagctatccgcctgccttggcctcccaaagtgctgggattataggcgtgagccaccgtatccagccaagatattttatttttgcttgtaaagcatgttttatttccagttggtatgttgtatggcatgagctttataaagtctcttaaaattttaaagatctgtgatatggcttattcacatttaaagataaagtaatattacataatttatttcagagtatcctgccaaagttttataaagaatggccaagaaactagcataccatatctgattttggatctttaaattaaccttgatagaatcttttttctggcctgcttttttttggtctgtgccctgatggatgtgaagtaatatcgtccctgattactaatgaggttgagctcattttcatatgtttattggccatttggatttcctgttctctgaagtgattgttaaagtcttttgggctctctttctttttcttattgatttatgggggtcattatacattttggatacttatcctttgtccgttatatatgaggcacatattttcttttgcattgtggtttatcttttcactctctttaggattttctttttttgtgtagacattttaagttttaatatagtccaatttattaacttttccctacatggctaatgtttttgtcttaagaaattctttcctaaccaagatggtgaagatatcctgctgtgttatctttgtaaagttttatggtattgccttctacattaggtgtgtaattaaactggtgttgatttttgcttatagagtgaggtaaggaccgaattttattttttctatgtagatacccagttgtcccagcaccatgtactttaaagaccgtccttttcttactgctttgcaatgcttccatcatataatggatgtccgtacgcacatagtatatttccatgacattctcttaggttaaatttttaggagaattgttagagcaaaacaaatgattatttattaatgcttattttgaaattacaaaatttgtgcacatttatttttcaattttttaattgtagtaaaatacacataaaatttactgtcttgactattttttatatcctgtgaagattcaccatcgtcatgatttttaaatgtctagttcagtggtattaaatacattcgtaatgtgcaactgtcaccactgtctgtccatcatgcctcttatcttttaaaatgaaactctaccgtgttaaacagtaacttcctatttcttccttcctcctgccctaggcaactgttcttctactttttgataccatgattttgactatcctaagtacctcattaaatggaatcatacagtatttatcattttgtgacttagttcctttagcgtaatgagccttaaggttcatccatgtcatagcatatgttagaatttccttcctttttaaggctgaataatatttgtggtatgtatatacacatttttcttatccactcatctattgatgtcacttggattgcttgcatgttttagctgttgtgtatttagctacgaacgtgggtgtacaagtatctctttgagaccctgctttcagttttttagggtatatacccaggagtgggattcctggatcttgtaggaatctatttttaattttttgggggaactgccatattgttttctgtagctgtaccaattttacatttccatcgatttgtgcacaagagttctaatttctccacatctttacctatacttgttcttttcattcttttttaaagtaatagtcatcctagtgggtgtaaggtggtacttatatagttttgacttatatatctctaatattagtgacgttgagcatcttttcatgtgcttattggccatttgtatatcttcctgggagaaatacctgttcggctcctttgcctatttttgaattgggctagttgtgggttttttttgttgttgttgttgttgttgttgagttttaggagttgtctgtatattctggatattaatcctcatcagatacatgatttgtaaatattttctgtcactttataggttgccattttactgtaatattgtcttttaaaatgtataacattttacaattttcatcaagtccagttccgtgttttcttttgttgcctgtgctttagtgtcatatctcagaattcattgtcaagtccagtatcataaagcttttgcctcatgctgtcttctgagagttttatagttttaggtcttacatttaggtttttctttggtccattttgagttaatttttgtttatggtgttaggtaagggtccaacttcactgtttcacatgtggatattcagatttcccagtaccattttttgaaaagactgtccttttctcattgactggtcttggaacccttgccaaaaatcattagaccatatatatgccagtttttttttttctggtctctattccattggtttatatttcaggactgcactgttttgattactgtagcttcgtagtaagtttgaaatcaggaagtgtgagtcttcaagctttgttctttttcaagattattttggctattcagggtccattgagattccatgtgaattttgggatagggttttctattactgcaaaaaatgtcattgagattttgatagggattgcattgaatctgtagattgctttgggtagtattgacattttaacaatattaggcctccaatatatgaacatgggatgtgtttttatttatgtctttgatttcttccagcattgattttttagttttcattgtacaagtctttcatctccttggttaagttaattcccaagtgttttattctctttgatgctatcgtaaatgggattgttttccttactatttaaaagtctttatttttcttgaattaatttccagacgtggtacattttttgtcttattttaaaatatatttttgaaattgtctttttgtgttctgtttttcatcttttccaactatgcaatctatgcacatttcctcagcttctttattacacagttgtgtttgtttctgcatattcatgctgctcagagtcaataagtccttgcaataagcaggaaaactgtgtgatctgagaattggtaaaacattttggaaactgcagacttagccaaatttaacttattactgacaccattttgttgctatattttgactgaccagtgactaaattttgaatacctaaccagaacaatataaataaaatagagtttgggaatgtgaagaaaatataaggagaatataaagtatatttctttctcttttgcagatttcaggaaatgacataatccttggaatttctgtaatattttacagaaattacagaaagaatatgtacagtcgatcctcattatttgcagattttgtatttgtgaatttgcctacttgttaaagtttacttgtagtcctaaaatctatacttgcggcacttacttggttatttgtgtgtatgcgcaaagctgcaaaaaaatttgactcctctagcaagcacattcccagctaaacttgaacaaggtgacactgccttgatttcacctctcatgaagagatgaccagaggacggagacagcagagggcagtgtagtgaagtgcaagaaggtctggctgtgggggccagttggatagggtttgaatcccaagtctgacatctgtttttgggatggccttccgcaagtcacttaacacttatacacctcatttctcttttgtaaaataaagaaaggagaatctccctggatgaattgttttcaggatttaagaatataataatctatgtgaggggtgtgtgtatgtgcatggttttccctatgaacaatgtttcagtagtcgctaattcagtgcttgcagtgattttataaaacataactaccacaaataatgagaattaactctgtgtgtttgctaaatgatgatgaatgattttattcttttttaatattgatacttgttcctaccaaaatcttagcaggactgaaaagatcaccataatttgcatgtaatttaaaacagataacagtatgaacagtctaaaagtatatgcttccttcagtgcggtttcctctctcttcacttaatagctttttggaactttggatatttattacccaaacgtttactctactctgtaccttagctctcccatctgtgttgctcataggttttgaaggattatgccagttcttaatctcagttccaaatacgcccttctatgctttgtgatgctggttcaaagactgcagatcacatttctgccttgctagcagctcatttctgtttcaaaagtatagggcactagagggaggctgcaaggagaaggaggaagaaatgacttacacctttgtcttgtttcctgtgaacttcctgtctgcttgttactttgaccatcacccttgtagaggttttttttttttttgctccagcatcagcagtttctttctgtagcagctgttgaatacagtttgtagtttttccaacactcacagaactaacctcatcataacccttcataacaccagcaccagttggctggtaccctgttcctcaaaagtttgggtcgcagtctcacaggacccctcttcagagacaacagcaccagctgagcagcactctgtcctcagaggtccgtctgagtttcagctctgtggaacccttcctccaagcttctgaattttaataattccaatcttttccctttgttcccatagtcctaggggtggtagcttttgcctgtagttgttacctccctgatcctttgtattattttttcagttggcaacagagttagtcattgtttttattaaatttctctattaaaataatcaatgtgattttcctcctgtctggaccctaactgatacaaggattaaataagttactaaatggaaagtgcagagaacagtgcctcttctaatagcacgatggatattactatatacgataacatacttgaaataatttgagatttttcttactgatttctttgcaaaatactaatatttccaatttatataggtaaaaacattaaaataatcattgaattttattgatattaatatgctcaaatatcacctcggttagacctaacttaactaccctatttaagttgtaaactctggcctgtgtgctctcataccccatttcctcatcttattttatgttttttgagacagagtctcagtctgtcaaccatgctggagcgcaatggtgcaatcttggctcactgcaacctctccctcctgggttcaagtgattcttgtgcctgagcctcctgagtagctgggattacaggcgtgcaccaccacaccgtgctaatttttgtattttttggtagagacagtatttcgccatttgtccatgctggtctcgaactcttgggcccaagtgatctgcccacctcgtccttccaaagtgctgggattccaggcatgagccaccgcgctcagccttctcatctttcttattagtttactttttcccacagtactaattgctaatatactgatttatttgttgactgtccactccccaaaattgtaagtaccccagcacagagagattttgcatatttgcacattgtcagcatctagaacagtaacctaacatatagaaggcactcagtaagtatttgttggaagaatgaatggatttcagcagatcaactcttttggtcaagatttgaccaagatttttaatagatttttatgcagtagttcccccttatccgaggtttcactttccatggttttatttacctgcagtctgaaaataggtgagtacagtacagtaagatgtattgagagacatcattcacataatttttatgatagtatattgttacagttgttctattttattattattgttgttagtctcttaccgtgcctaatttataaattaaactttatcataagtatgtatgcaaggaaaaaacatagtatacatagggtttagtactatccaaggtttccagcatcctctgggggtcttgggatgtattccctggggatagaggggacggctgtattacgtttcttttctagagcacatttcgctggggtgttgtttgtctttgtgttttctgcagcttggaccagtgccttgtagtggatgttcatgaacattttgagttgttcgtgaacaatttgagttgtttagtttttacattttatggttaaatgttcttacacactggacaattaggctcttcttcttttggtggggggaagaatacctcagccttgagatgaaatcaaccagattgatagaatcagtcccagtgattattttttctttttattccttgttttttagattccttttgtatttatcttacatattttttgtttgtttgtttgtttgcctttgattgactaacacctctgtgggactgaaatcatctctgttttctgtgctggtctttcagtttccagctaaaaattttattaaaatatattcttcactatgaaatactatataatgttagaaaatgtaaaaatatagaaagaaaataaatgaagatttaaaaattattcctgtactcaccacccagggaataccttctgttcaaacaagagtaatatgagggtgtaatttttttagaatatgaaaccagtatggaactttcagacaacttatgtttcccagtatccctcatttgtttatgtaatgtggccaagctctactgatgattcatgaaaataaaaacagtgattttaggtgatcatgactgatatttgaaatctttttatcaacagaagttatatttttaaattaagattgggatttgttattccatttttgtttttaacatttgtttagttcagtagtgcccatcctctttggcaccagggactggtttcatggaagacaacttttccacagactggatgcggggatgttttggggataattcaagtgtgttatgtttattgtatactttgtttgtattattactacattgtaatatataatgaaataattacacaactcaccataatatagaattagtgggagctctgagcttgttttcctgcaactaaatgttcccatcttgggctgatgggagacagtgacagatcatcaggcgttagattctcataaggagcacacaacctagatccctcacatacgcagttcacaatagggttcacagttcacgatagagttcatgctcctctgagaagctaatgctgctgctcatctgacaggagacagagctcaggtggtattgtgagcaatggggagtggctctgaatacagatgaagctttgcttacttgcctgctgctcatctcctgctatgcggcctggttcctaacaggccgtggactggtactggtttgtggccctgtggttggggaaccccgggtttagttatttcattaagcctttatgtgaagagttttttttttttttttttttttttccctgagacagagtcttggtctgttgcccaggctggagtgcaatggcacgatctcggctcactgcaacctctatctcctgggttcaagcaattctgctgcctcaggctcccaagtagttgggattacaggcatccgccaccatgcctggttaattttgtatttttagtaggaatggggtttcaccatgttggccaggctggtcttgaactcctgaccttgtgatccgcccgccttggcctcccaaagtgctgggattacaggcatgagccaccacgcctggcctatgtgaagagtttttatgcctttagatattaggtagataagctcttttttaaaaatactttatgtcccagttatattagtgtagagaatagtgtcacacacttgtaaatatttatttcagttttgtttttttaaagttttttagaactagatcctgatgagtaatcatgttattttcaagcaataatttgaggcactattcttttaatgtaacttttattatttatattaaaccaaatgatatcattgttggtataatcaatatatgacagaatttgttactgtgaggaattttagaggttatctagtgtgagttatttttcttccttcatgccagcccattcacaagtataaaagatacatctttaaaatctccaggacatcagtcaattaattttagtggctgcgtcatttttcattgtagaactgtactgcatgatttaagcaggttcctgttaagtgacatttaggctgattcactttttcactattgcaaatggtgctttgatgagtatttttgtatgtgcatgaattttattttatgaaattatctccttctgataaattcttaaaagtgagatttagacatttatttattgaaacatttattaactttaaaaaatttagtatctgtttttaatgtaataagtggagttttgctgaagtgatgttaatatacatcatagtgaaatgtcttataaaaacaacctagttagcattttaagatctgattcctaacgttaaaaatgatcctagtatctactacatatttggaaacctttcatttataataaatgatggtgagaagttaaccaaagaaggaaaacgagaaagttaaagtactaagaacaaggaaaaatgaccaaatgatagaaatatggggagactggaaagggtatagaggaggcaaaactttgcctccaccctcttagcgtccctgctgggcccgagaattaaactgacacaagatagagtagaggagaaaagcatagacatttaatataagttttatgtgacatgggagccctcaaaagaaaatgaagtcatagagaaatggcaaaacctacatgcttttgtgttaggttgaaagaagagaggcgattgtagaaaagtagatatgttatatggggaggctaaaggaagatgtttaatttaacaaggtctgtttgtacacaattctcttgactgtgactccctatcaaagaatgtttcttttctcctgggatagagaagacgtcttttacaggaacattttcatctcctagtttcaggaagaaaaggtggaagattagaatgcccttcttgcatctgctatttttcaagtgcctttcaaactcaaagtgatccttatgtcagagtggcatgtttgaagtggtgtattctgccacccttcacgggtaatgattatgcctagtgttccattaacggaacgctaagcttgtgggggttatttatatcctactgcccaaggtaattgccaaggtctgatttttcacaaaaaaaatttgcaacctctagcataaatgggttaatttcacacacaaaaatttgcaacctccggcataaatgggtttcaacctccagcagaaagggctttggaaacagacctggatttaaattctgtttctgcttcttactagctacatgacctgggaaagccttttaacccctcaaagctcatttatatcctcctttaaagtagaggtaataatatatcatggggttgttgtgaagattaaatagtaatagtaattacagctaacatttttgaatccttctatatatgccagatagtatattaaatgtttatatgtggtttttttttttacttggcagatatatgttatcttaattctcatgaacttgtgagatgtagataatttttactgatgaggagactaaaagagggattttgtaaattgccccaagcaacacagctaataagtggcaaaaccagaatttaaatccagcagtctgacccaccagaggctgtgatttgaaatgctgtcccctatgtatatgaagcccttagcacagtgcatagccatagcatgcattaattcatatttatgtttaggctgtcttttataaatagtgtgtcaagagaatgagaagacaagccacagactgagaaaatatttgcaagacacatatttgataaaggaaagttatccagaatatgcaaataactcctaaaacttaacaattagaaaatgaacagcccagttaaaaaatggtcaaaagatttgaacagacatctcaccaaagatttgacaaataagtatatgaaaagatgctcgacatcatatgtcatcagggaattgtaaattgaaaagatacaagtactactatgtagctgttagactggtgaaacccatgcttgctggcaaccccaaatgctggtgaggatgtggagcaacaggaactcattcattgctggtgtgtatgcagactctttcagccattttggaagacagtgtggcagtttctttttttttttttttttttttggagacagagtcttgctctgtcacccagactggagtgcagtggcgcaatttcggctcactgcaagctccacctcccaggttcatgccattctcctgcctcagcctcccgagtagctgggactacaggtgcccgacaccacgcctggctaattttttgtatttttagtagagacggggtttcaccatgttagccaggatggtctcgatctcctgacttcgtgatctgcctgcctcggcctcccaaagtgctgggattacaggcgtgagccaccgcgcccggccaacaatttggcagtttcttaaaaaactaaacatactcttacgatatgatccagcagttgtactccttgtttattacccaaatgagttgaaaaacatgtctacacagaaacccgcacatacatgtttatagaagctttatccataattgccaaaacttggaaacaaccaacatatccttaagtaagtcaatggataaactgtggtataactagacaatagaatattattcagtgctaaaaagaaatgagttattaagccatgaaaacattaaggaactgtaaatacatattactaagtgaaagaagctaaacagaaaggtctatacatactctgattccaagtatatgacattccagaaaaagcaaaagcaaaactatggatgcagtaaaaagatcagtggttgccaggggttggaggaaggaggggatgagtaggcagagcacagaggatttttagggcagtgaaactattctgtatgatattataacgagggctacatgtcattatacatttgttgaaacccatagatgcaagagcaaactgtaatgtaaactttggacttgggtgataatgatgtgttaatgtaggttcatcatagcaacagatgtatcactctggtgtgcagtgttgatgggggggtggttatgcatggagcacgagggaactttctgtactttccacgcaattttgctgtgaacctaaaactttcctttatcaaatatgtgtcttgcaaatattttctcagtctgtggcttgtcttctcattctcttgacacactatttttaaaagacagcctaaacgtaaatatgaattaaatatgaattaaaacttaaaatctattaaaataataaaaaattagaaaatgatgcatttgaaatgtgacacttctgatactttcattttcaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttgggtaagtattttctgttgatctaaaggagtagccaaaatgagttaattgtcctaaagagatgtttatgaattattaaaacctattttatgtcttatctcttctatttagttacttgtgtcacttgaatgagagttgatctgctgataagagagtaataacaaagttattctcagcttcaacagatgttcagatttatgtttcagattgtacagtttcatcatgattgtttgacattggatccaggtggaaaaatttggttaagaataataaatttcctaaaatatgaaattagatgtccttgtttataatttaaatttaatcatttaaaagttttaaaagtttctcttagaaattgtttataattttttatcctaaactttttgtaaatcttgtaataaactgtaaaatactagaaatgttaaatatttatcgtattatcaggttcaactttagtgcatgatgtgatggctaaagctgtatgtataaattttattcattttcagaaaatattaaggtacaagtagatatagaaataaaactttcatattcattataataatctgtcaatcacttgttctgtaccaacattagtttaatcaagaggactttttaaaatgcagcttcagtctttcttcctgaaggaagaagcaaagttttatgagagagaagagtaagtagtataaggaatacctgactggatgcctaaaggtctatatttttttatcccagtgctgccacttacggaacttggataagtcagttaacttttatgagtctgtttactcatctgtaggatgagtaatgatctacctcccaaattattttctgaataatgtaatgaatttgaaaacaatttctaattggcaagcacttgtaaaaaaaaataaagcattatgctgagggaaaaaaggcaggaagctacctaattagttaaaaatatgttattttttaaaattatagttattattaatgtggtgttttctgaaattattgttcagggctgtcgcagaatgtttccaaagattataatgcaaatgaacccatagactagttaataaacagataagacctttacttgggactattgcacaataaaaatttagacaactgtgaggggaagtttagtgggagacataaatgttaattaatcaaataatcacaataaatataaaattacaactgtggtaagggttaagaaggaaaggtacatggtgttatgtcttaccagggaagtcaagataagcacctatcagcaggtaataattgagctcggatctgaagcttttgtgggtatttcttctgttttttttttttttttttctaaaagaagtctctgtataaatattttcaggatttattcctatttaatacagtttaaaaaaacaaatgtatatttgttcacttaaagcacaagttgccttaaaaatataagtaataaaatctttcattggtgaccaaatagctgtgcagtacaataccaaatgaaaaagttctgtacctggtagttgtagagaagcagggacagtaaacatggcaattaacaaaaatgcccatgctttcacagtgggctttatcaaatgcatattgtttgagatttgtaactcttttgacaaaatcttcgtttagtatatcgtttccataaccagattatttgatagctatttctttatcttttttgctaagctgaagaaaaaatactgaaactcaaaactccatgtagttttagacacacgcttttttttttttttttgcatgcagatcctcattgaattttgtgcaggtggagcagtagatgctgtgatgcttggtaaatacctttttgttctttctgttcatatcttaaattatacttgataagatgaaagaatttcaaccatatataaatatattcaaatatgtaagtatcgagtaaagttcagtaagttaactcaagtatgtttttatattcttggataattatagtaaaattctaaaatgaaatgttgagtgtgtcaagaatgtgatctttgtagatatagttcttttaaaataaattccctgcatatgatctttgacagtgatgatatatacagaaaggtatatagcctgctaatatgttttcactgtataaaaagcagatttttttttttactttctccttatagaacttgagagaccattaactgagtcccaaatacaagtagtttgcaagcagactttagatgcattgaactacttacatgataataagatcatccacagagatctgaaggctggcaacattctctttaccttagatggagatatcaaattgggtaagttattcacttaaataaaacattagaatttttactctgaaatttccatctttatgtatgtgacttaatgtggttttattactacttaaatatgtgaaacatggagaactaactccatgctggtttttaaaaaacacttttttaggtaaatactcatttttctataatttctaaatatcagcacctaattgaatgctttaaaaagaagataagaaagaatgaatttttattttcaaaaaggcatgctttttaaagaccaatttcaagtttgtacccttaaatttttgtacgtagacttaatacttgtaaatgttttatgtttagaatataatatagtatgtaaaactgctaactcagttttttctttatttccaaagttcatgtctagtgagtttttccccatgtttagttttatattctattttattgatatggtacgttgactaaactaacaaagtaatcttagttctgaagagaatacctaaacgtaaggactagaatttttaattttactctttatactgagggaagaaatgttaccttcataagaagaattagatgtaggtcttatgaaagttatagcgctctttacccaagataggaattatttaaaaagtctagagatgaagtccaaatttgtatattttggaaggctattcaaaggacaaaatatattcagaagtcaagttgataccagtgactatagtcatttcactttactttgtcaagacatttaaacagatggtgtactaaattttattctttttaatttttttttaacggagtcttgctctgttgcttaggctggagtgcagtgatgtgatcatagtttactgcagccttgaacccctgggctccagggatccttccaccttatcctccctagtagctggaactgcaggcatgcaccaccacgcctggcgaatttttaaaaatttttttgtagagatgaggtcttgctctgttgaccagactggtcttgaattcctgggtgcaagtgattcttctgccttgggcctcctgaagtgaattttaaccttttgattgtgaaaaattacagatatagaaaaccacaccagaaattgtgtagcttaagtttagtactttgtagacatagctttgtaatcactacctagatcaaaaagtagaactttgacaggcatcccagaagctcttccgtatgcccatctcagccactgcccttctcttctccacattttatcctgacttttatattatttccttccttgtgtttctttatggcttagtcacccagtattcatctctagatgttagggtttaaacttgctcatataaaacttgggtttttaaagtctcttaacttacaggccttcccccattcctttcttttctttatattatggcatgtgtaatgggggatgagggcaatatcacccacatgggtgcaaaaattagttctttagggccaaaaaaaaaccttatgcattacaatggtttgtgaccttccaaaggccccagtacatgaagagatataacactgtatctatggcattaaaattttatgggaggagggatgatgtgaaaaaaatgtttaaaatgactccttagaggggctagtaatgaaacactgatccatggaacctgggctgtttggcctgttgtgtttccctcaaactgcattttgctattgcatactcctgatgattgaagttcctttctgtatttccttcagtttggcagatgaatccaaaggcttgatcagtctcaagcctgatcctttggcaagacttacaggtggttttgcattctttcattgggaggcacaccgtgtctgctttgtgcccttttttgatgttgcatctattgaggcttaatgcctacacctctgtcttttggggttgcaaaacgaattccattattttgttttcattattttcgataatgattttgatataaacaccaattatttcattattttcattcattataaaattagtaatgaagataatgacttggctgtctcttatcctcaattgatgaccagtgttttaaaaaatattgttagttcatggatttaattttatttggttggtttcaaatccattgcagtttttattcttattgaagctcatgttgttccatctttagtcagtggggtcttcctcgtgtctgcttgttggtcttcttgacagcactagtaatctttgatagcttacttgacagttctgagatgtttcaggctcatctgtgtatttcctgtgtcagacctgtaattaaccatttcttttttcttttctttcttttcttttttttttttttttttttttgagtcaaagtcttgctctgttgcccaggttggagtgcagtggctgatctcagctcactgcaacccccacctcctgggttcaagggattcttgtgcctcagcctcctgagtagctaggattacaggcatgtaccaccatgcccagctaatttttgttttttagtagagatggggtttcaccatgttgaccgggctggtctggaactcctggccagaagtgatctgcccacttcagcctcccaaagtgctggaattacaggtgtgagccactgcacccagtgtaattagccatttctttaagaagccctggtttcttttagtagaatatagtatttcaagaccacagtctggtgtaagagatgcttgcagttttctatattggccattgttctaggacttttcaaaggacagagctagaaccctcatgagttcatatatatttcctattcaaattcaggataaaggtttttaaaatctaacctctgtaataaatgtgcatctcctttcttctatgttgagagttctggttctcaaggacattgataggtttaggatacctcataattcattttaaccctcatttctatatttaatgctcaccaccactccttatgttgatgtgtctttggtgatgttggttatctgaagctcagcttttggtagattcctctgaaagggctctctgaattcttacatagtgataacagttgtacccttatagttgaaggttagttttgctggataacaaatccttggcacaaatttctttccttcagcatctgaaatatgttactctgttttcttcagtcatgaagtgttgttgttgaaaagtctgataatctgaatttcttcattgtaagtcatgtgctctttttgcttagatgctaaaagtttttttttttttttaagaccagtagtttgaccagtcttttctaataaatattttttttcttttcttttttttttttttttgagacggagtcttgctctttcacccaggccggactgcagtggcgctatctcggctcactgcaagctctgcctcccgggttcacgccattctcctgcctcagcctcccgagtagctgggactacaggcgcccgtcaccacgcccagctaattttttgtatttttcgtagagacggggtttcaccgtgttagccaagatggtcttgatctcctgacctcgtgatccacccgcctcagcctcccaaagtgctgggattggtgtgagccaccgtgcccggccttctaataaatattatgctcgtacaatattcgagtgctttcttccccgcccccgacaggaaagttttctggagttatagatctgagcatttgtttgttcccttgcattgacttgcttctttagagacttttagtatttgtttgttggatctttgcctgttgtccatgtttgtaactttttctcaagtccttttttagcttgctttcttttttatcgtaggaaaatatatacaacataaaatttacctttttgatcatttttaagtgtacatttctgtggtattaagtacattcccattattatacaaccattaccatcacctatctccatacctcttttcatcttgcagcagttaaagtctatacccattaaacagttagtccccattttccactcctcccagcttctggcaaccaccattctgctttcagtttctatgattttgaccactctaggtatatacgtatgtggaatcatacaacatttgtccttttgtgactggcgtattttacttaccataacgttctcaaggttcatccacgttgtagcgtatttcaagtcttccccttttaagattgaataatatgccattgtatgtatataacacattttgtttatccgttcatccatcagtgggcacttgggttgctttcactttttggctattgtgaataatactgctatgaatgttggtgtacaaatgtctgtcctactccctgcttttaattcttttgagtatgcacccagaagtggaattgctgaatcatatggtaattctatgtttaatttttttgagggaccaccatgctgttctccatagcaactgcaccattttacatttctaacggaaatgtacaaggcttccagtttctccgcatgcttgtcaacactttttttttttctatgctacatccatcctactgggtgtgaagcggtaatgggtatgaatttgttgtattatttgctcttgctttccctagtttagcctttgtttctaaagtttttcttttttattttaaattttttctggagctctgtcgcctttcagaatttttctaattctgacttacatggctcttttatgtttttcatcatttttaaaagtgtcctagcttattttgaaataggatgttacagttttgatcaattttgggggcattttttttgtaaatatattgaaattttatttgaatatagggacatacttgtgtaaaataatgtgtaccttatcaatatactgaaggtttaggaattgtaaaataatatttagttagttgacaattaaaatatttgtaatttctgtttaatttacaaatacttccagagaaccttccatttctgcaacacagatatatagaacaatcttatccccaagaaccatataatagataaaagtaattcaggcagaattgcatgacctttaagagttctacaacaaaaacaacaaaggttagaattgtgaatatggctaataatagctaccatttattgagtgtatactctgtggtaggcatgagcatcaaatactgaatttttggtacttattcaactttgagaattgtcgcatcaaatgtgaaacttaaaaattcgtgcatttatagcatgaggtgaattatgcagcaatagcagttttatgttgctgttaatgttgtgtgaactccaggctgaaaaggtgggattaacaactgaaaaagctataatgttactgttctgtataatttaaatcagaaaacataaggttcccaattttttcttgacaatataattttatgaggaatttagcaagacatacactgtcctaaaggttgctttagtataatttctatttttcacactatagaaaaaatgttaatgactcttagtttaattgtgccacatagcactagttggcatttattttgaagtggatagactggtctgcttttagagttaccattttttattttcaattttggaggatttgtcatctgaagataaggtggtattaaatgtattgataatgggatctttagcaggtttttttgggagatggtagaaagagatggtcaagattaagatgggagagacatctttttctttctgtttaacttactttttataataagattagccttattaaagacttaaaatgctttttctccccattgaatacaatgaacaatgcttaaaagttctcattaatgcttttgtgtgattatttcaagcggattttggagtatcagctaaaaacacgaggacaattcaaagaagagattcctttattggtacaccatattggtatgtattcagttttatgaatttatagtattagtcatgtcagcagttataattactcatgaatttttgtccacataattgattataccatgtgttttgcaatcactgttcttaaacatgttaacttttaattatctgtcttcataggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtaaaaatattcttaaaaaagcttaataagaaacaaatgatactaggaagcagaacttgatgttatattctcacaattttccaagagtatttaaaattggatacatggttcgaagactatatgaattagaaaagtgatttttggtatatttctcttaaagaccattaaaactcttcgagctcacttttcccatatatctgaaaatatgaatgatttgagttttgcatgagaaaggtattttctgtactatgaggaagtgaggtatatagattgatctatatttgtgaaatttattagaaattttgtgctttttggcatacttgtgagtatatggctgtctcagtgattatgtacctacttacatatatgtctaacatgtatttacagatgaataagttttacaaaatcttaatagtctcattaactagttatttaaatgttgaattaatactattacatacataatgaaacttaagcataacttatcaaagagttttgtttaatttgattaacaagaaagtaaaatagaatgttgttaaaatttattttaaaggtcttcaaattttaaggactttctaaagaaatgcttagaaaagaatgtggatgccaggtggactacatctcagctgctgcaggtaagagagtatgacaacagcaaataatataattattttaacatctaagaatgtaatttcatattcagtgtgctttctttccacttaaatttccctgtggagagtcaaaatggcagtagttaacatttgctttacaaaataaatgctgctgttaccatcaggcatttagcttaaacgttattcctcctgtgcttttttgattcagtttaattatgttcttttcattttggtagttatttccattatgtctctccagttactagaaagcaagctccttggggacaggggccgtgaactaattaattaaaaaatgtcttacagtgagggtaaatagtaaatattgttgacttaaaaaaatgttgttaaagcgattgggtaaatttaattttgctttatagaaggactacttgtaatatattaattaaaaattgtcaattttataggtgggcaaataaaatgacaaatcttgaggcaattactgttaggttattatgtaactccatcatagtgttttaggttgacctatttatctgggggaataaagcaggaaaaaattgctttgttgtgtgcagcaagtatacccctggaacacactttctattattattttgttacccccacacttgaagcccttagtctgcgacagacactgttaaatgttgagtatacaaagatgagtaaaatggcttctcattctcaagaattttagaaccatgtcaaaaatacaggtgtttatagatacttctaacagaattctaaagctttttataattttgaggctttgatagggtttatagagatggttactttttaagaagtaataatgaggccaggtgtagtggctcatgcctgtaatcccagcactttgggaggccgaggcgggtggatcacctgaggtcaggagttccagaccagcctggccaatatagtgaaaccctgtctctactaaaaatacaaaaaatcagccgggcatggtggcacatgcctgtaatcttagctactcgggaggctgaggcaggagaatctcttgaacctgggagatggagattgcagtaagttgaaatcgtgccactgccttctagcctgagtgatagagtgagactccgtctcaaaaaaaaaaaaaaaaaaaaaaaaaaaagtaataatgtagtgacctgacatttgctttaaatttcaattaaaattttttattacgaagttttcaaacacacagaaagtacatgtacctactacccagatataacaattcttatcatttttgataaatttgcttcagattcttaaaaatgtacagatccagttgcaggtagtccctgcttttgctcaagccctctcccctctttctttctcagatgtagcattatctgaagttttctgtcattttcctgcccacatgttcatattttttaccacataagaatgtgtgttgtgtgtgtttgaaacttagtttagtagtattccagttgttgagtatgttctttttaatgatcaacagcatccctttgttactgttgattccaacaaacccatccgagaattgattgcagaggcgaaggctgaagtaacagaagaagttgaagatggcaaagaggaagatgaagaggaggaaacagaaaattctctggtcagtatttaggaaagaaatttcatttagtgaatagagttcggttttgaggtgtagttgctcctgtatctaaggattgatgggtggcaacgcaaaacctttaaatttagacctgaagattagtagcaaggttgctcgtcgctgcacatttttgttatatttcccttttttttgagatggagtctcactctgtcacccaggttggagtgcagtggtcactacaacctctgcctcccggtgtcaggtggttcttgggcctcagcctcccgagtagctgggactacaggcatgcgccaccacacccaactaatttttgtatttttagtagagatggggtttcaccatgttggccaggctagtctcgaactcctgacctcaagtgatcttccctcctcggtctcccaaagtgctgggattacaggtgtgtgccaccgcacccggcccatttttgttatatttcttgtgagaagaattgttaattctttaaattcagcaacatttactgaataaagatctgaaatcactgtaggtctgtaaacattgttttggtcactctaaggtcatgttttaacactaaaaatacattaaatcttttttagccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagtaagtgtacatgagtcattgtttgggttttcctttgccattttctcaattcagagtttatgtgaaattgatgtcttgaaaataaaacagcattaaattaatgtagtattaacaatataaattcttacagcctatgaaagcaattaaaaagaactaaggagattgtggatctaatctttaaattttgtggtaggatctacctatttttgcagacctgatgcagataaacagtgtaatatggttgcttggtgtgattaggttcctttattggacatatctagatgcaacattagcaagaatcaacaatgtatgagagaattagaaattgaaagaatgatgtctttttaagcacatttagggtgtaaacaatccttgatttaccattggcccatacagtcacagacattgctactgccatgagaaccattgtggggaaaacaaaacaaacactaaagcccagaacacttggagctttgagtgtaattctcaaattttagtgtgcttaggagttactagcggctatgtagaagtctggagtgggtcccaaggatcactatttgtaaaaaaaaaagatcccacagagttctgatgcaggtgatccatgggctgccccttggaaaatacttcctagaccctctgggttgatagtagcagaagagaagacagaaaagcaggaacaacctaagaaaactgacatagatggatctctagggcatgagtgattagtctgcctatctgccccaaattcctaggattttcttacatgtattcctaggattttcttcttttttcagtttactttctttcactgactgaaataaccaccactctgaaattcattcactgacttaatagcctcttttaaaaatgcaaataacttgtataagaatgaagaagatattaattattgaacttttagtaggagctgaagaaatgtgaagtttggaggttaaggtgtagataggtgtattttttggagtctgccaactttagattttagaggaatcctgggtagggtaccatagtcctggactttggaagaagagcatgaggatcctggaagcttggagaagagaacagtaagaggagaggatgcagaaaggtgattggaaggtgccaaagagaaactgtttaaaatttggatgcattttgagtttagcattttcacattccatttttgcttcctctgccttctaaccctttcttccatatcaacacccagtaagtatctgccctgaacacttagtttaccaaaatgtatttgtaggagtcttatatgtctgttatttctgtttgcatttaaatgtttttggataccagttgaggaatgaagagtttagtcttaataaagaattttaggtcatagctagcagccaaatctggtacttttgggtgcagcagaggcactgtctttctagtaaccctaaaatcatacatatatctctggccctgagatggagggaggggctgtcgatattattgttactgattaagtagattttgatccccagtgctggcagtgtttaaaaattacctgagagctttttcaaaaaaaagagatttccagctaccctcagacctgtcaatttagtttttttttaagagatgagccccacaaattcatttttaattgttttgtcagtgaaaaagcagaggtatctgagaaactacaaattgaaaagatgaaaaaaaaggataacatgtaaagttctactgattagctatgtgaactgctcatcacttatgcctaattataatgtgtcataaaagctatacatgaagatgatcaaaatgcatactttgaaaaaatttgatttcatctgtaaagacgtgtaagtcagatgacgtttaaggtgttataactggttccacagatgagtctattgctttatatttatactttctatgtgtagtctgcatggctgttcagttgttttgttttaaaaaagaaagaaatgtttaaggaagaagaaaatgttttctacctccagtattccttgtacaaagcctaactaaaataaaatctcactcaggaaacaagaagacaaaagaaaacattgaagaaaacacgcaaatttattgttgatggtgtagaagtgagtgtaacaacatcaaagatagttacagatagtgattccaaaactgaagaattgcggtttcttaggtgagtagagaaacaacgtaattaaaactggtttgtgacttcttttcagtctctgaaaagtcagaagaatagagaaacaagggtaaattattggctaatttttttttattcttttactaccgttccactcgaaagaaaatttttaaagctttaaaaaaaaacgtatttcagaagtgtaatttttgctgtcttctctatcattaccattaaattttatcagacgtcaggaacttcgggaattaagatttcttcagaaagaagagcaaagagcccaacaacagctcaatagcaaactacagcaacaacgagaacaaattttccggcgctttgagcaggaaatgatggtaaagtctgattgttataccattttatatcattttgtgttaataatgacatttactgcattaaaaacagacaaacaaaaaaggttgtagaacttgttctctgattgccagatttctctagctttgtgatttatttctggcatttttacccttttggtgttctggatgccttttattgatttattcttttttcttgaaaggattttctatcccagtctaccttaagctggtttatggtgtgatgggttgttttttctctcatgaaaacttatgaagccagtaaacaaagttcctagatttgcctattgctgggtaatttttcagtgctctaattcgatctttcagatttggaatccaagattttaagccagtttagagcaattgccttcaaacctagctgagcagtaggactcctcaggggctttttaaaaatgtgctttattctctggcttctacagttaagcctccacatctctatttcctgctgctagaggaaatagtgctgactagtcctgggtagctgtcactgagtccttcagtttttgccttgtgtccaaagttggaaaaggaattagtaatgtaatataaaatttttgtaatttatgttgactatctgccttaatgtaggttagaaaaagtatcatttgaaatgttacagtactcatgttttgaatatagtccttgtgttgacttgtaattttaattgataaagattgttttgtgtgaactgtggattgttgattacatgagttggatcataactgagatttcctaagaaaatagtgaacttttgttctcattgagtatttttatagtacttatattgttttccaaaaccttataaaatctgtatttctcccccatcatactttctaaaatgttttacttttcaatttttttaaaaagaaaacatccattacaaataagtaactatacctgtattcaaaaacagtgttactgagtgttatataaacaggagtcttgttgcaagagtagatttataattccaaaagatctgttccaatagaataaggtgtttattttaagaatcttaatgtggaagattgaatctgaaaatgacaatcttattattaaataatggcgatattattaataatattattttattaaagtagacctcaaataagctctttgatttatcaaaaattttattggataaatattgaaatttttctgatttgccttactacttcacaacaattagctattcttctggataatctaaaaactttgaacattctactagtataatagaaaacaaattttgggtcgggcgcagtgccttattcctgtaatcctagcactttgggaggctgaagtgggcagatcacttgagggcaggagttcgagaccaacctggcaaacatggtaaaaccccgtctctactaaaaatacagaaaaattagctaggcaggatgtcacatgcctgtaattccagctactcaggcggctgaggcatgagaatcatttgaatctgggaggcggaggttgtagtgagcagagattgtgccactgcactccagcctgggcgacagagggagatcctgtctcaaaaagaaaaaacaaacaaaaacagaaaagaaaaaaaaaaagaccaggcccagtggttcatgcctgtaataccagtattttgggaggccgaagcaggaggattgcttgagcgcagaagtttaagaccagcctaggcaacatagtgatagccctatctctccaaataaataaataaataaataaataaataaaaagataagttggtcatggtggcatgcactgtagtcccagctacttgggaggctgaagcaggaggatagtttgagcccaggaggccgaggctgcagtgaactgtgattgtgcaactgcactccagcctgggtgacagagtgagaccctgtctctaataaataaaatagaaaaaaaatttccatgttagaaaaaaagaactcatttttttgagaattttcataacatattttagtgcatttgactttttcagtattgtgaaggttatagtacattactaaatttaaatactagttatgttctcttaggaaacatctttactataaggtattaatatgggtgatggaaaagttatcatcttgagctatattgttttacagagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggtaagtgtaaactactgtttttaattactaaagctttttttttaaaaaaattgttttaagactatctaaggatttaggaatactaataatacttgagagttaaatagcacctattcattctttcattcggtcttctcaacagtcatatagagttgtcataaggtcaatcattattcccattttactgccaagaaaactggagtaagagaggttttagtgacctgtttaagttcacctcaagagaggttttaatgacctgttcacagactacccctaaatatccagctaaaccttgaatcaggtcttcaaattgagtttaatccatcttaaggtctaccattgtccttaatgcaacacatttaagtccttatataaaagtattttttagaaaacttactatgttgtgtttgccagtggcagcagtgattcattttattatttataagttatttttcatctttaattcatacttttaacgattttgtttgttgattagctttattgcctttcatgggtattgtgccaaacaaaagctgaataacctgaaatttgacatgctatctataactcatcaaattgtgaggtacttcgaagaactagaagtggaacatatctgtaaagtcatttgatgagaatgagttttttcattgtttcctgaaactgtttcatattgttatagaatctgtttgcagtataaaagattgtcattgcttcagaaggaagatttacttattatattagcatctttttttgtcccaaattaaaactaaaagagctttacatgtaggtaattttcagagataattttataatttattaacatcttcagtataggaagacgatttgccttttcatgatataaaagacaccagagacaatgattgtgatcaattttattagggttggaacaaacagaaacctcagccaaactaataaatgcattttcacttttgttacacatctcaaatacccagattcattgactttaacatttaaattgagaagaaaattgaatgtcatactgctgaatcttaaggatttgctttaaaaagggtagagtcaaacattaataaatacagtgattttatgatttctttagataaagatgaatgaaatggtatgtgattttatttgatgtggcttccatttctaaaaatcactattttattactatttctgatgttttatgtagaattgctgtatatactgtgaggtatgacattactggggctacatgttaattttctctcaagtagtttttgagatattctttatctcagtgaaatttaaaaaattttacagataaatatatggtttaatcctaaatataaaagtctcagttattgtttttgtttgggggtaggagagtttcagccacgaacatgtttgagatcgtgatatgcatattttaaataattacattatgtatttttttttccttattgctaaacttcttgcatttggggagtctcttccttttaatggtgatttggtttcatgagggattactgatgggaaattttaaatacacgatgttaaatcaaaatcagtctctttcacggaccatcaatagcatgtggtgatttggaatctggtttcttttggtgcttctacttgtaaacacatgattgtttttcatagttggattacagatctattgttagatggaatatacttctagtattttgaaatgattaaaagaaggagctctaaaatgtacttcattctgtattttatctgctataataaatcatagcttactaaacttacttttaagagtgcttatattaccaatttttaagttgacaggcttagcttaacttgtcagcaaaggggaatattctaatcctattcaagatcatcagatacattcatttttaccacaccgtgtataaaatggtgtgtttatgaaaaaacttagtatccatttatttctcctttgtgtattctaagacttgctttccttttttgtttttggcctcattaagtagattttatttagcattatttctttagtatgatcaagccaattatgaaattttgcacttttataaatggcattagctttccttatgttcaatatttccaactatgtcaatagatacgtttataattttatgatctttcaacaaggtcagttgagtttatcacctgtagttcagcatcagtgctgcaagtaattcttcgctggttgtctttggacctttaagaaagagaatgatacatagggttattaagcaactaattaacctttgtgtggtgtaatgtccctttctgcactgagattatgcatgttctcttctttcattctttttcaccagactaacacctatgctaatgcatgttgaaaggaactttttaacaactttaatatttgacttgtagcttatctgctctcataaatgcttgctgtggagaaagtatcatttccccacctcctgcatgcttatacactgtaggttataaatgaagtggagaaagcacccaaagagctgagaaaagagctcatgaaacgcaggaaagaggagcttgcacaaagccagcatgctcaggtaacagcagcagcttaatgctactaaaaccagaaagcaccattttctcacagcttgataaaccatggttgaaagggtaaattttaagtgttattattatatgatgttgacttctccccattcaaaaactcctggaatcttctttatttaatactaaattcctactaatggtgacatttaagttgctaatatgaagttaagtggaatgtttggaaagttgactccagatgaaataaacaagtatatgaatgtataatccactgttatctgattttaatcttgatgggagcttatagttttaagtagtaatgccaatgtttgttagaaaacttttaggacataaaaatagaggatggtatataagctttgtgcttacaaaaagtatgcccattaaaacgctattatttctataaagtgcagttagaagaaaaatagcaaatggtaactttaaatggtagttcaaacatgtattgcttttaagcttgacaacataagcaactttaaaactggattttaaatattaagtaccttgtttttctttttggttcacaatccagcagttaaacaaatagactatttttacctatatagagtttaaagcaacccaatctaggttatgataaagttaagccttgtcataagatgggtgaattcttttttttttttttggtgaattggagtctcgctctgtctccaggctggagtgcagtggtgtgatctcggctcactgcagcctccgcctcctgggttcaagcgattctcctgcctcagcctcccgagtagctgggactacaggcatgcaccaccacgcccagctaatattttgtatttttagtagagatggggtttcaccatgttggtcaggatggtctcgatctcttgacctcgtgatctgcccgcctcagcctcccaaagtgctaggattacaggcgtgagccaccaccaccggcttggtgaattctttacgaagtgagataaattagtatttgtaacagaattttctagaattatctcacatgacaagtctttcatatgaaggaagatgaatcttctgattaaatttatgctaagcctggaggcaaggataaatgagctcaattttccattacataagtcagtgaaaggaagaagagatgtggatcgtgtatttaatcgatcctttgaattatctttttaatttgttgttttatgtgatttaacaagtggttcccagacttgtggattttatagacccataaaaagaaacatagaaacaataaaaaccactggggaccatgacatgggctgccattaaaaaaatttttttttaaattttgctaagtaaagatattttaaaactgccatttacttgtcaccatcatttcaaaggagagaatatttttaacaccatgaaaaataaggaaaatataatcttagaatttaaaaattaaataaaactagcttgtctgaataaatttagtttgcttttgtttttttcttgctatgagccattgaaacattttttcttggcctggtgtgggtattcctagtttaaggtggttaatagcaaacgcagcatttactatatgtcaggcattgttctaaatgctttatgtgtatgaacttatttaatctgagttaattatccttgaggtagtcttattacccccagtttacagttgagggaactcaagcacaggaaggctgagtgaccctcccaaggtcacacacctgggtagtggtagagccaggattctcatccagataagtttgggtacatgtttcacacactgattcgctgcaccatgctgcctctcatatttaagctacctacttgtgctgcaacttaaactctcgtcagcttgactcagtggttcttggccatgtcttgttaccaagtgaagaggaagtccttgctggccacacatgtacttttggttaatttggatttcaaaccagattagaataatatggtttttgccttataaaggaatatagatttttattaattccaaaaggccatgtatcaaattctaaagtcaaaactgagaattaatgttgaatgaattaggtaatactatgttttaataagactttgttggtgatttttcatataattttggtaacaggccagtattttctgagtagagctgaaagtaatcataaattccttcagtaaatctaatgaggaatttagtaatctaacaaatattaaaagtatttctatctactgctttaagcgaaggtacaaaagctttataactttacagtctatttcaaactttttttgagaattcataagtaatggtcatacagtcatggagctagaacatatttgatcatttaagtccagtggttttcaaactatactaacaggaattttgactttgaaagaagcaactatgggagtccctaagacggcaagaactctgggctgtgagcccctgcttctgcttcaactcaagcaacaccacttttgctgtggtttataaactgggatttttgggggtgaattttaaaaaagggggttctactagcttaaaaaacaacagcaacacactagagtttggaaaccactgatctagttcaaatccttcattttacagatgagaaagaggtccatctgttaagtgacttgttccaggcctcaagaaactcaacatttgtataattattcttttcgtttacaaaaagtcattcagatatattctcacctgggaggtgcattctattctgatccacagggtgttgctcagatcatgattcagtcttttcagttgtcatcttgtgcagtcttcaacgcccaaatgcaggacgtaagtcccacgtgcctgtgggaggatggcttctcctgttttacctgccttttcacatgtgccttttcattgttggcttcatttgccaaaatctagatgattgatacatgataatgtttgtaatgacaataatagtgataacctgactttagacttcagtattcttcagagttttcacatttggttctcattgccaccaccctaatatagggatggagtcatataaccattttacagatgaagaaattgaggcacagaagactgtgatctgcctcaagtcacataagagattaacggtagagctggaactagagcacttttaacacggtgttctgtctaccccgccacaaattctaatttgggattttcatgtttctcaagaaaataaaataccctctcaatagtataagctttgcacatgtgagaaattgaatgctgtgattagatttttattttcgtgtgaagtgacattttgattgcatatatgtttatgtagatgttttaattatggatatggtcagaaaagccatgttaaaagtagtgattttcattccgtttaactctattttccatttattcaagtagtcaataatgaatagtgagtttctattctccttattgtagttttaagttaagttggaaattccaagctgtattctttcttgcagtttctatagggaaataactagctcatttaacactgtaatttttgtttgtgacgtctgatatatacaacaggagtagatagaatacagcttgatttcaacccctcctttttcctctcctgaaattagacttgttttttattattggcagctgtttgactttttactgttttctaagagagtaagtaaaacattgatttttaaaaggagagggagaaattatgaattacgatcacttttctgatcattaccatttttagcctttgttttcatttaaaatgatcaaattctatacaaatagcccaatatatcataaccctttcttacagttttctagaccccaaagttatatttttaatgtttatagttatctgattaatatgataaaattgtttatccacatttaaacttgtacttttaaagggcactcattttacaatttatgtgtttactttaaaaaatgatttttggccttaataatttgggttcttttgttgttgtcttttatttgttaatccaagtgattaagttcatctttttttttttaaggtgtgtttgtgtaatctatttgaaatgtgagtgctcttttcatacctgaaagtaatttctaattataaattccatgtgaatgttattgtatttggcttttgaagttagggaatttagtgaatgtgtaataacattaacattttgtttgttttgaggtaatgaaatatattgattagtgtgtaagggaccttttcagataatttttagctttaatataaaaaatcctttatacagtgtccgactacatagtcatccagattctgcttaatttttcaagtctacagctctgtaaggcagctgggttctttgctaactctaattgttaggacttgtatacactggacttatatctgcctatcttcacttttacctgttgatccctatcttacttctggagccacacagtgctagttctgcctgcttcagtatataaacagtcatagctcctctttaccctttaggagttagctgctttaaggaacacttctctagttctttcaggcagtcattgtgaggcatggtttctgaaccctttattcccagctttgagttttctgtggtttacttttgaacttttaaaaatgtgatactaagggaagggacccactactctttatgtggactgagaccaagactgttgatacttgggaccaattgagtggaagctccttgaaggcagaactctctttcattaattttagtaaccttctaagtagtatagtgtccaccatttactaagtgcttaataaaggttttctttgaattgaactcttactgtgtttaatttagacataaatacagtaatatgaacaaaaattgcatagatgagaaattacatttactgttttagtggcactggcttatatttaccttttttattttcccataagtatttattcaccccatcctttacttttgtgtttgatttttttgtgcctaaatgtaagatttatatttatgctagttaatttagacccattgtttctgtctacacagattttttttttaatcctgtatgtaaaccaatgataaaaatgttgaacaaaagaaaaccctttgatatttttgcaggttatgttgtttattgaacaagtttgtatatagaaattttacagttgaggctgggcgcgttggctcacgcttgtaatcccagcactttgggaggccgaggtgggcgaatcacaaggtcaggagatcaagaccatcctggctaccacggtgaaaccccgtctctactagaaaatacaaaaaattagctgggcgtggtggtgggcgcctgtagtcccggctactcaggaggctgaggcaggagaatggcatgaacccgggaggcggagcttgcagtgagccgagaccgtgccactgcattccagcctgggtgacagagcaagactctctttcaaaaaaaaaaaagaaaaattttacaattgaaattagagaaacagtttaattttgttacaaatagtaggaaaaagaaaagcttgaacaactttgttataactacttaaaagataggcttggagattttgcatctcttaattaaaactcagaagcccttatattctagatagttgaatttaaatattcattgaaaattttttcaatgataattttcttaatgataaagttttacaggtgactgtagccaagttggtaattgcattttatagaggcattcattagtcttttctttctctactatatatgtatttatgctaaaatgcaaatgatgatgcagatgaaacagcagcatttacaacaccaaattagttcactctctgacatgaactgtgtcacctccagagattcaggatggtagcaagccaaccatcctgaggagtggagtgagactctctgtgcatttgaggagctgcctggcagtgatccagacctcatcagactctgaggcctcaagaatagttccaaaatgcatcttaggttttgatgttctcgaggatgtgcaagaggggggattgcaagtgaaattctgcttcaattttaaattctaaatccacacaaaaattgattgaatagtccatgagccaatcaccacctgctgtaactgccaagagagggatggacagatccaaatttacatttctttaatttggatgctgttccttttcttctgtaaatgtatgattctagcagaaagaccataagtcactttaacatttcctttttttgcacaataattgaaggatgtttttctaaagcagaaatttggcattcgggtagatagtatgtactcaataaatatttgttgaatgaattagtgaatccgaaacatgtttatagaattctgtgattatacaaattttcttgatagatttatagtatgtaactcactttcctatctccagtttgcatttctctagcaatgcattctcattaatttctcaaactattgttcttctttttaggcacatgctgtagatacagaaactatcttcttctgttaggatagccatgatatttcttcctaaaattcttcctctttagttccccaaattctgatatctgttttacctattagctcttaattgccttttttcctagagggcctttcttttttattttgagatggagtctcactctgtcacccaggttggaatgcagtggcatgatctcagctcactgccacctccaccctctagattcaagcaattctcctgcctcagcctccctagtagctgggattacaggcacccgctaccacatctggctaatttttgtatatttagtagagatggggtttcaccatgttggccaggctggtctcgaactcctgacctcaagagaaccacccgtgttggccttccagagtgctgggattacaggcatgagccaccacacccgacacttaaagggcatttcttatttatccttgttttagtcacaccatagtggaatgagtaatcagttttagaagctgcaaatttaccattctctcaaagatgctagtgtaatagggcactttaattatgagtgggctatatgcttattctgtatgtatccttcttagtgagttgagaatattatgtattctaatgcttttttcttagactgaattgggtgactaaatacatttgtactatataattttagtgattttaaaatccagctaactttgcaaacttggtttggaaatcttgttaaccactaatatatacagccatatagataaatggatgtttagttcattagatacttattaactgacaattaactgtttttaataggaacaagagtttgttcagaaacaacagcaagaattagatggctctctgaaaaagatcatccagcagcagaaggcagagttagctaatattgagagagagtgcctgaataacaagcaacagctcatgagaggtaatttttttaaaattaagaaatactgcaaaatgtagaattccttatgacagtagaagtgaatgtaaacatataacccttaaaatttcttcttgccctgatgatgctggaaatatatctgaataattttgtgtactcattatgccttatagttgttagtatacctaatggtcgtgtgttagaatgggatttaaagtacttatcttccctaacaaattagcttagatttttttttctttcttattaagatgattaaataggattttggtgttcggagtaggacattctctgtttatacgacattagaacagtctggaaagaggtaatagatattgccttacattggttacagttgcacttggacagctcagaatgtcaacatgtgtgtacgagttagtgtatttagaatacttctatgtaaatattaaaatgaagagcaaagtacattagtaaaaaaagagcaaagtgacattttgaaaactgctgtcttctagctcgagaagctgcaatttgggagctcgaagaacgacacttacaagaaaaacaccagctgctcaaacagcagcttaaagatcagtatttcatgcaaagacatcagctacttaagcgccacgagaaggttaatgaaaggaaaatttcttcatttttttgttcgttttaaagtttgcaaagctatttagttttgaaacttaagtttcttagataatgaattttagatttcctttctgtcttttatcctacaatttcttggatgaagtttggagtaattaattgtatcttgatcatgattgcaaacttcttttctacaaattataaggaaagtaactaattacaatgcttaaagacgttttacaccttgtaatcttcatctcggctctcaaaggtagctattttggctctatttgtggttcaagtatcttaaagtatggactccttgtacttattaagagttgcagtataaaactctcatcactaataactttcttttctttttattcttttgagacagagtctcgctctgtcacctgggctggagtgcagtggcactcagtcatagctcacttaacctcgaactcctgggttcaagggatcctcctacctcagcctcccaagtacattcatgcaccaccacaccctgctaattaaaaaaaaaaattttgtgtgtggagacagggtctcactatgtttcacaggctggtctcaaactcctaggctcaagtgatcctcctatgtcagcctcccaaagtgctgggattacaggtgtcagccaccagacctagcctaacttcttacaagttattttgtgcctagtattttgctggtcactgcaacaagggagagggtaattataggaaacaacaataacaaaatgacatatttgaatatgcatgtgggtactgactattgtttctgcgtcactggattctatttaaaactttcataggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacaggtaaatatgcaagttagtctcttctcttttaggtttaaaatttttgaatgaccattagaagttctacaaaattcctttctttctaaacaattagagccaccttaggcttgttgatgttcactttaattctgtgggctgggactatagatacatggcatataccaattagtcttccccaggatggtggtcacagagagcaaagcccttcctcctataccccataccagctcctgagctagactggtcctaagaccagccctgggaatgagatgactcggacaacttttcaagtcaagatatatggcctcactgtgatacttctgtagtcatggtcacacacacaaattaactcagatcactaagcagataggaggatcaaggttttaatcagaagttcctgctcttctctgaagctgtgatgtggactccaggtttgagtctcagcatattattacttgtagcttcagtttattgtgccttgttttgttaaattcctttatatcttcagaatatatagaaatcacatgcttctgaactatagtttatctttttttcttatttatagtttgctgcacaagaagaaaagaggcagaaaaatgagagaatggctcagcatcagaaacatgagaatcaaatgcgagatcttcagttgcagtgtgaagccaatgtccgcgaactgcatcagctgcaggtcagatacagaagcctgacagcaaagcccataggatgcggcagcacaagtggctgcttttgagagaacagtagctagccaaagtcaactgcatcatacacgaacatgctgggtttgagaggttctgttttttgtacagatccaaatgaagatcagtttggtatcataggcacttgtgtagattatatataaccatgattaatgtaaacataaagctaaattgtaacctacgaaattgagtctttcaaaagcagtattgagtatggtttttagtatattttgcaagaagatgtggagagtttcaaaatgatgtagacagttttgttgtcatattctgaattttttgtcagattctaaatttaaaatttcttttccatttagagggaaatagtttattttcttctaggtttttgaaataagtgataagttaaatatatgggaatttttctcctaggaaatttaaaagttattcgagagagggctgatttaggaccttacatagaatgtacagcccatctaaaatgtttaagatttcagagtagtgtataaatgtgggtatctatatatttgcttaatttactatagtagaacagatcctaatagattggcctaatgggccaatagatcttttacaggaatagatctattaggccaaccctttagtaccagatcccacattctgtactcacgggtaaaatgtatgcaggctgccttctgaagtgtcagttttatgagcaaatcttcttagaaaggaaaaacaaaagctcaagctagttctttttaagttctttttatatggtatgtaatagttctagcttctaaacttgtaaaaatgaagctatgattcatttcctaattcatggcccttggtttttatagaggaaaacttgaatctcagtaatagcatgatatttgatgagtaatttattattatggaagataattgtatttgtgaaaaattgcttagttgatctgaaatttttttaaatcccaactttattttcagaatgaaaaatgccacttgttggttgagcatgagactcagaaactgaaggagttagatgaggaacatagccaagaattaaaggagtggagagagaaattgagacctaggaaaaaggtaattttaaaagctttaattaaaatgatatgtgtgtactcgtccgtctacccagctattggctctttacctactgtgtcaggtacagtgtcaggggcaggaaacatagagatgaaaagacaaagtttttgtccccagaagttttggaatctagtgacaagcagttaggaattggtagggtcattgctctgaaggaggtgagtacaggatacaagggaaaggaacagattttgtaagcagaggaggaggagagcttaaatctgcctgggtaagtcagggagggtcttcaagaggagatgccttgcaagccaagtgagtcttgaagggtgagtaagaacttgctaagcggatgggctgattggagtggaatgggatgatttgagtagggagaagagaatgagtgaaaaggaagcgtacagagaattgtagatcgttctctgacattggagtatgagagggggtgtgtgccagtgtgtagtcattagggaggaagaaaaggaaggaaggaaggaagcgatgacagctgagtctgaacaggtcaactggagccatattaaaaggccctgttattctacgtaaacttgaaatctggtaaaatagggatggtgtcttctctgtctcacccctttcccttgtttgtgcttgacaccctattcacctggtcttactggctaaccatttcacctgagtttttgctatcactatatgatctctgacccttcgttactcaaacttaaacctttgttttggggggagcttcctgcctactgtacatttccaccattcctttcttccatccatacaatcagtcaaggaaatatgtatttagctatgtgccaaaggaagtgaaatgactaaatgagttcatagtgtggctttttgtttgtttgtttagacagagtctcactctgtcgcccaggctggagtgcaatggtgcgatctcggctcactgcaacctccgcctcctgggttcaagcaattcctctgcctcagccccccaggtagctgggattacaggcatccaccaccacacctggctaatttttgtattttcagtagagacggggcttcgccatgttggccaggctggtctcaaactccaaaccttaggtgatccacccacttgggcctctcgaagtgctgggattataggcgtgagccaccatgcccggcccatagtgtggctttttaatttaaattttctttattgttaaactttttgaataggtaatgcattcatgtagtttagaattcaaaaggtacagaattgtaaacggtgtaaaatctcctttacctacttgcagcctagcatctgcttcaaacaccctagttgaactagttgacagtggtcacaagtgagttgctaatagtcaaatcctatggccttatctaactgttctccttaaaagtcttgtttcttaaaattctcctctcacctggcttttgtgacacagctctgctcattctctgtgttctttatccccttttgtctcctgaaatgtagacatttctcagttttgcccctgtagtaaagaacagtctttaccttgatgattttattgctagtcatggcttcaactgttgcagatagacaactccaaaacttaaatggtagcagttgtatagagcatgaattgtaaagtcatacaggtgtgtgttcagatctcagtactgacacttactgattaattttctcacttaccatttctaggcctagttttcctaatttgtaaaatgagagtgatactacctatttggtgttgtttatatagcagttatctagtacctgagctatagtaatggttcagtgaatggttgctgttgctattattgtttcttgtttttattatcagtttgggcagtaagcgcccattttccatctgggtgttatgctcctcctcatttcacctaggccttgtgaccttttttggtcactgtatctcagtagcacctatactgaaccccaaacattctgtatctgctctcctttctttgtttttctttgtaacaattcatcaccaccagacacatttgtttattgtcccctcttgcgagtgagaatataaactccttaaaagcatgccatgatcgcttcatttattgatatgtacccagtttctagaacagttcctggcacattgtacagatgactacatacctgttcagtgttgactaaagagtataaactcagtagagagaaaaccaaactcagcatccttttccttcatctccatctcacctttccccactcactgcaggcccactcactgccagatgttccttcatctccatctcacgtttccgcgctcactgcaggccactcaccatcagatgttcttttctgcattcctgttctcttaactgacatctacgctagaaaccagaattatttttcatttctgtcacaccctacattcaatcaggcgccaattaatttggactctttttcataatgtgtctcctttctttctcactgctatcctggtgcttgtttaaattattcaggaatttcctaatgggccttctaatttctagttccctttcctttcttcccactcgcctgccatcaccggaggatttatcctcaaggacatctcttgacactgtcatactgatgttgagaaatcttcagttccatcagagtaaaatgtaaattaatgcctcagtttgactgtgaagccttcatagtgccacacctgagtcacagtcaccctttctagcttcctctcccactagccactttgttcccagtccaggttccagccttgggtataatggccactcctcataccagctcctcggcttcctgcctttgtgctgtgtttcggctctgtttctggcatgccttccctatgctccctatcaaattcttatctttccttcagcactaagctcatgtttcacctcttttgagaacccctcctatatccttccttcttttcctgtgctttgtacctctacagcaccacttatccctgaatcacttctccacaaagtcattgatacctgtaacaaaatgccataaactggaggctggggagtctgagaccagggtgccaacacggtcacgctttgatgagggccctcatttgggttacagactgccgacttctcaccgtgtcctcacagggcggaataacaactctctttagcccctcatgaaggcactcatcccatttggagggctctacctcatgacctcatcccttctcagaggtcccaccttctatgcatagtatccgcacattagggattaggtttttatatggatttggggggcacagacattcacatcacaatggtgcctcttacatttctcaagcacttatttttgctctgtattatggggataaaaatgattctgatttaagttgtacctttaaacagcttatattatagtctagtgtgaaagaaaatacaggcgcatcgtaactaaaataacaagtaggcaggggtaagtgccatgtgggagaaacacataatagttaataataggtaccatatattagagtgcatagtatgtgtaagtacatcattatcacatttatacttcacatagcaaattatccctatttttacagcagaggaattgaggaattaaatggttctctaatatagggaagttaagtaatggacccaaattgtccatttatgtggctgagctggacttgcacatagggctgtacaaagcttatgatcttaaaaaattgagcaggcgtgtcttcttgaggattatatacaaagaaagtgttttggacaagtagttttatcttggctgtcagcataaattctatatataataccagcacatagcaatttctttttccctttctttttaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaacttctcaatgcctaaattctgtagttgaagctctgctgcagagagttgggataattttcttttggtggatcagctctcataaaaaagctatgatttgctcaaatatgctgttgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaacatctttagaattaaaaacatggttgttttggaatttttgcttctcttaccgtttgatagaaattttcatcctaaaatacatgtacaaagtttggaaagatgaaaaaaagaggtagcttttagattgcaaactggaaatgtaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcaggaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgtt

SEQ ID NO: 36889 - DNA, 1378 bp, Homo sapiens
agctgccttgcacagcctcgcaatgagctgccacaactgctccgacccccaggtcctttgcagctccgggcagctgttcctgcagcccctctgggaccacctgaggagctgggaggccctcctacagtcgcccttcttcccggtcatcttctccatcaccacatacgtgggcttttgcctgcccttcgtggtcctggatatcctgtgctcctgggtgcccgccctgcggcgctacaagatccaccctgacttctcgccatccgcgcagcagctgctaccttgcctggggcagaccctctaccagcatgtgatgtttgtgttccccgtgacgctgctgcattgggcccgcagcccggccctcctgccccacgaagctcccgagctgctcctgctgctgcaccacatcctgttctgcctgctactcttcgacatggagttcttcgtgtggcacctgctgcaccacaaggtgccctggctgtaccgcaccttccacaaggtgcaccaccagaactcgtcctcgttcgcgctggcaacgcagtatatgagcgtctgggaactgttttctttgggcttcttcgacatgatgaacgtcacactgctcgggtgccacccgctcaccaccctgaccttccacgtggtcaacatctggctttccgtggaggaccactccggctacaacttcccttggtccactcacagactggtgcccttcgggtggtacgggggtgtggtgcaccacgacctgcatcactctcactttaactgcaacttcgctccgtactttacacactgggacaaaatactgggaacgctgcggactgcatctgtcccagcgcggtgatgtggctgcggtgggtgcccctaagactcgggactgctgtgcctttcacacttgaatgaagagaaacacctgagctatatatttttttaaagcaactaacttattgctttatgtttatctatgaaaaccatagataaaatctgatgcatttttgtaatctgacaaagtaatttacatactgtttgtgtatcaatacaattttgtgttcttggtattcttagtctagctcacctcaatagccttgaatcctgcatatgaattagacattcatcactggcatatttagaatatctctaaaaggacttgtttgtagaataaggaattttctatgtttcaaagtgttctaaaacctggctaaaagaatgtatttttgtggatggtgttgacttctgactctaaaagcaatcaaacatgtttctgctggacagtgaccaagaattatagtaccttcttatatttttttatagaactgtatatttattttgaaagaaatgttattcgtgctttaaaaaggaaaaaaaaccatgaatcaaataa

SEQ ID NO: 36890 - DNA, 56385 bp, Homo sapiens
tccataaaggggttgcgggggccgcgctctcttctgggagggcagcggccaccggcgaggaacacggcgcgatgcaggttcagtgccagcagagcccagtgctggcaggcagcgccactttggtcgcccttggggcactggccttgtacgtcgcgaagcctccggctacgggaagcacacggagagcctgaagccggcggctacccgcctgccagcccgcgccgcctggttcctgcaggagctgccttccttcgcggtgcccgcggggatcctcgcccggcagcccctctccctcttcgggccacctgggacggtacttctgggcctcttctgcctacattacttccacaggtagcgtttttcccttgcgggcgcccagtgcagcgcactgccctgctcccggcgtccaggagcgcagcgtagagcgcgcaccgaggaacgccaaggaggcagcgtggggcgctgtgaggaacgcggaggccagcctgcctggcgcacctggcgggggccggggccggggcttggacgctagagagttgacaagcggctgcggcacagacgccgccttcactcccccaggacctcatccgctctcagcagctccaaatcctctggctgctcgagagaaagaggtcctgcgggcgggaggcgacctggaaagctcaggttggggagacctattggacaggactgttccttaactgcgcgcaggcggcggttacctgtggcatatcgcgccccgccccgcttccctttcttccttcaccttttccttgcagggtggggacagattagttctgggatcttgggagagtcttacgcgtttggcatctcccgagggaaactcagctcagaggttctcattgatttagtctttgcaggtctaaggaggaaggtgggtagagcccaaatccagacttcacagatggggaagagaatatagtgagatcccactgactcaagcgagggtccccgcttcttaggcccctcccaaaagggaccaagcacaccaccaattcatctacctttccaatttccctgggacttgaaatgtgagtgggtaacttacagctcaaatgttcttctagatttaaaaaatccgggttcaggagaactttgctttctgctctgggaaggaaagacaggaaagagaccaagggatgttagggttcagagaaagactgtccagcctcagtaaagtctcacagggaaagggaagaacgaacacattgttaaattgcctaccatgcccaatcgtttagtatctatggtctcacttaactctgttgtaaccttttgagagatatttattatgtccactttacaaagaaactgaggctgagtaaggttatgggactgaaagaagacaatacagctggtgcccgctaagatgcaaatctgagcttgtgaatctctgaggtttaagaccttttagccgttttaagtaggcagatattctatgcaagaagagaacagagcccataaacagagaaaagttatcaaacgaaatcaaaaccttgaaggttttgccttattttgagtagaagattcctagggtcaaaagatcaaggaagtttggattagaaattaggataaagaatgcctctggcataatctgtctcgtaaagagaaagtgatgcctcatttcgagagaagaaggtgtcagagacggatttcaaactgtctttcttaatttcctcttatcctctgaatcttctttattggtcaagatttaatatttatgcaatcttaactgaattctcactctttttaaaaggcaaatgttgtcaagtaataagaactaaactgtatcctttcaacaaatatttactaaaagcctgctgtgaacaagattctttattttacacagattttattttactcagatttagatggtttaatttgcacagaaagaaggatgttggatacaggagataagagattagttttttatttcactgatttttgaacagacatttgacagaaatgtgatttttgtcaacaattatttttatcttcaaattaactactgtatgttggcaacataagcaatatttttatgaggtcatttcatcttaatgattagtgttttgtgacaatcatattaatgtaatctttaggcttgtttttgaaatcaaaaggcactttgcacaatacattatgaccggtgcatttaaaaaaaaacccaaaggagtaattatgcataaaacaaatatctacatattgtccttcttcagaggaaattttaaaatattagtaaaggacttggagattcattctgcctgagggaaaattgcccactggaagtacaactcttgagctacttgttcctgaggcatcgggatctgatgtttgtctttcctcttttttgaattctttctttgaagccactggagtgtgtgatctgttattatttgagtgcttacagggtgttacactctgtgtgccaaacactctgagttaataatttactcatcctcataccaacccatttaggtaggcacgcccattttgcaggtggaaaactggagcaagaaaaggttaaataacttccttgcccaaggtcacacaataacgaggaatcagagttcaaacccaggcagtagactccagatctcaggctcttcaggtatgataataaactgttgtatacttgttggataaatgcgacctcattcttgctttttaaaaactatatttattcttaaaattattatgtaaaaattttttaaattataaaaacattttttcctaatgaaaaatggaaaaatcccaaaagtagaaaatactcataattacatctaagtatattaaatattaatgttttagagaatttctatcaaatctttttccttagtagattttcacacatgcttgttatgttgaatatatggttttttagttctgtttaattacctaacattttatagtattttccaacattatcacagatttcttaatatctgcttatttcatctactgtaaaaataataatttacctatatattcatttatagttggacatttaatttgtcttggggtgaggctaggttcattgaagctgtgatgtacattttttgcatctaaattcttttcaaaggttagatctattttcttaggatttccagaagtggttcaaaggttatgaacattctttagggtcttgatataatcatacatatctgtttcgaggcttaaggagtcatttggcttgatactgagggtgcattaaggaacaagcatcaggctgtcttggctttatctcgtgctgtgtgttgctaagacagagaataagacggagagacagggagaaaggatggctcaggtttggctcagactcttttgcaaaatgtccattggggactgttcaaagcagcaatatgtcccatcaaatagaagttaaaactcattgtacttttctcaatacaaggatggcacacaagaatgtagattccacagggtcaaaggtttttgtctcacttttatggctgtatccccattgtatacaaagagctggtacatagttggtactcactagaatttgttgaatgcatgaatgaactctacttacaacaaccgtacagacagaattgtaggagagctagcaattacttgggaatcataattgctgagattgcatagttaggtcaattcagataactttcctctcttcagaatctattgttgtggctgtttggattctttagccacatggaaatgactgctgcctaagcacattgcctaatcccactgccaaaggcatttgaagtcaagagttatctcacctcttttttttttttttttttttaatgtttttttttttattatactctaagttttagggtacatgtgcacattgtgcaggttagttacatatgtatacatgtgccatgctggtgcgctgcacccactaacgtgtcatctagcattaggtatatctcccaatgctataagaaaaaccaacacagagaccaccacagttcccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtattgggatggctgggtcaaatggtatttctagttctagatccctgaggaatcgccacactgacttccacaatggttgaactagtttacagtcccaccaacagtgtaaaagtgttcctatttctccacatcctctccagcacctgttatttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttcgtgttttggacatgaagtccttgcccacgcctatgtcctgaatggtaatgcctaggttttcttctagggtttttatggttttaggtctaacgtttaaatctttaatccatccatctcacctcttgttgactgtgattacagctgtggaatgaccccttgtctaaactctctgattggtcttcactttcccaagaagtcttggtgttccatacagtggtcagtcacatcacttatgcatgtggtggctgatgtctttttcaagactttgatgggaccttgataactgaatgaacaagacaaagaaacatttttttttccagagaagaagtgactacattgtgaaaaggttttgggcaatgtaatttccatgatatacatctagaagcagagtataatgcacacattagagtctgtttgaattcggagagatattccttgaggtttagatgctgaaacatttttttgattagccaaataaaatgatggcttcaataaggtgctttttgctttattagtcagttcattccccagcggaatttctcctcatccttcaagattcaggtcaggcatcctttcctccaagaagccttgtctgagtcttttcttttctctaaatccagttgtgatgctgttctttgggctttcataataggcagtgtggctttcgatgaggcatttcacacactggatcataattatctgttctaaggaaacgtagttctcatctgcccagcctcttcattttacagaagcaaagcacaaaaggttgggtcagttagggggaaatcaaagagttggaacttgagtcttctcatgagcccctgccaatgcttctcttatttcacgagaggtgcagatgtctcaactattcagaagtaatcagaccttgctaaggaaactactcatctgctgagaatcagaatgagaattaatggctactttggaaacaatagacaaatctctcctcttagagattaagaaaaaaaaagcccaagcaagaaaagcaacattcctgtgatcacttaatcatgtgttaaggatgttcctgaatcataatttaaataaattaagattaattgaaggatttttttagaatgagagtcagcaaactttttctgtaaaaagccaggtcatgatctctattgcagcaactcacccctactgttatagcgggaaagcagctacagacattatgtaaacagatgaatgtggttgtattccaataaagctttatttacaaaaacaagcagtgggccatatttggcctatgggccatagtttaccaatcccttctaaagaaaactatgaatggcgtggctttacattcagtgccctggtaattctataataaaatttggttaaattctatagcaaagcagcgggcatatcttagaaaatttctgctacatgtaagtggggacttggcagtaaatattgttttctgagaattcttgggttctaagtttttatttgaacttttatgggaaaatagtaggagtcttggagttttcattctaaatggaatgacatcataagcacatctgaaaaatatatagctatgtttgccaaaaatataaaccagctttggagatcgtgaccacttcacttttaccacactgaagaaaggaccaactttttgtccatttaaaatctaatttaatgtcacttaaaaagaacaaacaaaataaagaattacgatgggaattcaaggattcagactggcaaagtgacatgtaccaagttacatggcaagaaagggcagagtggagcttgaagcctggtctcctgatctttatcagagttctataggctcagaactatgctaggtctcatgggagtcataggagtacaatacctagtgcttgccctctaggaagaaggcaggaaagaaccttcattgtgtgcttctcactctttctggtgtgaaacttgggtggcagcaacgtcagtctgacaatatcaggcaggtgggaaaatgtaaactgagggggaaagaagcctggttagcacgggcccccgccaggccactgaacattcatctgagagggccctagtgcctgtctatgtttgattgtgcatgggacagggggcagatagataggtggataggtgttgagggggcctcaaaatggcacccttcttctccattcaagttcagaactaactgagagatccaggaattaggtaactagagacatattaccaccttttattactggtaaagctggtttgggggaatgtggcttagatttttggattatatgggccttataacacagtacctcagaaataattagctatgatcatggctgggcaaccacaggcctctcacagtggtacctgttctgaaaagacagcagaagggctgagctgtacgcatcctttggcaggtcctgctcccagattgacccatcaggtaattcacatttccttgcctgaggaggaatgggtgagggacagtggaagggcttgcagtgatgctctaatgaagggccctcagccagctgtagggggagcataaatattttttgttactagatggaatacaaacgttgtctacttattgaattttgccacagcctggcaacttgtttctgcaacttggggtacttcccgttctgctgttgactccctgccatgtatggcaatggggacatcaaagtctggactcaagttgttttaaaagtttctgtgctcaacccaggagcctttaacgagactcagctcaacataggagctctaaattttaaaaacccctgaactagggccaacagtgcaatttgtcttccatttggttatagaagggagagaagggaaaccaatatttattgcgctctgggtgttccaggcattatattatgttctttgcattggctatctcattttgtccttgaggcaatccctgttattagtgctattttacaagtgattgcagtgcagagcattgatggagtgagtgggagtgaagatgggagacttgacctggtccttgaagaatggcctgttcccagatttctgggtggggacatgatgtctgttgggaaaaggggcccatttggtgatctgtgacttaaatttgccttatactttgtatactcagtcttggagtatctctctacttttagattccaaacatcttctgtaactatgccatattatccagtcctactacccaagtcttaaattaggctctgggcctctttcaatttcttttttttaatatttgctccatattgttaaggctgatcctagaagttactgtgaagaaaacagggtaatttggttttgatattttttctttctaaccacgaaacatcccaagatcttttttcatgtatagactctggttctctcttgcctctctgcctgccctcttgtatcagcagtacatgatcttacttctatcttttaaaacttaactctgtgtctcatgctgtcagtcaatgccctttacttgccaaaagttactcatgtgataaacaaatctaagttctagtgtattgggttgtttgttttcttattattgagttttaaaagttgtttatgtattctggatagaagtattttgccaggtataaacttagcaaatattttctctcagtttgtgacttgtctcttttattctcttaactgtcttttgttttaaaaaaattatttttaggttcaagttaacatatgcagttctgttatacaggtaaactacatgtctcaggggtttggtgtacagattatttcatcaccccagtaataagcatactacccgataggtattttttcaatcatcaccctccttccatcctccaccctcaagtagaccccagtgctgttgttctcttagtatccatatgtacttggtgtttagctcccatttataagtgaggatatgcagttggttttcagtttctatgttagttagctgaggataatggcctgcaaaggacatgatctcattatttttcatggctgcataatattccatggtgtatatatgccacattttctttatccagtccaccattgatggatatttaggttgagttcatgtcttgactgttgtgaatacgtgctgcaatgagcatgcacatgcatgtgtctttatggtagaacaatatatattcctttggggatatacccaataatgggattgctgagttcaatggtgattctgttttaaattatttgagaaattcctcctagcagtgtataggcgttcccttttctccataaccttgccagcatttattatttttgactttttaatagtagctattctgattgatgtgagatgatattttatggtggttttgatttgcatttctctaatgattagtgatgccgagcattttttcatatccttgttggccacatatatcttgttttgaaaagtatctgttgatgtcctttgcccacttttaattgaattgtttggtttttgcttgtaaattagtttaaattccttatagatgctggatattagacctttgtcagatgcacagtttgcagatattttttcccattctgtaagttgcatgtttactctcttgatagttttttttcctgtgcagaagctctttagtttaattaggtcctatttgtcaatttttggttacgttgcaattgcttttggtgtctttgtcatgaggtctttgccagatcctatgtccagaatggcattttctaggttttcttctagggtgtttatggttttaggttttgcatttaagtctttaattcatcttgagttgatttttgtatgtggtgtaaggtagtggtccagttccaattttctgcatatggctagtcagttatcccagctccattttgaatagggagtcctttccctgttacttgcttttgtcaactgtattaaatatcagatggttgtaggtatgcagcattgtttctgggcactctatcctgttccattggtctatatgtctgtttttgtaccagtgccacgctgttttggttactgtagccttgtagtgtagtttgaagtcaggtaatgtggtgcctccagctttgttcttttttcttaggattgcctggttatcccagctcttttttgattccatatgaattttaaaatagtttttttctaattctgtgaagaatgtcatcagtagtttgataggaatagcatttaatctgtaaatcgctttggcagtatggccattttaacaatattgattctttctatccatgagcatggaatgtttttctgtttgtgtcatctctgatttctttcagcagtgttttgtcattctcattgtagagatcttttacctctctggttagttgtattcctaggtattttattctctttgctgcaatcatgaatgggattgcattcttgatttggctgtcagtttggatgttgttggtgtataggaatgctagtaatttttgtacattgattttgtatcctgaaactttactgaagttgtttatcagaccaagaagcttttgggaagagactatggggtgttccaggtatagaatcacatcatctgcaaacaggaatagtttaacctcttctcttcctatttgtatgccttttatttctttctcttacctgattgctctggccaggatttccagtactatgttgaaaaggagtggtgagagagggtatccttatcttgttctagttttcaaggggaatgcttccagcttttgcctattcagtatgatgttagctgtgggtttgtcattgatggctcttgttattttgaattatgtttctttaatgcctcatttgttgagggtttttaacatgatgaggtgtttagttgtattgaaagccttttctgaatctattaagataatcatgtagtttttgtttttagttctgcttatgtaaatcacatttactgatttgcatatgttgactcaaccttgtatcccagggataaagcctgcttgatcctggtggattagctttttgatgtcctaccagattaagtttgccagtgttttgttagggatttttgccctgatgttcatcagggatattggcctgaagttttctttttctgttgtgtctctgtgaggttttggtatgaggatgattctggcctcatagaatgagttggggaggagtccctcttcctcaattttttggagtagtttaagtaggagtggtaccagctcttctttacacatctggtgtaatttgtcttaactgtcttttgaaaaacagaaatgtttaattttgatgaagtctaatttttccatttttctttggcttttgatgtgatatctaaaaaatttttgcctaatctaaggtcacagtgattttctcttatatttccttctacaagatttgtagttttaggttttaatttcaggtctatgacacattttgaattaatttttaaagtaggtttccaagtttgaatcaaagtttttttgttgtgtttttttttttttgttttttgttttttgcatgtggacagtcaattgttttagtaccatttgttgaaaatactactttttgtccaatgaactgcctttgcaccttaactttaaaaataggagaattatatgaacagatactttgccaaagaaaacgtatgattggcaaacaagaacatgaaaggatgctcattattagtgattagggaaatgcaaattaaaccacaatggggtatcactatgtgtctgatagaatggctcaaataaaaaatactgaccataccaagtgtttgtgaggatgtggaagagctggaactctcatacctttgatgggaatttaaatgacaaccactttggaaaatggtttgatagtttcttaaaaagtgaaacatatacctatcatataatgtagccattgcatttctggttatttttctaagaaaaataaaagcatgtgttcatacaaatggtggtagcagcagcctgactggagtggctgcagtgttagaggcatggctggggctgcgcactccacagagctggcacggccaggaacaggcatgagccccatcccctaccaagttggtggggcagaaggccagtgctccttggcgcagctgcagccacccagccatggctctggacccgggcttccctgtgctctcaggggcctgggaagcgcccctgcccctgaaggcttggaagtacctgctcccgctccttggcctcttcccactctaggcacctgctctggggtggaacaaagttgtggctgagccaaggtgctgttgctcggcctggcatgtgcaagctcagggcggcattgacacaccagccccctgccgccttggccccctccagactttgggtgctgatgagcatgggaggaggggcaagtgggggctgagggtggcttagtgcaggcttgcaagcaccccttggcactaacagcctgggcaccatggatggcatgtggatggtggcaggaggcagacaggctcctgggtggaaaggggcaggtctcgggtgaaaccccaccttcaagccagggatggcctgaagcctgggtgctgggctgtcaattctggatggagtcagtggcccagagtgacaatttatggtgctttttctgaacctgctcatggtggcccatggaccaatcagcacgcccttccttctgaggctataaaaactctggactcatccagacttgggcagacatcaggactaccagctgtgggaaggaactgcccactttgggtctcccgagagcctctctgtcactcactgaagctcctctctgccttgctcatcctccagttgtttgcgtacctcattgttcccggacacgggacaagaaatcaggacctgctgaatgcggggactgaaagagctgtaacacaaacaggtctgaaacatgcccccctgcttgtcacattgcaggcaacaagaaggagagaagagctgggacccttcggggagcccagaactaggggagccctgagccagggctatgacaccctctttggggctttgtggttcctggcatctccaagcttccaggcaccaccatgttcccttcatccagatgtgggtgcccacagtggaagccacttggggtacatctggtccaaccatagcctcacatggagccggcacttatgctgtcatctggagctgcttgccttgcccagcaaccagtgtgcctggctgtgcacagtggctggaccctgcgctcactcacacacacacccctcatcattctgtgcctggctcacccttggcaggtgtgggatccaggcctgtagcatgagccaagtgcagcctgccaggctgagtggacagattgagctcagtgggcatgagcaatactcaggcagaaggcactactggccacagaggtttccagctggtgaagtgacaccccaaggatctcgtgacacaaagacttgtatacaaatgtttgtagtagctttatttgtacaagccaaaaactaggagtacatgctttatgattatgtttatataaaattctatgaaatttaaactaatctatggtgacacaaagtacatcagtggtttcctgaggacacaagagggacaagaaggtagaactacaaagggtatgaagaaccttttgttgtgatggatgtgttcattatttttatgtcacatggcttcatgtgacatgaaatatatctaccaaactgcactggtagatatatatatatatatacacacacacacacacacacacaccaaattgcaccctttaaataggttcagttgactgaatagtaatttacttcaataaaaataagaaaactaggtaggcctgtgaaaaaattatatgtatatgtggccctgtgtcactgagaattgttcaaagtttctgtgaagttcatctggaaatgttcaacaagtgctgataagctgtttcacttttttgaggtgtgagtagaggagggccaggaattctactcaagggaaataatccaaaaggaagaaatcagtctacacaaagttatagtgttactattcacaactgtgaaacactggaagttacctaaatgctctacaattggggattgattgtaatcaatatgattaaattaccatatatatttcaaaaatattagttgcatggactatatctgtgtatggaaataaatatatggagccatttagttaaaaagtagcacataaagagtacactctgatttaatccatgttgacatgtacaaatgaaaattgaccatgattggaatataaagtgatgtaaatagctgataatttaggtttgtattttttccttttagtattattaaagtatttaattatttaactcctattataccttatagaagaaataatactgtattacaaaattttaagatgtattttacaaactgaccatgcaattaaatctcagcagagatatgacaccccataagtagttactgttctgagggattttaaaagtcacacttcgtgtgtgagatctcccccactgagctgctatgacacaacccacttatgaaattgtcatctttctatttctcctttgtatcaagatgttgatgatcccttaacatgcaatcatgttacctggcaaagtagcacttggcaaagtccaaactattatccttttaatattttgaatctgagaggatctcatctctttcatccttaatcatggtaatttatattttccactttttttccagatctttttgactagagctttagaaattgtattgatcatctcagaactagatttttatttcattgagtttcactattgattttgttttacatttaattgttttctgttttgatctttattatgttttttcttatgcttactttgaattttatttgctctcctttttctatttttattaaggtggaagccaaggttataaatggagactttctctttcttctaatatgagcatttattgctttgaatttcatcctacatattgttttgtggcacctcacaaattccgacatgttgttaccattttaatttatttcatgtattttaatttctcctttgatttattctcatatctatgggttatttagaagggtgttatttagtttccaaatgtttaggaattttccagacatgttctgtattcatttctaatttaattccactgtggatagagagcatactttgtatgacatacatccttttaaacttactgaatttaaaacttgttttatggcccagaattgggtctatcaatcgtaataattgttctgtgtaaacatgaaaagaatgtgtatactgccaagaagaggagtgttctaaaattgtccataggttattttgattgttagtgtgcttcaaatttctatatcctgatgattttctctctacctattctaccagttattgagagaagagtattgagatatctgatcaaaattgtagacttgcttttttttcttacagctctatcagtttttgcttcatgtattttgaaggtctattattacatgcatagagacagaactggtatgtcctcttgatgaattgatgcttttatcgtgatgaaacaatcttctttattcttggtaatatcttgctttgaaatctacttttgtcttatattaacttagccactacagatttctttttactagggttaacatggtatatgtatctaccatgtttattccaacattttacttttaatctgtttctgtctttagatttaatgtgtgtgtctcaaaggtggcatactgttcaatttttctttccccctgcccctgccattctgacaatctctgatttttaactgggatattagaatgtttatatttaatgagattatttatacagtttgaattatgtctatcatcttgctatttgtttccatttgtgtctctgttatttgttcctatttcctatttatattccatcttttggatttagtattattttatttcaatttatattgtcagtttattcattataactcttttgttaatttgcttaaaggtttattgcatgtatcttaaatttatcagtcttccttaaggtgatattataccacttcaagtatggtataaaaatctgaaataatgtacttccatttcttctctcttgcccttatgttattgttgttgttttacttacatatgtgctataaaagcctcaacttattactattatttttgtttaaatcgtcaattatcttttaaacagttttaaataagataataaaaaagttatatatttgcttatgtggttgccatatttgatgcttttcatttttgagggttgatttatatttctatgtggtatcattttttccttttacctgaaatcagaatttatatttctgaaagtgtttttatttcttgttttcgaagatagaaaattctaggatatagcaatccagattgacagctgctttctttcattactttaaagatgtttcactgtcgtcttgtttgcattatttccaacaagaaatctgttcttgcccttatccttgtcctctgtacttaacgtatcttcttatctttgcctacttttaatattttcatgttatcactggatttgagatgttgggttactatattccttggtgtatttatatttcttattctgggcttccttaaacttgaatccatgagcttgagtctttcatcaaaattggacgattttcatacactattcttcattccctccctacttctcctttcttttgctgaggaaaatatctatgagacctacatgtatattaaactgtcctacaactcactgatgctcttttcatttttgtggattcttttttttttctgtgtgcttcttttgggtaatttctattgctattcttcaagttcataatcttttcttctacaatgtcttatctgttgctaatcccatctctggtatttttatctcagggattgtagtttccatctctagaattttggatttcggtctttttttctctcttccatgtccctacttaattttgtgaacacatggaatgcagttataacagctgttttaatatcattgctaacctaatatctgtgtcatttcggtgtcagttttgactgattaattatttttcctataataagcagtgttttcctccctttttgcatgcctggtaatctttgattggagggtcagaaaattgtacctcattgggtgttggatatttttgtgtttctataaatattcttgagctttgttctgggatgaagttaagttacttggaaacaatttgatcatttcaggctttgatctgatttgttcagtggttccagaagagtgttaatgctagggctaattaataatttcctctgaggtaaagcctttttgagtattctacccaatgtcttatatgagcttttctatctggcttatgggtacaggctctatttgtggccatgtgtgatcactggatactgttccctttaattcttttgggtgattctttcctcacacaaatgcatgaattaacactctgctaatacttgaggaaaattctctgcaggtctccgtgtgtctctgtccttttcagcactctgtcttgaaaattctagatgtcttgatttcttgaaatctcaattttgttttctcaactcaggaagtcttttagcttctccctgggatccccttccctgtacctcagcctggaagttttctcaaaccaggaagctgggtcagttatgaggtggtgtgagtcatttttttcttgccactcactgtttttcattgcctaatatccagtgttttgtaaataattatttcatataacttaccttttttttttctagcctggaggataaatccaattcctgttattcctccttgactggaagcagaagtgtctccaatgggttttagtatttatctttgctaattggataatctgcaatactggttgatttgttggttttagtgacctctacttgtactcaatgtcatgtttttttccccaaactttccatcttcaggcttgacgtgtaatgctttgggacgtattttacttagaagactaagtgggatagcagaatgatgacttcctttacatgagtcctgtggctccatgtagctgcagctgggaaggtggctgtaggactatagagtaggagataaagagtgggagataccaacagatggttatgaatgattggtttgaaactttcacatggaaaattatgttgcagaaacctcagattgtgcttttgttctttttttgtttggtccaaatgaacaatggaatggaggtagatgtaggagggagatatgctgaggtagatcaatctttgaatgttgcctttgatcagggctactgaatccctggacatttatttatttgttttaaaaatttaattcagggggtacatgtgcaggtttgttacatgggtatattgtgtgatgctgaggtttgagcttctaatgatcccatcacgcaagtggtgaacatagtacccaataggtagtttttcaacccttgcccctctccctccttttcccttttggaatccctggtgtgtattgttcccatctttgtatcaggacaatatttaaatgtaggtggaaactttttaaaagttctcaaatttatggcaatatctaggcctcattgctgcaaaactgtacagagctgtttgcttccaaataacatcagaagacttgggattgttaatgggtacattaatatgattagattgaatgaataagttctagtatttgatacagactgactacagtcaataataatttattactcatttaaagataactaaaatagtataattggattgtttgtaacagtaaggatcaatatttgaggtggtggataccccattttaccctaatgtgattattacacattgcatccttgtatcaaaatatctcatgtaccacataaacatatacactatatacccacaaatattaaacataaaaattttttaaaaaggaaaaaaaagacctgtaaacctgggctgcactaagaagctaaacaactgaacttagaaaaccacaattttctttttgcaaacattgagaaataaaggagacaaaattatagctcagagaaatggcatgtatttatccaacagtgaaagtgcctgttatgtccttagctgctcttcataggcttgctgagctttttacttcaagctgaaaaccatcccatgtcaatatttgtattttcttgattttgtaataatcagttagcatgagtggctgagcaactgttgtttcatgatgccaaaatccacctcaagttgatcaatttatagaaaacggtaaactagttattcaaataagttgatttagttactcaggccatgaagttgatctgattctctttgattttgatcttctggggtattaaaaatttttttaaaatggagccagtggtcagtagcatgcctatgggaggtttcactccaatgatcattattctttctatcattctggggaatcctcaaagttttttaaaaccttggtaattcattagatgtttggattgaacatctattttaatgtagaggcaggaagaaagatactgagtggacagttccaaggtctcccagtattaccaggacatgccataaatacttaaaaacataagcagggaacttaaaggttttctgctgtattttagatattcacaagctaatcatctcaaagattttgcatgatttaaatggatctgccagattaggaccattagatagttaaaaccagataacatttgcatggggttgacaatgggatgtggctgccctgtcttccagcatggcagagtaagatgggaagaagtcttgagtcattgctctttggggaaaatatcattatatgtctaggaggccttaatatttgtcttactagagaaagtaattaggttaatattgctgtgctaatagagtcttggagcctgaaaactgggctaatccacactgtaaatactggaggccgtgtgtttccccagttagggcacacttggagaggagtcaggtgtgctcttttacaaatctcattgcattattattgagctcttggaaaggtgctgagtcttcattttagaaaaagggattagatgtggagggaatcactttgctttccccagggaggcatttctctattgcttttctagggttgggataggtatatagaaggtttgattctagaatttataaaatgatattctgggaactttgagcaatattttagggagggcacccatccaaaaaactagatgagttgctgcctttctctgcaacagcccttaggagactagcttctgatcttcttcctaaacttggtatccagtttattttgcttgtcttcctgcaggccattcttgtggagacaccgagtaacaaagtcttgaagtaatgtgtgacaagctctgtagggctataggattatagagcagctactcagagggcaagggtatgaagaaaaagagcaggtgcataaaaggaacagggaaaggggagtaaaaggaaatggggaaagaggtttaaaggagatacaacagtaaaaagaagaaaagctgggaaaggagaaaggaagcgcagcaaaaaaggtggaaaaagaagagagagtgctgatgcaggtttttcaggggcctatattgggcaaagcattgaacaagttacacccaaaggccaggagcctgaaatcaggtgccggttctcaaataacaagggcttattaagaatcagtgctattgcctaggatagttaaacagaaatacaaaaagtgctggagaagttcagggaactgtgagatatagagggaaaatcaggggaagatggacaggagatgggagctctagacacccttagacatcttggtttcaggttcattggtcagaactctctccccatccccacagtctatctagatgcttacatcaaaggcaatgcttgcttgacagatttctaaatagcagtagcaacaagatggaaagaagaatggaatgtcccattagaggatatagggccaggacttcagaaagagttcatatatattaatcacatgtcttagaatatcctggagcacctgtcctctcacctacctaaaatacttgattcccaatggtcaatgactttttaaaaaaagggggggggggggattggtatgtacatagatattgtgggaacgtacaattttttaaaaagtgatgataaagttctataggtaccttcacaaaccactctgttctacttaaatcttaacagttcctggaggaaactttgagattactcttcagagcttactttggtggttggggtgtgttgtatggctttgtgtgtgtgtgtgtgtgtgtgtgtgtgtgtgtgtgtgtgtgtgggtttgtttacttttacttatgggcactgatgtattggttactagaaagttcatagataaatttttgtcctattcagtagacaaacatacctgacttgttgacatagagtctaggtgctaacttcattagtcaattcaccttactttcatatctttattttcatttgcctcctttttctttaaattttaggccatcttacagcactttatacatctatgtttatggccttaaatcttttctttttctttttttaagagcaatttgggaagaactaaaataaaattgaaatacaaatcaacattttttgttttatgcaaatgtatgttaaaatattcaaagaataaagaggttttttaaagaatagtaggttctagcacggctcagttaaaatatggtatcacttagtaagaaacactttctaaaaaacaatttatattagccataattaagaaaaaaagggatattgaataagtcaaagagtggtttccagggaagtctttctttgtctggaaagataccataggattttctgcagacagcttactcatttttttcttgattgaaatctggaaaggaaaacttgcaagaaaacattccattctggactcggcagcaggtcaagccaaagtggcaacatttgcagcctggagatcacacagtctgggagctcaaacatttaggcaataaaagctgatggaagccaaaaagccacgccactggcatctggtgtcagggtagctgctgggggagatctggccatggtggtggggcccagccatataaacaagttcagaggtagaactggagctgtgtactgggttgaagcatgtctctcctaaattcatgttttctctagaaccttagactatgaccttatttggaaatagggtctttgcgatgtcatgcattgcttaacattgtggttacattctgagtaatgtgttgttaggtgatttcatcattgtccaaacatcatagagtgtactcacacaaacctagacggtacagtctcctacacacctagaccatatactatatcctattgttcctaggctgcaaacctctacagcctgttactgtactgactactgtaggcaattggggtacaataatctaatgagactataatcatatatttagtgtgccattgaccgaaatgtcattatgatgcatgactgtagttaagatgaggtcatactggattaggtaggttctaaatccaatgtgactagtgtcctcataagaggagagaaacagacacaaacacagggaaacaccgggacgatggccatctgaagacagaggcaaacattggagtgatgcaatgacaagccaaggaatgccaaggactgcaaaccattgccagaagctaggaacactcaagtaaggactcctccctagagcctttagaggaagcatggctctgccaaccccttgatctcatacttccagccttcagaactgtgagacaatacatttctattgttttaagctatccagtctgcggcaatttgttatggcagcctaggaaattaacaccaggcatacttcagagcaggacaggtcaagggataaccaaataggtctcctgttactagaattatttacaatgtcagagtagttcttgatgtttacttggccctctcttggcaaaggctctttgtattttcctacactaaaggtctggccaagtaggggttcagattctcttcaagtatagaaactccccccgatttttatgtttgctggccttccaagtaagatttccattgaagaaaatgctccatggctaaaaagctttaaaatccattggtattatcggcagatttggactctatagagcctagtttctaaagtgcttcatagtgccgatctgaaagtgagatagcactagtcctatcagaggattgttcaacctgagactctgcatcagaaggtcaggcagcactgacctgtgtcaggcctggagcaggctctaggaggctgctttcgtgatgagttcctttttgttcaggagaatataaggaagctggtcctattttagaagcaataacagcctttgagtttgctctagggcaattgcaaaatcaagagcccccagggtgctgtactccagatttctaggtcacagatatccagaccagagttgaccagaaattggccagaatgggttctggggatgtggatgaatttccatttctcatccattcctactccatctccattttatcattctccattcctactccctcaataccaaaattaaaacaaattgttgattactaggtagccttcacattgagtttttcctatggtataacccttgaaaaaaattgatcaaccagaccattacaagaaaaaaaattatggttttactgagttaagccttttactaggttttgcggtccaatttctctgtgtagacatagacttggaaaagccaaaacatctaagcaatgcaaatttaaacaaattagttaaatctgccactgggagtcattatgtcattggcttttaacctggctgcacattaaaatcatctgggggaacccttaaaatgacttctgctcaaagtcatgtgcccaaggttgtgattaatttgtcttcagggtgattcctcccctttaatatttctaaagccactcaggtgacttgcttgtgcaaccaggggtgtaatcctctgatgtggacatgtgactgcaatagaggaaaatgctagagagcagatactctggaatcagtgccacctggacttgaatcccaactctgatatctcataattatgtgaccttgggctaacttagtctcattgtgcctcagtttccttctctgtagaatgggaataataatacctatctcctagggttgttataaagattaaatgagttaatatgggcaaagtacttagaacattgcctggaacatagtacgcaatatataaatattagttgtctgtcgtcctttgctgacatttcccttactggatgtctgaactgaaattgatctcaatagtgtaatattactccaacaagttatattaacttcctgtgactgctgtaataaattaccacaaagtggcttaaaacaaaataaatcttactcttactattctgaaggccagaagtctgaaatcaaggtgtcagcagggccacacttcttctggaagctctgaaggaaaacctgctcctttcctctttcagcttctggtggctattggcattccttggcttgcggtcacatctctctttgcttcatcttcatattacttcctcccctgtgtgtctttcttctcctggtatttcttgtataagaatccatgtgtttgcatctagggcccacgtggattatacaggatgagctgcttttctaaggattcttaatgtagtcacatcttttgccatagaagataatattcacttttttttgctatcataaggtactattcataagttcctggaattaggacatagagatatctttttggggtctaccattcaacccactatacaagatggcataataaaaagtaagcttggatgggaggcatcactgactcattctgtgtttagtggacttcacatttggcctgcacatcccattctctaatatgtctaaaaccattatttacacaacaggtaccatccaaatatacaaacaagtgactatttattgtcaatgtttgtagttacttctcggcaaggacccacagaagtggagcaagtgctcagaggactggttggcccaatggcctttggcatatagagagctccaacaaggaaaggcttcctggtggttttgctccaaagagaacaattttttgagaaactctattttgtgctaaaatgtgtacccaaaatctcaccaatgatggctgttttttattttgttttcattttagagatatgatctcactatattgcccaggctggccttgaactcctgggctcaagagatcttcctactttaccctcccgagtagctaggactacaggctgcatgactacgcctggctaattttgggtttacatttggaaaagtctgatgcttattttaaaagagaacagggtgatgctacattatcaggacatgttttctgtcccaagtgatagaaaaatcaatctgaataggcttaagtgaaaccctaatttattaactctcataactggaaaattccagcttcaggtccagatcaatgcagtggttccaaagatactatcaggacctggtttctttctccagctcttggctctacttttgctggctgtagtttcagaaaggccgtccttaggtactggcaagacaactgtactaagacctacattctctcaggttcaaggcacatgaaaataaacagtcctagaaaaaaatgtaagcaaaaccttaccgagatttgttgggttgaatactcatgcctgagacaaccaatgtgatagcaccccttcctgttctgtttggccgaggaccttggaaaggatgacccctcttaatacatgggctaagactgtggaaagaggtaggtctgttctgaagaaccagtgtaggtaccatcagaagggagaatgaatattgggtggcaaatacaacagatgaccactgtagatgcaattaggtccttggactaaaatgtctgaaatccaaacctgggttttcttgagcgacatgtgggatttttttttttttctagttgtgtgtgttggtcacaatttccctttccacttggaaataagtgagttattttgaagcagaagacccacatttaaattccatctctgctgcctctttgtagctgtgtggccttgggcacattaccttatgtctgtaagctttaaattcttcactggcctggcggtaacacacacacacacatacacacacacacacacacacacacacacacacacacacacacacgatcaggatagaggccatcttaccaggactattcatcaccagggcacataaacagaataagcctacatgaacacagtctgattgataccgaagaaccatctgtccctacatatttttcatggtcctgaaacatgttggaaatttctaccatttgagtaatggaaggaatgtttaaagcaacatgtttccagagagccaggtgaaaaatgcaaattgatgccagggaaaagcaaaatgaaatcctgcatcactgactactccttatccgccaccttagaagggatgagccaaagtcaccttgtgtgatcattctcaacatgcaaggcaaccatcaagagacttcaggcaaaatgatctttctgtttttccacatttgttttaggattcttctctaactgcttctcctgaggcagtgttccctggggatatccaataccacagggaatgtccatattgaaaaactatacctagagctcttctttctccaagttgtctccagttgcaaaaatgacctcttcatctccgtaatcacagtgctcattttcacagtggagttgctattaggtagggcaagtaccatctgattatgaattgattaaagcattcatattaagcatgtgtgagtgacaggctcaacttttttttcagggagttagtgtttatcttcaatcttctagattgaggtaagacattttttgagaaagatacccgggtctttttccctttctcctagatcggttgcaagtgtactcacaacagatgttatgtggtattctacttctaaaagactgttggccgtaggttttagctatcacttggaagataacaagtagtagaattatccttcctgttatgggtaggaaggaattcctacggataggaattatctcaagatccctcacagatgtgcactatcatgctccaaaaggtttatttttcctagaaattgactagccttcaagtcttttcagttctcttatcaaaacttactactcctttgtccaaaccctttactattcctttgtccaaacctccgtaacccctgttacagcagccacagggagctaatataccttgttggagttatattagaccattgaaatcaattttagttcagacatccagtaagggaaatctcagcaaaggaccacagacagctaatatttatatattgcttactatgcttactattcctttgtccaaactcctcaaatatccttcctttagattgcagagtagtattctgtggtgtggacctacctcagttgaattggcagttttatttttcttcagctgtttgaatgtgtcattccactgtcttctggtgtgtaaggcttcttatgagaaatctgatggtattattgatgtgtccttgtatgtgacgtgtcacatttctcttgctgccttcgacaatttctttgtctctgtattttggcaatttgattgtaatgtgtcttggtctagatttctttatattcatcctatttgtggtgctttcagcttcatgaatctgagtgttcatttcccttctggaatttgagaaattttcagtgattgtttctttaaataagctttttttcctattgtctctctgctttccttctagaatcaccataatgtatatatttgttgtcttgatgatgtctcatatgtcccttaggctttcttaactctttcattcttttttcttttgcacttataactggataatttcaaataacttgtctttgagttcactgattccttcttaggtttgatcaattctgtgtttgaagctttctattgattgtttttctttcagcaattagattcctcagatgcagaatttgtctggttctttgtatagttcctatctttttactgagaatctcatttttcaggtattactttcctgatttcctttggttgttcatatgtttcctctcgtaactcattaaacttctttatgataagtattttgaattctttgtcaggcatctaaaagatctccacttctgtagggttggttgctggagatttgttttttcctttgattgtgtcatgtttcccagattttttatgtttcttgtagctttgccttggtgtctgcacatttgaaaaaacagccatctctcccagtttttatggagtggtgttgacagttaaagaccttcatcaattagcccagctagagatttggagagcctctcacatagcaagctgactgcctcttttcctttgttcttagctgcccccatcaaactatactcattctgtcagtcctttgggttgagtggaacagggactggcattcttctggcaatgtagtgaaagaccaagaggttggaggtatacaccactcttctctcttcttggtgagatgcctaggttctgcaatttctcccaatctcacagagctctgctatcctgtaacaatctgtttacgccctttccattgttgagttgaccgaggggtccaaactatggcagtactgtcaatgttccatgtggggcaagatagaaactgtccccttggacaattcactgaaagactgggatgccggatggtcattccacttctcttcccctcctaatgagagaagtgtgggttgaggcaatatcccttggcattgatctgtgctggctttggggagaggctgacataggtaaagtgtaattgctcttcttatttgttttaatgtggctgttcttcattttgtgctcatctaggatgcttgcaacttctcataaaagtagtctcacaaaggtattttggtgtgtatattattgttagcttgatgtttctgtggaataatgaggtgagggaccatttattctaccatcttgctgatatcactcccctgaagtgcaaaagttttaaattttgatgaagtccaatttatgagttttccttttatggatggtgcttttggtgtcaagtctgagacctctttgcttagtcctagatcctgaggattgtctcctgactgaaaggctaattttcctccattgatttgcttctccacctttataaaaaatcatttgagcctatttttatggctctatttctgggtcctatattctgttttgtcaatctatgtgtctatcccaccaccaacagcacatagtcttgatcactataactatttaataagtcttaaatctgataggaactctgactttttttttccaattattttagttatccaagttcctttgactttctgtatacagatggtccctgaaattcaacagttctacttaaaactttttgactatatgaaggtatgaaagcaaaatgcattcagtagaaaccatacgcagtgtccacacactgttctgtttttcacttttagcacagtactattaaataaattgcatgacatattcaacactttattataaaataggctttgtgctagattattttgctgaactgtaggttaatgtaagtgttctgagtaagtttaaggtaaagcaagctaagctgttatatttggtgggttagttgtattaaatgtattttcaacttctgatatattgaaaacaatggttttatcaggaagtaatctcattgtaagttgaggagcatgtgtacattttagaattatcttgtctatattttttaaaaatttctgggatgtaataaaaattgcattgtcattttgggggagaattaatatccttgctatattgagtcttttaatccatgaacatgatatgtcaccatttaaaaaagatctttaatttattttattaattctttggagttttcactatagaacccttgtacatgtttggttagatttacaacaaaatatggtagttttggggtcatcgtaaatttggtgatatttttaaatttcagtgtcaacatattcattagtagcaaatagaaatttaattgtgtattttgtatcctgcaaattcactgaaataatctattagaagtgaggggtttttttctgtatatttttggggatttcccacatagataatcatgtgatttgcaaatgacttttatttctccttttctaatctataaatttttttcttaccttattacactgactagaatttctagcatgttgttgaataaaagtagtaagaatgcacatctttgtcttgttcacgatcttaaggaaaaaacattcagttactgactgttcgatataatgttagctgtagatgttccttatcaagttcaggaagttttcctctactcttattttctatttcttataattttatcattaatagaaattgaattttataaaatttttaaatgattgatataatcaggttatttctctttttttattctgttaataaggtgggttacatcaattgatttttaagtataccagccttgcatctctgaactatatctccagttggtcatgctatataattcttcatatagaattactgaattctgtttgttaaatgtttttgcatcaatttttatggggactagtagcctgtaatttttttcttgttcttctttgcactgtctttatctggtttatctttaccttttttttttttggattagggtaatacaagctttataaaatgaattgagaagctcttctattttttggaagaaatcacatagaattggtattaattacttaaatgtttggtagaattctgcagtaaagccatctggacaaggatatctctattttggggatattgaaaattaagaaataaattacctagtttattttttaaagtggttacaaaaaacaaagatgaatgtagtttttaatttaccttgagacttggtctttgatccatgaattatttaaaagtatgctgtttagtttctaagttttggagaatttcttgttattattatgtctgatctctgttttgtttctattatggccaggtgacatattctgtataattttactttttaaaaatttgtctaggattgccttatgatataagatgtggtctactgtggtatatatcccatggccacttgaaaagaatgtgcattctgctgttgtttgatgctgtgtaatagaaatgttgattatatcttgttggttgatagtgttgttgagttcttttatatctttgctgattttctagttttcctagttttctggttttcctatctatggtttagaaatgggtgttgaagccttcagctttaatagtagatctatttatttttccttctggttttgcttcatataatttgccagtttgttgcttgatgcacacacatttaagacttctatatcttcatggttaacttaccattttatcattatataatgtccctctctaattctggtaattttgtttgctcagagtctactttatctgaaattagtatagtaactctacttcatttttacttttaacatttattattttttattgtggcaaaatacacataatagaacttaacatttgaaccattttgagtgacattaaatacattcttaatgttgtgcaaccatcacttctatttagctcatgactctttatcttataaaactgaaactctgtacctagtaagaaaataattcacgcctgtaatcccagcactttggaaggccgaggcgggtggaccatgaggtcaggagattgagaccaacctggctaatatggtgaaaccccctctctactaaaaatacaaaaaattagactggtgtggtggtgggcacctatagtcccagctacttgggaggctgaggcagcagaatcgcttggacctgggaggcggcggttgcagtgagccgagattgtgccactgcaccccagcctgggtgacagagtgagactccatcttaaataataataataataataataataataataataataataataataattccctctacttccagcccctggaagccaccattctactttctgtttctatgcttttgactacttttaactacctcatataagtgaatcatatggaatttgtcttctcgtgactggcttatttcacttagcacattgctctcagggttcatccatgttatagtacgtgttagaattttcttcctttataaagccattgtaagtatataccacattttgcttatccatttattcatctgtcaatagacacttgattgcttccacattttagctattgtgaataatgcttctatcaatgtgtgcacaaatattgcttcaagaccctgttttcagttcttttagatgcatattcagaagtggatttgctatgtcatgtagtaattctatttttaatttttgagtaaccaccatattgttttcctcagtggctgcaccattttacatttctactatcagggcacaagtgttccagtttctccacatctttgccaagacttgttattttttgttttcttaatagtagccatcttaattggtttggttggagatggtatctcattgtagttttgattttaatttccctaaagattagtgatgttgagcatcttttcaggttcttatgggccatttgcatagcttctttggagagacatttattcgagtccattgcccaattttttgttgttgttgttgagttttaggagtgctttatatattctggatgtcaatctcttgtcagatatatgctttgcaaatactttctcccattctgtgggttgcccttttcctctattaatagtgtctttgatgtacaattttaaagattctccatgaagttcagtttttctgttttttcttttgttggctgcacctttggtagcatatccaagaaatcactgccagatacagtatcatgatgcttttgtcctacgttttcttttaagaattttatagtttttttcttatatttaggtctttgatcaattttgagttaatttttctatatagtattaggtaagggtctaatttatttattttgcatatggatatccagttttcccagcatgatttgctgaaaagactgttctttctccactgaatggtcttgacatctgttttaatcagggttcttcagagagacagaattaataggagatatatatctatatctatatctgtatctatctaactatatctatatctatctatctatctatctatgtagagagaggcgggggagatataagaaaggatttattaggggaattgactcacttgattatgtaggctgagaagtttcataacagatcatctgtaagctggagtgccagggaagctggtagcatggctcattccaagtctgatggccttagaaccatggaagccaatgttgcaattctcagtccaggactgaaagcccgagagcctggagaattgctggtgcaagtcctaaagtccaaagaccagagaatctgaacttgtctcatgatacaaatataatctaccatggtatatagcccatgtacacttgaaaagggtagaagaaatgaattctggctccagaagacagatcaagaatttgtccttcctttacatttttattccatcacccacattgagggcagatcttctccacccagtccaccaactcaaatgccaatctcttccagaaacaccctcacagatgcacctggggtagcccaatcattagaatcaaatgctaaatcacttgggtttcccttttacagaagggagacatgatcagtttctactgaagcattgagaataatttgtactttatcagctgctgggtatcccttaatccagtcaaggtcacatccaaaatcaaccatcatagcacccttgtcaaaaatcatttaaccatatatattagggtttatttctggactctgtattgtatttcacaggtctatgtgccttttagacttttatttttatttttattttattttattttattttttgagatggagtttcactcttgttgcccaggctggagtgcaatggcgccatctcggctcaccacaacctctgcctcccaggttcaagtgattctcctgcttcaccctgcctagtaactgggattacaggcatgtgccaccacgcctggctacttttttgtatttttagtagagacagggtttctccatgttggtcaggctggtcttgaactcctgacctcaggtgatccgccctccttggcctcccaaagtgctgggattacaggtgtgagccactgtgcccagcctatttttattttttttaactttaaaataaagttgagggggcacatgtacaggtttattacatgggtaagttgcacgttgctgaggtgtggtgtacaaacgatcccatcacccagttagtgagcattgtagccaactggtagtttttcagcccttagccccctctcacccttcccactttattagtccccagtgtctgttctttttgtctttatgttcaagtgtactcaacgtttagctcctacttataagtgagaatgtgcagtatttgttttctgttcctgtattaatttggctttgaataaaggcctctagctgcatccatgttgctgcaaaggacataatttaattttttatggctgcatagtattccaagatgtatatgtaacatattttctttatccagtccttcattaatgggcatctaggtagattgcatgtctttgtctttataggcttttattgtctatatgccagtactatattgctttgattactatagtttttagtaagatttgaaatcaggaaatgagagtcctcaatattttttctcctttttcaaaattgttttggctttttgatgtctcttgagattccatttgaattttatagtggactgttttatttctgaaaaaaaaaagtcattggaattttgatagggattgtattgagtcaatagattgtgttggtagtatggacatttgaaaaatattgtcttccagtccatgaacatggaatgttttccatttttatattcttctttaacttctttcagcaatattttataattttttactgtacaagtctttcacgtctttagttaattcctaagtattttatttgttttgatgctatcgtaaatgagactttcttaatatccttttcatattgtttattgtaagtgtatagaaatgcaactgatttttgtgtgtcaactctctatcctgctactttgcttaattcgtctattaacagttttttaaaaatgtatgtggaatcgttagagtgttctagacacatgatcatatcatctgtaagcagagataattttagttccttctttctgatttgtatctctttgatttcttttccttgtctaattgctctggctaaaacttctagcactatgttgaatagaaatggcaaaagcagcacccttgccttgttcctgattttaaaagaagagctttcatctttgagtacgtttgctttgggtttttaatatacagattttattatgttgaggaagttgccttccattctcagtttggttggtgcttttatcatgaaagagtgaatttttcaaatgctttttctgcatcaattaattgaccacgtgttttaccctctgtaagcctgacaacgctatggattacactgattgatttttgtattttgagttatccttgcattctagaattaagtcttacttgatcatggtctataattctgtttatatgctgctcaatttggtttgctagtattttgtttaaaaaattgctttgatgttcataaaaaatactgctctataattttcttttctgatagtgtctgtgtctaaatttggtgtcagaataatgctgacctcatagaataagtcaggaagtgttctctctcctcttcattttttttttggaaaagtttgagaacaattggggttagttctttaaatggtagaagtatttctactattggtagaattcaccagtgaaactgttagatcaagggctttttttttcattatgagattttgatttttgattacttatgtaatctccttactagttataagtcttttcaaattttctatttctttatgatttagtcttggtaggtttagtatttctaggaatctgaactttttcatgtaggttatccaattttggggggtacaattgttcatagtgctgtcttagaattctttttattcccatagaataagtagtaatgtcccacttttatttatgattttagtaatatgagtcttgtctctatttttcttagtcaatctaagtgtagaattgtcatttttaaaaaaaatttttaaagaaggagcatttggttttattggttttacccttgtttttctattcttgatttctttgatctttgttctaatcttaattattccttctttctggtagctttgggtttagcttattcttttctagctccttaagttgtaaagttagttggctgatataggatcttccttgtttttaatataatcatttgtagtttcaaatttcatgcttaacactacttttgctgcatcctataagttttagtatgttatgttgtcattttcattcatatctaagtattttctaatttccctttgctttctcttttgatccattaatttttttaaagaatgtgttttaaaattttcacatatttatagatttttcagttttacttttgttattgatttctaactttatcctgttgtggtcagagttgttttgtatatttctgttagatctagttggtttattgtgttaagttctctatgtcattacttatattctgtctagttattctattcatttttgacagtgtggtattgaattctttaactattattgcagaaatgtctctttttacttcaattctgaagttttcactgtctttattttgatggtctgtcattaggtgcataaatgctcataagtcttctatcttcttgctatactgaaccttttaagattaagtactttttttgtttcttgtaaccatttttaaaaaaatttaaagtccattttgcctgttagtacagccacatctgctcttttttcatttccatttgcatgaaatgtcatcttccatttttccactttcaatttatttgtgtctttggagctaaagtgagtctcttgtaaacagcatatatttggatcatttaaaaaatccattctgctcatctatattggttgaagagtttaatacattttcatgtatgctattactgaaaaggaggaacttacttctataatttttatatttgttttctctacaccgtataactccccatcccttgttcccttttgtatatattctatagctattttctttgcagttaccattggaattacatttaacatcctaaatttataacattctaacttataaaccagcttaatttcaataacataaaactctgctactttaacagctccttcccatctctctttgattgttaatgtcacaaaattgcaactttatatatcatgtgtcacaaaacataaataattccttgaaatgcattaaactcttctatggaaaaaataatgagttagaaaccatagtttcagtgatattaacttttagactaataattgtttttttaaaaagtattagtttcttaaatcatgtacagaacacaaagtcaagaaacattgttataataataccaccttttacaatgtccctatgtttaccttcattgatatttttatttctttatatagattctagttactgtatagtatgctttcattttaacctgcaggactccctttaacagttttggcatggcagatgtagggcagcaagctatctcagcttttgtttagctgggaatgtcttaagtttctcctcactttcaagttttgccagatatggtgttcttgcttgacagtttcttttttatattagcactttgaaaatatcagcccactgccttcttatctctaaaatttctgatgagaaatttgtagataatcttattgcagatgcttggtatgtgacaagtcatttctatctcttgctgctttcaagattttctctttgcctttgtatttggaaagtttgattataatgtatatccatgtgggtatctatgaattcatcttacttggagttaattgagcttcttggaggtttatgttcatgtcttttttcaaattcgaagaatttttcaccattatttcttcctatattctctctactcctttctttctctctgcgttgtctgggactctcatggtgtgtatgttgagccccttgatgatgtctcacaggtctcttgggctctgctcacttttcttcaattttgttttctttttgttcctcagacttgatgatttccattgccttatctttgagttctctgattctttcttttgcctactcatatcttccctcaaagccctctagtaaatttttcatttctgttattttaatttttagctccagatgttctttttaggttttcaaaatctttatttgtattgtcattttgttttatacattgttttcttgacttcatccacatgtacttttagtttatttatttatttatttattgagacaggttcttgctctgtcatccaggctgtagtacatggttcagttagctcactgcagcctcaacctccttggctcaggtgatccttctgccttagcctcttgagtagctaggactacaggtgtgtgccatccatgcctggataaataaataaataaatttaatagagatgaggtctcactatgttgcctaggcttttaaattttattttttgggtatgtagtaggtgtatatattcatgaggtacatgaagtattttgatacaggcatgcagtgcataataatcacttctaagatacaaaataaagccctctttactctttgctttcctttccttaagcagatggtgggagtaaattttgttgtgagttgtgttgcctggtgttgcaggaggaatggcacaagcacttccttagccaccctggctggtgtccaatgttcactgattctaagcccagcacagcactaggacttgcccaggaattgcagtccttgtggcctagactgcctctcaagtttgtttaggatcccagagcacttaagcccatggtggtaagtcttgtgaaaattcaagttccagctgctgggatgggtgattcccctctggctagggctgatctatatgctccctgtgtgtgttggcattggctgagtttagcccagctttactttccattgtgacagggcagcattgagttcaatgcagagccccacaatcactgtactgtccatttcccaggtttacagattgtctctctgtgctatgtggctgctgccagagggataggggaggggcatcattggcaattcaagactatgtttcttaccttcttcagtgcctctttcagcaatatgaagttaaaccaagtactgtgattgcttatctgatttcctgtttttacgaaggtgctttttgtgtgtgtagatagtttgttaaataggtcttctgcagtggggatcattgttgcaaggttcagtttggccatcttgctccaccctccctcttttccagttcttaaagtatcttcaagacagttattttaaagtcttttttgagtagatctgctgttaggtctttttcaggggcagtttctgttgactattttttcctttgaatgggctatattttcctcttttttttttgaatgccttgtgtttttttttgttgaaagttgggtatttcaatttaatgatgtggtaactctgggatgcagactcttctttttcctcaaggttgtttgctttttgttattgttttgtttgtttataaaaattgctttagtctgtctctgtgccaaggatcagcctgaggtgtaaacataaggtctttactggtattctctgagcttgcatctttctgtggtcatgtgtgttaactttctaattttccccatatattcagttgtttgtgaatgtccttatctttaatatctggctcccaaaaggagaaaaagagaaaaatgaaaaagggagtggaaatagggtgccagccctttaaatctctggaagtcatttcagctggatggggaggggtttgcaacaatggaataaggtgtaacagcaaagacccaccacctctttgtctgtacctctctgatcagaagcagcaatcatcaatctaagcacatatgcctgatacttagaggacagggtccattttgcttatcctggctccttcaagctgtgtgcaacaagctgctgcaggaatacatgcacagctgcctgccacaggggtggggataggaaatgggtagctgttactgtgctaagagctaaaattgactgagctgaaatcaaagttaactgcaatgtaccatccaaatgtttccctgaaagttgcaagccttcaatagactccagatttccaaaacagttatatcagacatactctgtcagtgcaattattgcctaagcagggagacagattcctcgtgtttcttactcttgcagttccccaggatgctctccctaccttcctttatttaatgtttttatgatacatcttttcccctttttattacgtttaccctgactatattgttatatttgagtgagtttcttgtcatcaacctattgtttggttatgttttagtcaactcttgtcttttaattgtctttagccaactcttgtctttacaatgatttgaattatttacatttattggatttattaatgtattaatgcttaagtctgaaattttattttttgttttatatttgttctctctgtttttctatgtgttttctttttttatgcttcctggtgattatatgaatattttttagaatttcattttgatttatccttagatttgatacaagagaatctctttcatatagttttttagtgattgctcttggtgttaaattatatatgcacaatttttcatagtttaaaagtgttgtcattttaccagtttgagtgtagaaaacatacttcccgtaatgccacatttttcttcctcatttataatataattgtcttaaatattcccccttcgtacatttagaattacataatacagtgtattggcatctattgatttttaaaaattcagtttgagaccttcttggttcttggtatgttaagttattttccattgaaacctggacattttgaaacctgaacgtggaggctccttgttacttttgtgtggcggtggggtttttggctccctgttagtcctccactgatatctgtttggctgagagagttgggaatgtttcctttcacctcccaactggtttccactgacaccatggaatgcagtggaggagggaaggtggccttgttgtcactgggaaacggtgaatattccaactctccactagggcttctctgatactacccaggccagcaggaggatgtggagttaagaaatcctggctccccatgttgtctctactaacactgtggagaagtgggatgagcttgttacttcccagtaggaattcctgactccctacccagccttttctgacacagcctggcaaggggttagagtgcctataacagcttggtaagggggaagcacaggcttctgcacttccatcagactttgctagtggggtgagagtgagccagtttttctgtggtgtttgttataacaaagcaactatattctaaaagtttttgtctttctggtttttccctttttctcattccttggctagagaaagtaagattttgtttggcctttttgatctgtgatggttccattttatggttgccaacttcaatggctctaaatctggaatatatgaggcaaaatgaaaatccaggaacacactgctttgtttttcttcaaatcctaaggtttctagcccatatgccttgttctctccaacttttagaatcttctcatgtttgctttttaaataacgtccagagactcaattatatgtagcaggaggaatgtggaaaagcatctccacttcacacccccctggaagtaaaagttatgatgcatatacagtgagataaaatttgaagctctgcatgcgtatgatgtgtgccacttatagcacatgatagactctctttcattcaaaattcattccaggcctgctgtgtcccaggcactgttcaaggcattgcagatatagtgatgaacaaaatagataacatttctctctttatggtgcatacattcttgtgggaagaggtggacaataaacacagaaagtagaatatgttagtaaaaaatgctactggaaaaagtaaagtagatttatgaggctagtgagtgctggaggcattggaggttatttattttacataaggtggtcagggaagctaacatttgagcagagtggctgcagtgagatggacaaagacaaaagtggtagaagagagcagagatgtagttggggaatcagattgtctagggtcttgaaggcagtcaagaatttgggctttcatttagtcatgaaggaggttttcagagagaagtaatatgatccagtttacagctttattggtctgctatatggagaatagattgcggtggagtaaatgtggtggtcaaatgaggaggcttttacaaatacccgggagaggtttaatgagagattaaactcagatggaataatggagttagtgagatgtggccagattctgaaaacattttgcagataaagatgacagaaattgctaacagattttatgtggggtgtgagagaatgagagagagagagagatcaaagatggtctaagatctttggcttaagcaattggaagaataaacttggcatttactgagatggggaagaccgagggaagtgcaagtctggggaagaatggggagtcagaggtttgggtttgactgtgttaaaattgaaatatccattaaactaggggcatagtaggaggttgcccacaggagtctgagtttaaggactgcagatatcctgtctggagatatcaatttgggacttgctgtcctatagataattgcttttgtctgttttgcgctgctataactgaatacctgagactgggtaatttacaaagagcagaaatctatttcacacggttctagaggctgggatgtacaaggccaaggtgccagcatctgatggactccttcttggtgtattctcacgtggaggaaggcagaaggtgaaagggcaagaatgaacaaatccactccctcaagtcctatttatagcagcattaatccattcatgttggcagagccctcatgacctaaacacctcctaaaaggccccacctttcagcaccgttgcattggggattaaatttccagcacacaaattttggggaacacattcagattatatgaatgatatttaatgatatgtctagatgtgatcacatagacagagactgtaaataaagaagaaaaagagtcctgagttctgggggcactctcatatttagaggtcaggaggatgaggagaaaccagcaaaggaaaatgagaacagatcagtgaagcagaagaaccaagagagtgtggtgtgctggaagttgagtaaagaaagtgtttccagaaagagggagtgattaatttgtcaaataagaagagagttgtaaattgattcttgggtttgggaatgtgatggtctctggtggccccaccaagatttgtttccatgggaggagggggaaggaggaaagaagtggaggagaagacagagatggtgagcataagcaactctctggagttgctataaaggaaagcaggaaaatggagtagtagatgaacaaggttacagggtcaagaaaggtgtaattactatacagaacagttaaatatatacatggaaactttgtatttatctatagagtttgaatttattttgattgacaatgagtctaaaatttcatatagtgaaaagtcttcaattggcttgataatcttagcaatagcatttatatttgaagaagacttagttaaatatgagttggtctatgcaagatgtgtaattttaaagcttcttttctttggtttaatttggatttgcaatttcagttaaccctttccaatgaatccccccaaatgaatatttacttagcaatgataaaaaaactttatatttacagagtacttatcagtctctctataagaacaaacataaaagaatgaaaatttacattagaggtgtaggaggtaattaaagtgatgtggtcccaaaccagggaaactgagtctcagaccataggtggagcatgggatctgaaggggaaactcacctacaactctacagcaccaattgccagcctcttgggctaatagactctctcccgcttctgtcattgtctttgtctttttctacagtgaaacaagctttgaactatttccagctttccaatagcaaagttattcagattagatgaactttatttgttctccgggacatctagttctccaaagtcttctgtctgtaccatgtgttcaccaaacctccttctttttcctgctgggaaacccaatcagctgcatttcccagcctcccttgcagttgggtggggccaaaagaatgagggtggaatttatgccacttccagcctgaagcatggtcattaagaaaatcttctacacaatcctccttgtcctctctcttcctttgcctgctggatagatgcagaagattccttggaagggcctgggtcctgaatggctgtggagcagaagcttgaatagcatcttactgtggcatgagcaagaaatgagcttttattatgttgatcttttgatactttgtagttgtttgttacagtagtgagcctgccctgattaatacatacttctactgcaagtattacaaaaatacaactttttaaaaaatacctttctgtagcctttcaggatcctttccttctaagaagtcaccttcaggctcccaaagctttcctggagtgtgaatgcaaggagaaacaaatagcaacaatcctgtatcagttactttttcctgcatcatcttatttaatttctgtaggaatccaatgattctcataaaacagtagtccaatgagtccagcctcataatccaataaggttaataattaacctcagtttacagatgaaggagtttgtccaagatcacagagttatgaaatagtgaaatccttcgagcctgacctttttaaccacggagcccttgctctcccactacatcttcactctgttctttttccctctggggaaggaagtaaaactcatgaatctaattcacttatgcacactctggtattagagactcaatttcctttctcttgttgtgtgtatttgtgttttgaaggaggtgagaaacagagaaggtaattatttactgacatgaattgtaggcactgttgtgattgggtggggtgggaggcattctgcagacgacatagtagacctgagtccaggtgtgaaggggagagggagacagcagacagcatttagtttctagggagacagcacaggaaactaacctttctttccccttcagctttttaatacaaataattaaagatcctcatagtccattaactggccaggagagcagatggtagaggtgagaagtttcagcatcctgagaacacttgagcagcctccctgttccaacagaattgtccatattcaagccaagagaggaaagatgtggaactgctgttgccaagggggaaagtgcaggtcttcaataccaccttgatgttttatgtttataaaatttggctcagctgggcgcggtggctcatgcctgtaatcccagcactttgggaggctgaagcaggtggatcacgaggtcaagagttccagaccagcctggccaatatggtgaaactctgtctctactaaaaatacaaaaattagctgggcatggtggcaggtgcctgtagtcccagctgcttgggaggctgaggcaggagaattgcttgaaccctggaggtggaggttgcagtgagccgagatcgtgccactgcactccagcctgggcaacagaatgagactctatctcaaaaaaaaaaaaaaaattgactcacacataatgcaacacctgtctgcatacttttgccagtcactccataatttaaaatgtgcttcttcataggaagcatcaaattagataatttcatcctcacagcaattttaggaggcaacactcacatatgatccaggtaaaaaaaatggtgactcacatccctgacatgaagcccagggcatttcttagacttcctgtttttgagaaggaaatctaagacaaacctcccagactttgaaggatgggtgttcctatccaaaatgcaactgtgattatctgtgaaatctgcagatcttgtctgctctttcttgtctgcaaaagatcagatgaatgctctggagatgtgtgtggttgtctagcatgagcatgtgcgtgtgcatttgtacatgtgtgtgtgcatgcatatgtgtgtgtgtttttgtgtaagagacaaagaaagaaaaatgaatataaaatttacagaatcaaatatcagttttcaaagcttcaagatccaattgtgtgtataggattatctgccctgtttaggaaagtgttttctggagtggagctccaagtctgtgatgaatgtgccaaactaggggttccttctcggagagtcatcatatccttagtatgccatggcttgaagaaaccccacaatgagtaaatattaggtcttgtctgatgttatagatcccaagcttacttaactatggattctcttttttgagtctatcactcattcacatacagtgacagtacatctttttgaaaatgccaattcaagagtaattagaaaggtttaatgtagaaaactaggattatcagaagacctagattttgctcttactctatcactaataggctttataatttttgataaattatttttatttagttctttttcaagtatttttttctgccttgaaggaaacatttctttaaggatatttattgtacttatttaaaattgttgttctgtcatgataattccactttgcatggtacatgttattcattatttattacataaattatttatatattacatgttgttgattatttcttagtggttgtacttttcaggtatgtaattattttggcctgtgatatacatcctcctggagaagataatttgtattgggttaaggcgaaatggcagagcctggtttttgtaccttctggtgtgagcttaagaaagaggtggggatgagaccatgttcttttttaacagtgaatcctaacctttcctccctgtgtgtcccaggacatttgtgtactcactgctcaatcgagggaggccttatccagctatactcattctcagaggcactgccttctgcactggaaatggagtccttcaaggctactatctgatttactgtgctgaataccctgatgggtggtacacagacatacggtttagcttgggtaagtgaatctgcccacttctcacctacttcccagctaacaacccttcccacaatctacatcgccatggcctctccctactgcaatgacctcgtaatgatcccatcttcccctccctcacctctaccctgatcttttctctatatggtagccagagagattgtttaaacacatatcatgccatttcccatcgcaaaactctccagtagatttcctttactctcaaaataaaatacaaattccttcccactgcctttaaatcctaaatattcttggtcttttcaatttcccaacctcttttcctggctccctgcacctccttttctgtgctccagtgccagtggccttcctgctgtgccacaagctgtcaagcttgtccagccccagtgtttttgtataggactgttccctctgcctagtacaggggtgtccagtcttttggcttccctggaccacattggaaaaagaagaattgccttgggctacacatataattcactaacaccaatgatagctgataagctgaaagaaacattgtttcttaaaacaatgttttaagaaagtgtacgaatttgtgtcaggccacatccaaaactgtcctgggctgcatgtggcccacaggctgtgggttggacaagcctggcctagaaggctttgcccccatgtattcatgggggttggttcctcactttatttagttccctaccaatttgcacctcctcaaagggactttccctgaccaccctatctaaaatggttgaagacactgctgtgtgtgctgtcccccttccctccccgctcccctaccatcccctgccccagataccctttcttccaggctaatgatcttttgactaggcaaggtggaaaatccttgttttatatcaaatcaaataaggtgagaatagacttgattgtttcaactaaactgttcttgctttttgcctattttgaaaagcaccaaagtgctttgctgacaggttgggttgggcctctttgtgggacggtgagtgtttctgggctgtaataatgccttttgggatgcaggatctagcatccctgatcctggctgtcctcacctcagaacagggccctttctgtaccagtggatagtgcatgtggagacacctccaggatatgtggctaagtaagataaataaaaatgtgaacagtgtgtgtagtatgctacttttaatgtcagaatgtgtgtgtgtgtgtgtgtgtgtgtgtgtgtgtgtgtgaactggcagtgatggaagtcagtttgttagtggccacgcctccaaactagctcacgttatttcatgagagtgggtgtttcagtcaggaatgcgttcagaaaaccatataatagtgacgggaataattcagaattcatagttcttacataacaagtgtcgaagtaggtggcttctgcattcctgtggttgcttactgacaccattaataactcaggcactttgtgtctcccctattcttagcatgtttacctgtggtcctcttattcatcacttcatggttgcaagatgttgactgtagctcaaggcattacatctggcaatcaagacaggaagaaagacgaagtaggggcaccggtcttgcctgcaccttttatcagaaaagcaaacgatttccaaggaagtcccccaaccaagacttcactttacatcttattggtggaactagctcatgtgaccccctttctcagtgcaacctctgtagtgggggatggcaaaagaaaaggggctggaatcagctgttgagatatgaaacctcgatttgactgtttgtgaatgagctaaaggcttactattatgatccatgcatttgtttgtttatctatttaaatactggacaatggtgctacctcctgctctcctctcttttctaatctgtctccatcagtggtgccactgtgtactttcagcccaagtctaggaaacagcacacccagtgctccccattcaggaccaggactcattgccctccccactttctgccacgtcttaggaccattcttagatttagaaattaaatgcccctcctttcattttagcttagtttgtgaaaaaagcaccacaatctggacacatttaaaaaaaatttctcctttctctcttctttgtcaaggtgtcttcttatttattttgggaatgggaataaacattcatagtgactatatattgcgccagctcaggaagcctggagaaatcagctacaggattccacaaggtaatgtctcccctgcccccagactctcactcttccctggagcctgtcccagggatgatgctatggtagcagatggagaggggacagtgagggcacgaatgatacaatacctctcagcttgctcttgacttcccctgcaaacccagtcccatcacagtacctctgcatttctaatctgaacccagaagctccagagagctaccagagccctcaggaaggtgcgagaccgcaatacccggaaggtgggagagagtgggagatttgagtagggttggaatcggctacctacaccctcattgcagtaggtaaggttgtcatgtacagagggctgatcctttctaggttgcaaatgatgctgaatgcttggccaataaatgtgtcccctccaattgatctagacttatcttgtgagcagttaaggctagaacttgcgtatttcctgccattcatatatacttttaaaggtgtagagaactatatttacttaatcaaaacttaggatgggaggccttacaagcacaagtgcatttttggagataaaggtgagcatgtttgtaatcctaactgctccaaagaaaccagggtatgagattgacaaatatacgcagatgggagcaaatcagtccaagtcatccttcagtaggtttagatgggtatttgtgtaggtccttggcttccaccgtttttgatgtaaatacaaccctttatttacatcaaaaaatttcctcaattatgacatgatgttagtgcacattaatagtcattgattaagaaattaatgacaaagttactatgaattcagtaacagattcaaatgaatttgaatgttgttaatatcctaacagtatctacatcaaacaaaaataatttaggaggttaagatgtgccgtttactgtcttcatagaaaatttataggccctttgctttagatccgtggttcctcccagggcgtagggaatcacaggttgggaaccactgacgcagtctcatcttcaagaaagattcaactctaaggggctttgattttaaaaacattcactccataactagataaataaagaagagcagagaaagcacttgaaaaccagttgccaagattagtttccaacttttgaattataatagagaatgatttaaaacaaagtatttttatgtaactgtagaaagaacaaaattgtttcggttgaaacatccccagtttaatgtgggtaataaaatttagtgtggatatatttaatatcattagaaatatgctgatttctagatacagtcctgagagaagaaatacctggttggatagaaaatgaaacatttaaaatctagaagccgacttcaccagcctacagcaggacaaatacctgcagctcctactctctgctttaaacatgaacagaggagagtgctttgcagaagggtggggaggggcaaatcccataagagaatctaaattccttctcccgtgagttcagatttttattattttaatgtagtgtgcagtttcacattttgggactgtgaatgtgaacgtgtgtgtgtccaggaaaggagcggggaggtaagaggtggcccaaaaaccttccttaacagaacaaaacaaaaaccagacctcctacacctctcccttatcctacccaaagctagtggtccagcagttgttagagatttggatagagcccgttaagcagttgaggccactcttcgcaactccagaatgttctccaggcaacaggctgttgttgctttgtttccccttctccccaagaggattccaccaaactcctatgactatggagggagcctccagccccacatttgttcttgctgcctttgtgtattttggaacaacacagatgggtttaatgtcaaaatgattcagttgcaatgattgaccttccgattcttctgcacgcaggtggcttgtttacgtatgtttctggagccaatttcctcggtgagatcattgaatggatcggctatgccctggccacttggtccctcccagcacttgcatttgcatttttctcactttgtttccttgggctgcgagcttttcaccaccataggtaaatttttcaataaaagcggcagcattcacgtagctttcttcttctccaaacaggcttttaacccgcagaggaagattgagaaaccgaagatatttaattttttaagggaaggttgatactataatctgggttagcatattctgacttgctgggcttgtattgaagttggaagttagctggatgagagtagcagtaataaaattttttctaagaacaaacataagtccatgtaaacagaggcaactgaggtgacggccgggaaggtcctgtgcctgtcttgttgaagaaggctgtccagcgagaagtgccttgcaccttcttgggttagctgacccaggctctgtgcccaccaggcaggcttacctggagatgcttagataaagcctcaagaagcggaagaagccgcttccatttccaccttcagtttcatcccctcccaccacatttctggaagtgtgctccagaggtgggaccatggccagcactttccaaagctccacagatatttatttatttatttatttatttatttatttttgagttggagtctcactctgatgcccaggctgaagtgcaatggggcgatcttgcctcactgcagccttcacctcccaggttcaagtgattctcccacctcagccttccaaatggctgagactacaggcccaccaccatgcccagctaactttttgcatttttagtagagacaagtttcaccatgttggccaggctgtccttgaactcctgacctcaagtgatctgcctgcctcggcctcccaaagggctgggattacaggcaaagccatcacgcctggcctccacagatgttctgaggcacagcaggctagagaaccactgggaaaaagtactatcttggtgactatgtggctgctatttttggcaacaagatttggtgctaacagttcaggtaatcacagagccctggaactccagaaggattatttcccctggaatctctgcaatgccagggtttattttggtactgccttccttccctgacacccaccctctataaatcataaccaaggccaaccctggattctggggaaggtaggacaagaaatcccatgtatggggcaatcttaggactgccctatctgctgggaaatgccagggattgcaggtgtttcagaaccctccctctgaaggtctggcctaaagcttcactaatccactaacctggggtggagtggggacaaaagaattaactaaaagtattgctggaagtgaaaggtaatatattaggttgttatcaggctttaacttgccaagtgtaaatgtcagatcctttccctaaaatggcttttgtggaaagagaaagcctataattactggagactatggatactcaaacagggaatgagtggtcttggaaccaggaccctggggttatgactcaatgcctagttttgaagatttaactaagaatgagttcctttttttctgattagaattgttcgaggacaacagttctgaaatgaatgaagcaacagctagtgacctattcctaccacctcctagactctgtgaggaggggtggcagagggttcctagcccataaaagagtcataacagttcttaccatttcaggctgggtctgctgcccaccagaggcagagcgggaatgggagaagagaaggcatcactcagcacttggagggtccctgggaaggagggactctactgtgcttggttaggggagggatggtaattccaccagacgtttccagctgctgcaacaacaaaacccaaattgaggcctcatcctgtgatgtcagacctcccagagaagggccagaaggcatagtttttaataggctaacaggactttgtgaaggcttctataaaacaaagccaggcactcacatcagaggcagcacgggcggaggcagcccaccagacttctcaaatcacagtaccgaaaaccagccaccttttgtaacttattatttgccccctaattcaaactaaggtactttaatacagtgtgtcatcttgattatgccttgaggaccgccagcatcaactagttaggaagacagcctggcaacttaagcagacaggcttcttataagatgcattcgtctcctgtggctgctgcaatacattaccacaaactgggcggcttaaaacaacacagatttgtcctttcatagttctggaggctagaattttgaaatcgaggcgtaggcagggccaggcccccgtgacggctctagggaagaattcttccttgcctctttttagcttctgatggtggccggcaacccttggtgttccgtggcttatagctgcatcactctgatctctgcctccgtcttcacatggccttctctcctgtgtgtctctgtctcagtctctttgtctcttctcctcttctttttaggacacagttatattggattaagggcacaccctgctccattatgacctcatcttaattttatctgcaatggtcctagtttcagaaaaaaaaaaattaccctctcagttactgggggttaggacttcaacatatcttttgacgagacaaaattcaacccatgatacatggtgacaatttgctggcattcccaggcctcatgaagggatattttcctgggaacattgctggttctctttgcccatagtctttggttccctgtatttcccagctgaatccaaacaagtacctccttctagatactacatttttttttctggtaggatatacgtaacaaaaattttaccactttagccgtttttaattgtaaaattcagtggcattaggtacattcataatattgcacagccatcaccactaccctctgcctgttacttttcatttcccagcaaaagaagcttcaacatttacaagaaataggctgtgggaaggagaaataagaatcataagtgaccatcgaaatagtcaggcccaaaataactgtaggttgacttgtaacaaagatttggtaagagcaaacctcagctgtcagccactgctccattatatttacaattattcctttcttgtcttttaggttctacctcaagatgtttgaggactaccccaaatctcggaaagcccttattccattcatcttttaaaggaaccaaattaaaaaggagcagagctcccacaatgctgatgaaaactgtcaagctgctgaaactgtaattttcatgatataatagtcccgtatatatgtaatagtaggtctcctggcgttctgccagctggcctggggattctgagtggtgtctgcttagagtttactcctacccttccagggacccctatcctgatccccaactgaagcttcaaaaagccacttttccaaatggcgacagttgcttcttagctattgctctgagaaagtacaaacttctcctatgtctttcaccgggcaatccaagtacatgtggcttcatacccactccctgtcaatgcaggacaactctgtaatcaagaattttttgacttgaaggcagtacttatagaccttattaaaggtatgcattttatacatgtaacagagtagcagaaatttaaactctgaagccacaaagacccagagcaaacccactcccaaatgaaaaccccagtcatggcttcctttttcttggttaattaggaaagatgagaaattattaggtagaccttgaatacaggagccctctcctcatagtgctgaaaagatactgatgcattgacctcatttcaaatttgtgcagtgtcttagttgatgagtgcctctgttttccagaagatttcacaatccccggaaaactggtatggctattcttgaaggccaggttttaataaccacaaacaaaaaggcatgaacctgggtggcttatgagagagtagagaacaacatgaccctggatggctactaagaggatagagaacagttttacaatagacattgcaaactctcatgtttttggaaactagtggcaatatccaaataatgagtagtgtaaaacaaagagaattaatgatgaggttacatgctgcttgcctccaccagatgtccacaacaatatgaagtacagcagaagccccaagcaactttcctttcctggagcttcttccttgtagttctcaggacctgttcaagaaggtgtctcctaggggcagcctgaatgcctccctcaaaggacctgcaggcagagactgaaaattgcagacagaggggcacgtctgggcagaaaacctgttttgtttggctcagacatatagttttttttttttttacaaagtttcaaaaacttaaaaatcaggagattccttcataaaactctagcattctagtttcatttaaaaagttggaggatctgaacatacagagcccacatttccacaccagaactggaactacgtagctagtaagcatttgagtttgcaaactcttgtgaaggggtcaccccagcatgagtgctgagatatggactctctaaggaaggggccgaacgcttgtaattggaatacatggaaatatttgtcttctcaggcctatgtttgcggaatgcattgtcaatatttagcaaactgttttgacaaatgagcaccagtggtactaagcacagaaactcactatataagtcacataggaaacttgaaaggtctgaggatgatgtagattactgaaaaatgcaaattgcaatcatataaataagtgtttttgttgttcattaaatacctttaaatcatg

SEQ ID NO: 36891 - DNA, 10186 bp, Homo sapiens
cgccgggcggggaccgtgggagccgcggacaagcccaaggccggagcggttccaggaggaccctggtgaggagggctcggcccatgggtgtagaccgatggacctgggcacgaggggcggggcaggacaagggagcaggagaaatgaatagagaaagggtgcggtggtggctgaacgatggagacgaatgcggagagaatggacataccgctgttccgaggggcgagggcgcaggctggagcccggccgaggcagccagcagatgcggagttgacaagctgacggctgctccatccttttcctctccagcccccacccctttcctgcattcaccagacaaactctgcgtattgccccacccccatcctccacctcctttcagggcatctgggtgggtctccctgggtcccttcctctgggagtaaggggtaggctggagggcagggccagattgcggcagcagggacctggaggtccattctgggcccggacctcttccaggcccccgccccccttcggagatccagagcgcagccgcgttctctgaccctcccggctccattcccggggggttacattcgactccatctgcaaacactgcagtggaaactaatggtcagtcgattgcgatttgcatctcattgaaatatcttccaaagcagccagagccttcaggcctgctgctgccgtcaagtcacctcggtgtccttccccgcagctcttgtcctcactggccgggcttcaccacctctgtcttctaggtctgcacctgtggttgccaggtaggtggatgtgagagaccctacccttctggttctctagaagccatcccatcgccgctagcatcatgctgtcccctcagagagctttactctgcaacctcaaccacatccacctccagcacgtctccctgggcctgcacttgtcccgccgtcctgagctacaggaggggcctttgagcacaccccctcctccaggagacactgggggcaaggagagcaggggcccctgcagtggcaccctggtggacgccaattccaacagcccagctgtgccctgccggtgctgccaggagcacggtccgggcctagaaaaccggcaggacccgtcacaggaggaagagggggctgcctctccctcagacccaggctgctcctcctcactcagctcctgctcagatcttagccccgatgagtcccctgtctcagtctacttgcgggacctccctggtgatgaggatgcccaccctcagcccagtatcatccccctggagcagggctccccactggcttcagcaggccctggcacctgctcaccggacagcttctgctgctctcctgattcctgctccggagcttcttcttcacccgatcctggcctggactcgaactgcaacgccctgaccacctgccaggacgtcccttccccaggcttggaggaagaggacgagagggcggagcaggatctccctacctctgagctcttagaggcggatgatgggaaaatcgacgctgggaaaacggagcccagttggaagattaacccaatttggaaaattgacacagagaaaactaaagctgaatggaaaaccactgaaaacaataacactggttggaaaaacaacgggaatgttaactctagctggaaaagtgaacctgaaaaattcgactctggttggaaaaccaacacaagaataactgattctggctcgaaaacagatgcagggaaaattgatggaggatggagaagtgacgtcagcgaggagccggtgccccaccggacaatcacgtccttccacgagctggcccagaagcgcaagcggggcccagggctgccccttgtcccgcaggcgaagaaagatcgcagtgactggctcatagtcttctcgcccgacaccgagctccccccctcggggtcgccgggcggctcctcggcacctcctcgggaagtcaccaccttcaaggaactccggtcccgaagccgggccccagccccgccagtcccgcctcgagaccccccagttggctgggctttggtcccgccccggcccccacccccgcctgtccctccccgaaggaagaagaaccgacctggactgcagcccatagcggaggggcagtccgaggagggccgggctgtcagcccagcggctggcgaggaggccccagccgcgaaggagccgggcgcgcaggccggcctggagggtaagaggtcgcaagaagcgggaggagggctgggcttcggccgctcacgcctcctaggcttccaacccggccccctgtcttccctccattctgtgtcacccatcctccccgccccttctaccagggagcgctccgggaaagggaaactgggtgggtcattgggttatgggactaactgtttgctccctcttcttcccgccccttcttgcctggctgcccatcccgctgccctccttccctctgcgcctggccccgccaatcccgcctgcagccggtcccctcctgctccctcggcccctggttttccggttctcggccgacgggcgccccctgttggagggtgggggcgcaggcgcagctgggtctctgctcctggctcctctggccgggtggcccggcgccgggctgcggctgctgggggcgccgagccccccagaggagcagctgctgcccgtccgcctgtccccggtgggagcctattcgcctccgactcggggagccttgccctgcctggccagccccgagctggcactgctgctgtccccgctctttcccagaagtagcaccttccccgccgcggctcccccaccccgccaggtacccgcccccccgctgccaccgcaacctcgtccgccgaaggcccctcgctggaccaggagcccatcgcctccgcccaggctacgtaagacggacccgggctagccccgcgggccacgcctcaggcgggccgccccgcccactctcgcccggccccgttttcgctttttttccggggttgcccagcttagtcccgcccttcagtttaagccgactccaagcaagtttgtcggccttggggagtctggccccgttcctagtgctggagggggaagttgttgcctttcctgctccgtgggccggccccctctccctccagacccacctgggcatagtggacgcgggcttacccagcctccatgccaagtctagggggtcccagcgagtctgttgttaggggctttgggtcacaccctctgtggaattccttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctacacctccctccccgcgccccgtcctctcccgccctacaggccctagcagggcaggcgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtaagtgttaccgcgcccttcttcccttacgccagtccgtagttcgtggtccttcgccggtgtccccggagcccagcggctgtggatggcagaagcccagagtgggactggtcagctgcaggagcagaagaaaggtagggcaccctgactcccgaccccgcgcttccgaataaactgcccttcgcccccggccctgctctcaggctgtccgaaggcagtctctccacgcccctcgggcaagcctgggtaggggcgcggcctcctagcgtcttccctttcccactcctcccaggtcttctgatagccgtcagcgtctccgttgataaaatcatctcgcatttcggggccgcccggaacttggtgcagaaggtgaaggtggctggggggaggctgttgggatgaggagagtaatggagctccgcggggggtgcgggaatggttggcgggaggtggctgggaggtgtctggagggatctctggagccatcggcatcgcgccacctccaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggtgagccaggagggcgtgggacccggcagtgcgcagggcagggccgggcttggctgactgcaccccacgttctcaggctccagcacccgctcccttggaaccctgtatagccaggtcagccgtctagccccgctgagcagcagccgtagccgcttccatgcctttatcctgggcctcctcaagtgagttgccttctttccagtgcccttcccacgacctgggactgcaggagcgtcatgggtgggacacagtagtagtgcctcacatccccagagaaggccccccctcttccaatctcatctcccatcctccacccagagaggactggagtcctccacctccctgaacttccattccctcttttctcccctagcaccaagcagttggagctgtggttttccagtctccaggaagatgcaggtcagaggttcagatggtagaggatggggctgatgggctgggaggatgggaaggaaagagttctctcctgctggttcccactgctgccagaatgccattaatccagatctccgatcttattactcttctaattaaaactttctaaggaggcccatcgcccataggatgaaagacccaaagccttggctgtctggcctctgccctcttcccctgccttggagggtcttgccaacagtcttcccgcctggcccttcctgctccagggccctgcttatgctgttcctctaccttctgcccctcctgcttcctctgaactatcattcatcctttgagtccttccccagtgaggccctacctctaccctcggactaggccaacccccacgcctcattttgtatgtgcttctatggctctcctgtcctcctcctctgtagcctttgcactgtctctgttacttgtcaccacttgctgtgtgtgtcttcctatttgggctaggttccatgcaggcggggatgtcagtcctatagcccaccacatccttcctcctctctgccccagtgcccagcagagtgaggcctgggaagatgtgtgctgactggtgggctgctctggggggtcttctgggactaggtccagggcaggagctgatgttggcctgctcttttccaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggtaatggggtaccttgtcctttctatgaccttctgactctctcagatctcctagcggcttcatttgaaactctctagtgatgatcctttagggcagagattggcggtctgtttttctacagccatgagctaaaaatggttacattttaatggttatgttaagtgcctacataatgatctcaattttctctcttggccctaggtcctaaaatatagttatccccaggtacatgtgggggattggttctaggaccctcacatacactaaaatctgacatactcaaatcctacagttgatgtataggaaaagacagccctcagtatatgtggtattacatcctgagaatacagtattttttgttcggttgaaaaaaacctgcatataggtgaacttgtgcatttcaaacctgctttgtttaagggtcaactgtatttactatctggtcgtttagaaaaatgaaaaacagcctgggcaacatggtgaaaccctgtctctacagaaaaatacaaaaattagctgggcatggtggcacacacgtggtggtagtcccagctactctaggaggctgaggtgggaggactgcttgagcctaggaggtcaaggctgcagtgagctgtaatcacactgctgcattccagcctgggcgacagagcgagaccctgtctcctctccaaacaaacaaacaaaatgccaacccctgctccaggcttcaacaactggtggctctttaatggcttgagatactctctagtggccatttcattctgagcctgtctagaccctgctgggtccataggttccttgtgatttgtggtgttgtggacttttgttgtcatctccctcatcagcctaaaagtgcctgtgtccaataatgaacactctgccctcagcagtgactaacccctgacctcttttgaaccacaattaggccccttagcctctccctccctccaaaccccagggttcttgggttttctggaagtgggttgagctgtgaccctatgtcccttcttttaggagaccatctagctggctgcccccgacagtgagtgtgttggctcttgtgaagcggggggcacctcccgagatgccttctcctcaggagcttgaggcctcagcacccaggatggtgcaaacccataggtaaggaggattggggagaatgcactagtgtgtaaccatgtatgctatcacagcatggatgggaggtagtgtaaaaaaccctgggctttaaaataagaccgtgcttagtgtgcattgcagcttttctatttattatcgatgtgtcactcatttgagccttggatttttttttttttttaagagacaagagtcttgctctgtcgctcaggctggagtgcaggggcacaatctcggctcactgcaacctccccttcctgggttctcctgtctcagcctactgagtagctgggactacaggtgcccaccaccatgcccgtttaagttttggaatttttttttttttgagatggagtctagctctgtcgccaagctgaagtacagtggcatgatctcggctcactgcaatctccgcctcccaggttcaagcaattctcctgctaagccttctgagtagctgggattacaggcacatgccgccacgcccagctaatttttgtatttttagtagagaccggggtttcaccatgttcgccgggatggtcttgatctcctgacctcgtgatccgcccgccttggcctcccaaagtgctggaattataggcgtgagccactgtgcccagccaatttttgtatttttagtagaaacggggtttcaccgtgttgcccaggctggtctagaactcctgacctcaggtgatccacccacctcagcctcccaaagtattgggattacaggcatagctactgcacccggccaggattctttctataaaaaggatatgatgcaataccttttttatggttatagagactaaacataattttttttttgagacagagtctcactctcgcccaggctggagtgtagtggcatgatttcggctcactgcaaccacgcctcctgggctcaagtgattctcctgcctcagcctccagagtagctgggattacaggcacctgccaccatgcctggctaatttttgtaattttagtggagatggggttttgccatgttggccaggctggtcttgaactcctggcctcaaggaatctgcctaccttggcctcccaaagtgctgggattacaggtgggagccactacacctggctactaaacttttttttttttttttttgagacagtgtcttgctctgtcgcccaggctggagtgcaatggcatgatctcggctcactgcaacctccgcctcctgggttcaagtgattctcctgcctcagcctcctgagtagctgggactacaggcgcctgccaccatgcccagctaattttttatatttttaatagagatggggtttcaccatgttggccaggatggtctcgatctcttgaccttgtgatccacccacctcagcctcccaaagtgctgggattacaggcgtgagccaccacgcctggcctaaacattttataaaagcatttggcggccgggcgtggtggatcacctgaagtcaggaattcaagaccagcctggtcaacatggtgaaaccccgtctctactaaaaatacaaaaattagccaggcgtggtggtggtgggcacttgtagtcccagctactcgggaggctgaggcaggagaattgcttgaacctgggaggtggaggctgttgagatcacaccactgcactccagcctggacaacagagactgactctgtctcaagaaaaaaaaaaaaaaaaaaaaaaagtagatggagtagtaggagatccaaacaccaaacaggttttggtgatggattggatgtatggagtgagatgcccaggtttttaccaggggcaagtgtggggagaaagtggtgctgtttaccactataggcgacacgaggaggaactggttttgagggtgagtcatttcatttgcctgtgttgaatttgaagcaccattgagaagtgcaaatagtgtcaaataagcagctggagtgggtttgccactcaggagaaggctggggccccagatagaatcaccaagttgatgaatggttctcaagtccttccagagcccagtcaatgtccactgagccaaaccaacaagggcactctagaggtgacgcctggggacggctgggcagccccacctcacctcatcccagtatcttcctctggctcccctcagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttg

SEQ ID NO: 36892 - DNA, 62743 bp, Homo sapiens
gactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttct

SEQ ID NO: 36893 - DNA, 112990 bp, Homo sapiens
attctgagcccgaggcgagggggactcgcacccactgccacctctccctgaccctctggccaccatgcacctcggcccggctgaggggagtcggggggtcgggggagagggcgtagctgccgagagcctggcgcccctgcccggaggaggagaacggaggacgccctcccgggtctccggaaaggaagggggacggggttcggtgggtcctgggacggggatgggagggaacgtgggcgagctgggagccgccctccgcagcctggactttcctggcctttctctactccgaagcagcaccgggccgctccggtccccgccagcccctgccagctccgcttccgggggccacgaccctcgctcgacttcggccgctgtgcgcctcccgccgactctgacccagggacccggagaccaagtccggctggccgaggcccgcgggccgcggcgcaagttccgctcccaccgtcgaggactgtggaggcggcgtgggctggtctccgcggccggggggcgggagcgccgggcggacttgaccgtgggcgccaagcgtcccggccgcgcggcgcgggctttatgtaaatggaggctgcgccgggcgtcctaggtaggatggaccagccccccgcgcctcggccctcacgtccaataagaagagccccagcttgacacctgcctatatacaggcgagcgcgcccccgggccgcggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaaggtaagcggccgcccagcgcccgtcgtccacggagactttctagaaccttcttcggtttccccgatctcttcagcgggtgagggctgcgggacggggccggggtcgtcggggccagcctgtcatcccggcgcagcagagggaccccctgcctgtcttcgggactggggcgtttgaagccccgccgtggtctgaggacgccttggggacttaacccaacccgaagcgcagcgttgaggggcagccgtcaacggctcctgccccggactctgaggctggtttctgtccgattctcccggtcccgactgccgcgggggaaggcgtcggaaccgcttagtatcctcagatggaggccggggttccccgtcagcttggccacgcagcctggccgtcgcctctcggtcctccgccttccgggcccctcggctgttggtcccaatcaggtcctccacagcccggagggtgctgaggggctttcccgtaaggaattgtcaagacaccagcgctctggccggtttgacaaatttcacggaaacctgactgataagtacagtaactccaacgtcagcgtttcatgtgaattttgtaggcagcggcagtttccctgggaaacttaaaaagttttaatatttgttagcatgttcggttttgaactgaagaacttacttttttttttttataacgaacgttgacatcttgggtttgctaagcaggatttttgttgttgcatcgcctaaaaaagaatatgcgtctgctacctaatataaaatgaatttactttccacaaattcgacatagaaaaaaaatgatcgattacaaacgtaggggtattgtaatgttacaacattttgagggaggtggtgagagagagatgggattgaaaaccacgtttcttggagttcattttgtagttctctggtttgattttctagtcctttcggtacatttctacactcaacttctcccaattaacgcaaacgcatagacgcacatgcatatggttaaaggttgattaaagatgtattccatcgtgcttttttacaagataaattttgtagagaagtaaattgtttgcatctggcttagtggttgaatgagatatacaagaaacaacatcagaatattgagattttacttgcattgagttttaggttacaaatcagggcgatttgtgttttgaatgtcgatttagatggatttaatgtacctgctagcttttttagatggtgtgacaaatttttcaaagccgttttaatgagaggtcgttaatggttataaccttttaggcattgtttgcataacaatagtgccaatgtgtggcacttgtctgggtttaggaacgagcagggaaagcatgcagcttagaagttttattttatgagggtctctaacctcttcaggctctttttaaaggtcttaaaatggaagatctacacaggagaaaagacctaaccctcagatttgggaaggtttgattttagtcttatttttgatgggatttttctaacagcctctgaaagaaattttaggtatgcaataggtacgtttttcagaatttaatttggaagctcttccagttctcttactccctaactaccccctctctcttttctctcttgttctcccccagtaggaaagacaactgatttatagctaattggagcctttaatgtggagtcttttagctcggggaacttttatccagtatccactttcccacttaatacaaagaaaaacaatcagaaatgaaataatggattgtaacttgattctttaatttgtggggaggaggtaccttatttttgccttgacaaacaaccctcataaacactgagtaacactaatctaaaggcgagctctttccacaaaaacttgtaaaatcaggtatctgtgagcattcccagcagttttcctcctcagctctttagtgagacttctaaattttctaagacaagcatagtggacaagcagtattttttttttaaacgtgaagagcagaagctgctcttttggtatcccagggtaatgatttttttacttaaaggaaaaataagattaatagtgagttttttaaaaacaaacatgaccagaagtgagggaaattatattagcaatttcaaacagaagagtgaacaagatagaatggacagtcctttagcatagtgataccatattcgataggggattttaaaagggtaatggctacaaaagtattacgcgttagggcgtgttaaatatcacatttgaaagaaacacaatatttgcatcagaaaatgatactgtaagacaatatgttattgttttttgtcttgctaaacatacatctttagtgaaggatatgactttctgtatgatttttcagtgtgatattgggacccacatagagtcactacttaaaataaatgaccagactatgagaatttcaagtaatgtgcacttagaaaactttgtacttgtgatcttgtatttttctgtatttttgctccaacttcctcctcctcctagaagtatttcacatttttaataaagggaatgggggagatgaccagaattaaaagttactgcctttgcctgctagaggtccagtggaaatgctccagaattaaagttcattccctaaggatgttgaaagggctaaactcatggttgtgtatggacttttaggcagttacattccattttttaaaatacgcttaccactctgaaattctagtatccatattataccaatgatcaatggcaataccatttttggaacatgtctatttgtatttccctaatacagcaagctggatcccaagttttaaaagtgatcccttatgaaggaatgtgctttttaaaactagatggtgttagtcaaggaggagtgaaaactaacatgaagtattgaggggaccaatttggtaccaagagaatgcgctctcctttgcttgtatcctaagaagactgcattctgattgccttgagcgatgtgtttatgaatttaaaattttctgagttgtctattttattagtctgacttttataattttgtataactgatattataggaatacacacattacaaagtcaaggctcagcactttactgaccgcccctgactgcaggggatatctcttaacagattcccaggtctttggaaacttgtcctctgtattccacttcgaccttctttcttggctctatcttctcttctggctgtaccggtctctcctttccttcctccctcccccagatcgttgtgctgtctttctcttggtcactttttcagtgagagtttatgcccataactaacagtaacaaagagttatgttttttttttctgcatctgatattatatggggctgaaacacagggaggaagagggtatttataacataatgacctgctaaaatagaagaggcaaaaaggcaatcaacttaaaactcagagctaatgtgcatcgtgagtctagatttgtctttttatttattcatttaaacttctgttttctggggtctatttcaattaaattcaaaaggcatttgagtggccatgttcctaacaggggtgcttttcactgtgttagactggaaacatctgccttctgggagattagggtcttattaaaaagtttgtgtgccaaaaattggttgttagtacagcagtagttcagttgatcaatgtaataataatgatgatgataattataatgccacttacatttttatagggcctaatggtctgcctagcactttcatatatatcttgtttgatccttgcaaaaccttttgaaggagagagagtagaaataaatagaataattcataagaaagacattggccttgactttaaagaaattgatagttttcatcaccatacactttttctaacggtctgtggcacgttgttttttcatcgttttgttccgttttttttttttttttgttttttttttttttgagggaaggagtttaaatctttatattttgtgttgcttctctcgcaaccatggagaaaatatgaactagtctacccctcttaagaaggagctatcttttgtgacttttgattctaatactttaaatggctatttttgatttttctatgagatttttttttttaatctggggcaagattcttgcctgtgccaggaataatttcttaaaagataggtgtggatctagatccttccaaacctttacttaagattgtctgttttggtcataaattgtcagtcaaactacatgttaatagaggacttcaggttttttttttaaatactttttcataactatgcagctttttggtgtttgtatcatctccatttaacacagggaagctggacaatttcatcacaggacttgaattagataattctcctggggtcctgccctgatcccttccactacatgggcctatgttaccatgtggaattatcatttgctgagggactcctcgttctttatttctataaaatgatgaatgatagtttttgtatttcagagtagaggattctctgaggagactgttttgtgaggtctgacttcctcatagccaggcttaagaaaggcaaatcatgcatagttagttctctgttgcatcaatgaagcacaatgatttaaccatgacaaaatcagtaaatatcccaagtcccatcacccagagttatcagttctgagtctttcttagttggacaataaaatacaaatactgataggagtttttgtctcttgagttatcttagtgacagtatcaggggtcagcaaactgtggactgtctgcctggttttataaataaagttttattgtaacacaactgcactcattcaattatatactgtctgcggcagctttctgactataatggcagagccacagaaaccatatagcccacattttagaaaaaacttgcatgcccttccttcatttggaaaaagagagactctgagttaaaataagcctttgatcaaatcctggtcagaaaggtacttatcagctacatggacagttacatttatttgacacatagtgcctgatatgatgccaggtcctagggatgcaacagcacaaaaaaaaaaaaaaaaaaaaaaagatatgtgtggcatcttaaagagtttcttcactgactttcaatttctacatttgtcatcattgagataatagtatctactttatggggttaaaaggactaaatgaaaagtgtgttaaagtaagtggcatataatgatagccaaaattctattgcatttttgcaaagtgatgactatatatatatttagagatctaaattaatggaaaccaattttaaggaagatcagaattatgtgatcaactggccaggcgcagtggctcacacctgtaatcccagcactttgggaggctgaggcgggtggatcacctgaagccaggagtttgacaccaacctggccaatcatggtgaaaccccatctctactaaaaatatgaaattagctgtgtggtggtacacgcctgtaatcccagcttcttggaaggctgaggcaggagaatcacttgaacccaggaggcagaggttgcaataagctcagatcataccattgcactccagcctgggcgacaagagtgaaacttcatctcaaaaaaattatatgatcaacaaagttttataaaaccggtctgttttatgtattcttttaattatttttattacatttattatgtgcattactcataagagttcaatattctgggtagctatggaatcctccttatatatttacactgcgtttttaccaaatgggattcctgggagggttttccaccaaggtcttgtctttactaaaaaagttactaaagcattttctctgacagtattttaataataaaattagatatcttgacatttgtgccaaaatatagcatgaatatgcttcaatatgcccgattagctgagcctaaactccaggttgcaaatagacgtttctggtattttaagtagttaggataaaaatacaagatattgatacataaatgtgggaagtatgcagcatacaaggacattctcagaaggtagataccttttgacagtgggaaggtatcttactttatataatttaaaaacgaagaaacttttactagtcctgactgtccaagataacatatggaattttgagagcattttccaggagcagtcaccttccagaaagtaaaagcaccaggccgtggctattttgaaagccctcctagcatttctttaatttctttattgactgtgacaggtaatttcaaagccattcatttccccccaaacagcaaatctaattcacgtagaggtgattgctgtaatgtcacctgggttaatttttaattgcctttaattgtatctttgagatctatttcatttaaccttttaaatatatgagattatgcacattgggaattacttatcactggtatttctctactgtctgcctttaagattgagttatgtttaaattgttttccttcaaaatcttagagcttatttacagcaggtttatttacaacaagtctctgttggatcacatgatgaaaacacttccaggctttgaaaattccagttggaataataattgggtgatttcaccacctagacttctgctgggctctaaacaacacttccctggggctaaacgtggggattaattgacctctgtagaatgtggttaaaaattagtatgtctgcgtgtgaactttctaatttttattatagaaggaagcctttcttttactccagttcagctctgttacctccagaagtagttacctgctctgtttcccttcctcatcactgtctgacctttggagagccaaagtagtatttctttatcactacaactgtggaaagagaaaagcttttgtttaggtcaaactggaaacacctgtttcttatctagaagaatttagcatatcatgaatctgaaaactctttccaatcttgattatacatttttcaaaatattaaaaagttatattttaatatattttattttacattattttcatccatctattcattggactttgaatttcaagtccagtgactcttaggttttttttttttttttttgaatatcatttctagtgattccttaaagattaaacagtcagaaagtggtataggttgtgtgactctttcccacaagaagaatggaattacctcccagtaaatgaatctggcgaaatattgtgagtttaggaaacccactaattatttagcaagcccacgagatatgcaaaaataacctacttccccttttccccacctgtcactcctaacactcatataccagatttccagactgagatgtgtgtgatagtggcacgatttcaggtgggaaggaggaggggaaggctttgcctgggaaggtgaaattatgaaatgcctgtatgaatttatggagaacaactgaaagtcttatttctctaggtgtgaaaattggacttgctggcagaatcctttttgggagaagatgaagaatcagtgtgagactgtttggttaaaatccccaataaaactgaaactggtgaattctgcctcatctatgttttacagtttgataatataattgtattatttaattttattataaaatttaattttaatttttattatctcagggtcatttttatttttggctgtagccagagctactcttgtgcctccctgaatttatgtattcatttgtgtatttaacatttattaaggccttttgtgtataaagcattgtgagtcactctggcagagaaagatatataggtgtggcccctgctctgaagaggcggtagaggattcccatttgggtgtggagtggggtcatgcacacagtagctattgttcatgatagaagatgctaaatgtttgagatgaatgaggattcagaagatagagatgtttccagctcagcagaagaacagcacactattgccagacatatttgacagaaaatgaattgctttaatcatacagaaaagtaaagcagtaatataacaaatgtgtgtacctgtacctagatttgttagttcttaatgttttgcagtatttgcttctaattttttaaaaggaataaattgaagcccccatttctttctttctcttcctttgccagaggcatttatcttcactataggtatatgtatccataaataatacatgctattgttttgcgtggtaacatcttttatataaatgttttatatatatgtaccatatatatatatatatccttctgtaatttgattagcttgttaaacatatgttcagtattcatccatgttgttggatgtacttataattagttcattgtaattgttgcagagtattccattctttgaatatatcctaatttttagtttctgctcttgacatttatgatgcatccagcattttgttattgcagtaatgctgcattggacattcctgatcatgtctcctcatatacctggtgagagagcatctaggatgtatacctaaaagtgatattgctggctcatggagtatatgtatctacaacttaattagggattgccaaatttctgtccaacatagttatactagtttccaccaccagtatattcccagtatgtacacctccagtatatcccaccagcagtgtgtcagagttcccattagtctacattttcacctatacttcagattctcatacttattaaattttgctaacctggtaagtgtgaaatggcatctcattgctactttgatttgtgtttccttgatttcttgtgagattgagcatcgtttcatgttggccgtttggttttcctcctttggctaatttatcatttgctcatttttctatgttgtgtatttactgatttgttatcagtttttataaatgtattcaggattataatttttatcagttatttactatgcaaacattttctttcctcttgtaactttccctcttctttttcttgtgtaactgtcatacagttttaaatgcaaaggaagaaggatttttcctttagagtcctgtttcagaaatgcattcctattgcagatttttcaaggcattctttttgtagtcttcagaaagtttatttttgctttttgcatttctgtctttacctcctagaattggtcattgcttatgcatggggacaataataaagacaaatgatgtagcattggaaagtcaaacaatattgatgtttaaataatttttaaaaattgtattccttgaagtcttggaatcagattaggaagtctagaatgtgtggtcttctctataatgggaaaataggagaaactactttgattgatggttttaatacacactagtttccctaaactaagaacagtgctgtgttccacaaacttacctctaggcggccactgtataaaactctagggtaacatgattattataacttattcatgtcaagacttaatttccctacctttcttacattatctggaacagaataagtacttaaatattagctgtggttgtactcttgctcatgtgcgctcgcgctgtgtctctcacacacatacaacactcatttttgaagggtcaagataaattgatgaattattcactctgtgctgctgatagatttggagaaaacatggataggtagcaaataatttaaaaagaatttctaaaagaccttttttttgaataactctacattattcaagaataatatacttcatcctgttagtgaagagaatttaaattattcctaagcaccaggtctgaaaataacattacttcttattttgttaacattttaacttaagttctaaacccaaagctggtgtatatatttacctttgtgtttgaatttcatcagtgatttggttcatacatgtgtatctctaattttaaagaaaatattgtggaagtgtgaaattctccaaccttaaaactaaaactaccccttctgtgtatatacttacatataacacctgacaattttggctacacacttattttttgataatgaatgtatattctctgagcattcatattacttatttgcacttctcagtggtacaatttttgcatggtattatatttttctgtgtaactccctacttctaaactgtactagattataaactcttatttatcatggtgtttctgaagtacctagctcaatgtctaacaatgtagaaacttcaagaatgttttcttaatgaatacttgttatattttaatagctacggcttttattattaatactacaatattcagagtacttttcacatatgattacattaaattcttggggcaacactacgatgtggatattgtattaatatcttcattttataagtgagaaaatcaagcatattaaagttagttttttcaggctcaacagcaatagtgggtggcaattccaggactcaatactcctccttccctactcgtaacaataaggacaaacataataaccactacaaagacaatacaatttggactattaacctaaagccttgctgaatgtttcataggaaaccccaagcccagttcctcaactacaaatcccatatttcattcagatcctaagtctaattccactcagtattgtccgcagctatcataagcaacaattccaaccagacaaaaatgggagtatgaatttaaaaaaaggagagaattgatacaatttgacactttaggtatacatcacctgggaatatgtgattttttaggttatgataaagaacgatgtttttcaatcctcattggttgtgtagtcacacactgcccttaataacacctgtttatttgatctgttttgtttgcattcaaaaagtgttttctttttttatggctgttaagattgacttgggagggaggatgtgtgaggctattgaggataatatattttacattctttctaatgctttctgtgccccagtgggccatcattttgtgtaactgggctataatttctgtgagagagatgcttgccagaaagagttgggtgggtatgttccatcttgtctcttatgagcaatcatcttactaaggcttaattactatcagatccctctgttacctgtaatctcagtggggaggcagaatagaggaattcatgcagtactcaaactttgagtttcagcaacacaaaggggtggcatttggggtgcacaattaatgtttcattataaatgattgaaaaatcctctctaaagaaactgctgaaaggttgtgtcctttaagccagatcttgcaatctccagatttctctgacttcacttttagagagaacagatcttttttacttaccaaacttatgccttttctttccttttttattcctccccttttgtgcttctcttctgcttcccttggtgtttctcttaggacaggcacttgataactcttatttctcgtttagactcatttacctgtttgcatgaaatggttagttatgcctgggaacctttgtagttggctctcccagctgttggcctaaatggtcctttgggagaccagaagcaatgaacctggaataaccacatttgacttctgggagccctcctgagaatttagtaattacttaatggattgaattggcgacatatactattccagataacagcctgggttgcattaaattaaccttcacaaatgggtatttattggtgtactcttaaaagactacacgtgttggctgtaattgctcttccatgtttctccatgctgataggtatttgtactgagtgaaaaatttctgagattaaagcctgggtggtagttgtagctatttagtgatgtgtgtcattgtgttcagcacattgagcataaatcctgtcttgtaaacagcagggagactaatgaggtttgcccacattctggtatcattaccaggaattccaacagagaaaaagagagggcgtagaaaagaagtacacaaaacagtgatttttggaactcctgatgatctgatttaaggagaaagatgattgctcagcatttagtataggcatgtatgcataaataggggtacataaagtacacttagccaaaaaacaaaccaaacattttgctttcactgaatgcttgcaaagtcactaacttattgctacggagatgagggccttatttgtgagtgtctgtaattgtgagtggtgtaaaggggacaactgttgaaataatgcagctgttaaaatgatagcatgctttttgcttttttggaacactttataatttcagtgaactaaaattccacaccaattttagttttacaatttttggagtatttctgctgtcattttcagtgataggcacacatgacttcagaacacaaaaatctcttagaagaagcattttaaatgtggcattttaggtttatttcgaactttattattactgttaagtactgtgtgttttataatgtcactccaagggatccaattactgtttaatttgtagactcatttttttcttggacttaaatttttatgagagccggtatcatggctgccttgacacagagtgtggtccatacatcttcgtgtttgatgaatgaataaatgaatacatcctagacaataaattgtctgatttcatttgcagagtcattaatagttaaaatgccaggactagaaagtgaattccaaggtaaagtgttttgaaacaaatttctttcatgtgcttcctttaaagaaggtatacacacatccactttggaaaactcttctgcttcattgccacgcatttaccccttcctctgaaatagaaacctttcagtgtaccttgcagagcagtgaacaaggcactggacagggcattagaagacccgtgttctgaccccagctctgtcacttatgtatgttcatttaacagtttcttggatatgcaggcattgaataaatacttattgaattagcgaatgaacaaaataacttgatcatttattatctattctataatgggacctggaaatatgaaaatgctttgtgatactgggtacgccacttaaatttcctggtaacaggaagcagaggttgcactgagccgagattgcgccactgcactgcagcctgggcgacagagcaagactccctctcaaaaaataaaaaaaataaaaaataaatcctggtaacagctttgttacttacaaaatgagagaccagaatgagatgcttattaattaatccacctactttttaaaagtgttggattagaaaagctataagatttctttaccccaccctgactaattagaactctactttcctgggcccagaacttgggattatgggcatctgaaagacaatactgaactgcttgcatatttagttgtggtctttttagggccgaaaatttgcactcaaacagttttgttgaaaatactgtctcaacaatgtactcatggttaccaaagagtagtccacagaaatccctgttaatgattctcgttatataaatgagtggctagcagtgtcataaagatccagcggaaatcaaaatgtttcatatttgctaaggacttaccatattagaaattagagcagtgactcccaagagacttcctcctttgagtcttggtgaaaattgattttaatactttgtaatagtagtaggcagaaaatatttgttgtcatttctcctccagaccatttgagcagctttcctgccaagctaagctcatgaaaaccatggagggtgaggaagcgtggtggcaagggaacttgtcagaagcttacagcttttcacttgagtctaatagagacttagcactttgcaggtcagtgccactgctatttgtctctgacctaagagatctggagttcttcacatcaaaaccacatcttgctgagcagagatcaaacgtaggaaggtaagaattctgccagtgatttatcatgccagggagagtgatcaggccatatggggccactgcaaatgaagttgacattctggcagtttctcatataggcctctcatgtagttatggctagtttttcttgtagaggaattccgggtcaagtggcagctttcagtggtatttcttagcagaactgacctccaacatgaggtttatttcaaaatgtagtcctagcaagagttttctaatgttgtgtttaaatggcaaatagggatcttgaccaaatttgagcttttcatttgtctcctttcctctttttttcttttctgggaagttgcctatctaaaaaaataaataaataaaaagagaaaattaagtttaagatgtacaaaaatttctcaaaatgttagatgtgattttaaaatgaactctataaattatgcacaattaggcttattagtttatcatcacagtttaagtcagggtcctttaggaatgacttactgcaaataatattataatccagttcctggggtaagaggaagcatcacatttaaggaataatttaattctttaaatacgattatttgctaagatctgagtcaagtgcaaaccttttcatttgacagaaaaaaattcaataattcttctttaactacttatatcaacagatatgtaaaaatgattgtgctacataaaattcagcattttgtttaccgtcacaagcaaatgtttagtctcctgtggagaaatcactcatttattggttcaaagccttcttcaaccttaggatatgcattgaggtgttcgagcccttccttgcatagatgtttgctttgcagcataaatgaaagatgatattcacatttaaacatagtggtttgagacattaacttctaattcaactgaagatgctagttgctacttttggttttactttttttgtgatgagaaaaatttccttagttgaaataggctttagtgactagaactaggtcttaacctgtgtatcaaattcacttgatttgttgaattatcactttatctgtttataaactggaaattaatattccggttgatgaagtactttgcctgtgcagggagcaagtctaagtgcaataatgaaatggaatttgtcttagttttcacttaccattcttggaacacatacaacatccatgaaaacatggtgggattgtcagataaaataaatgatttttagtgaaatttgaagattaagtaaataatgaattagttttttagtatcagtataccctatgatttcccatacttaaactgaaattttatttactgtttttctgaaattcatatttaattatacttttatttgctaaaacgggcagctctaaactgttagagaaatcattggtgatttttatctgtgaccagttaataaacatcattttaatgtaaaattaactggcattaaaagcaaaaaccaaggaattctttaaaactggtacactggaataatgaagagcacagtagaaagactttttttttttaaccctagcaatactattgaataaatagggcaactaagcccattgtaaaaacagcttaatctcctaaatgaattgctccaaccttctaattcaaaatcatacaaacaaaaacattgagataagctgggtgctttttcaaatggggacccccgtggctttgaaaataaacacttcagcccccttccccctcaagacccacactcacacccactagcctttctgaagtcttccatttgcaaatgaacaggctgaattctgagaaagacagaagactaattgaacctagggaagataggcagaggaacatttgtttccaaacagaagacaaaaagaaatcatgttacattctcagttttcaagacaggggggtacataaaagccatttctcttgagttttcttctctcaaagtacatttcccacaccgctgttcagaccctctacaggccaggtagccttaccatgtttgaaccagcctgcattagcctgtctctatggcagtgtcagaagtgggtagtgatcagacatttggggagaccagttaatgtgttggatggccttcaccatctttacctctttccccaccctatctgtctctgctggtttagcaaagtggtcttagtagcaacagagagtaagtgaacgaatactcagacagaacaaggagtgactagctttttaagagtactcataaattgccttgaattgattgcttatattcagaatcagaatgaataaaaagtctcagtgcatactatgttaggcttttcagtaatccaatatcttatttaatccttacaaccactcaataaatggtttttattatcttattgtacaaatgagaaaattgagccacagaaagtttaaatgacacatctaagtcacaccatctagcaatctttgtacacgtaggaatatgacccataaagaaatcatgcgagaggaatagaggcacaactggatcttaggacaccttcatcaaatttctgtggttaaagaagatttggtatattcctaacatggaatactcttcagcagtgaaaagaaccaaaccacaagatacattcaacaacatggataaattgtaaaatacgctgagtgaaagaacagaaaagggtacttactatgtgattccattcatatgaaattctagaaaaggcaaaataatctatagtgccagaaagcagatcagtggttgtttggaatgtgagggtcagggtgggtaagagggagggattacaaagggaaacaaggaaatttgtggggtggggtggggaatggatatattcattatcttgactgtggggatgggtgtacatatgctaaaactcatcagatacatacagcttattattataccttaacagagtattaagattttaaacatttaaaaaatagagtccaagaagacctccatgagactcagctcaggtgttagtcatacctgtcatttgattaagggagactgggaaaattggacattttagatctgttgtgggagtatcctgctgtaacccatggaatcctgagtcaaatggaacactaggtctgcatcataggtcaccgtaattcccctggaccctttaatctgaatgacccaaaataacactgaatatctcaagcagcatcattctgggaaaggggcagatcccccatccatacttcccttctcaattcatttggatccggccttgtccatcaaaggctgaccaaactgtcctctggggaacacgactagtgaccttttgtctctgtagtctcatctgtgtcctttcactttcagaagcagaccttgaggttagatggatatgtgagaagctaggtggatcttggctacctaactgttaatgtcctaagttatttccatttacagcattaacacagtttgtgtaatcattgaacatcagtacaatgtgttgggcatacaacacttaatttaaaatacccagctgcttactctggcacaatcactttctattagtattttaaagctgttttaaaatgttacctttagttttacattttttttgaccttgtactgtctgaatacttgagcagtctagttagcagccttttctagtgaagacttttcctttttcctgactttcagcttaggactcagcataagtggggttcagggcctgcaatattgggtccattatttaaaactgttaattgatttaaaattataattgataaattagtccttctcaaagcaagctttctaaaaccatgctttttgctagtaaaatattacacttactgaacaaagcccatgtccctataatatcaaaacattgactttaaagtgaaaaatgcaatcaatcatctaggtgttttttctatacaatgccatttgggtgtttttttcactttttagccagatgttttggcgtgaagcaaagcgaatgaataatggaagtcaacagaaccactcttgttctaactatataaccatttcaggaagaagttttttccccctctctaaatgatctgagcacttgccttattgttttactctgtataggtagactcttaattagaagtaaaaaaagttggggctaatttttttcaaagttaaaaatattacctttgattataatgtttaaaggacaccagccttacagagtgccatactgagatgatcatcaatacagttttttataggtaaatgatagcgctgccatttttttggttgttcttaaatctctttaaagtagaaacagtgggacaatcatgtaaaaggagataactaccattaagtcctcaaactacttccttatattgtttaactaaactttttcatataaatcaatctggatattgatttgctgtctggtactctcttatgaggaatgaaaacagtttaatggcaagttgagtaaaatttaactctccaaggtacaatctactgcagagtttaatacaaatcatttgaagcatttactattaaaaaaacaaaacgttttattactgaaataaaacatggcagctttatgtcaaagattcactgaggataggaaattatttacacctaactcctatcaatacctgctgctttgagaattcctcaggctttagattccccaattagaaaatccatggcagcctgcctatatagttatggccattttgctgtgggctgacaagtgcgataagcctagtttgtcctctcttgttttcctgttgcaaaagtggccaagcaaggcaggctgtatggctagtaagtttcactgttttgaatctttatccagctaactgttgagatgtatacagcaacttaaagcaacttttagaagaatccgatgctgttgacagccaatcttaattccttatcccagccccactactttttctagaaacatgatttactatatcctttgagcacctactgcattttaagtgctgttaagatgtgggggaaaccaaatgaagccagcagacctttcttcaagaacttagggaagagagaaactcccattttaaccagctatacttcaggcacatttcacattttatctcactaattgtgcaatagctctgtaaggcagacaggtcttatttctgtttttacggaggaggaaacaaagctcagagagtttaatagcttgctcaggatttacacaagtggcaaaaggcagactggcattaaaatggagatctttcaactctacctcccccattctaggttgttctatgaggaagatgaaggaatacatacaagattaatcacctcaatctttaacgaatttcttgatttttctttactttgttttacatacatagatatgacccttgtaacattcaaccatcaagcatgaataaattaagcaactctacacctgtcttgggggaacagacttgcttgttaccttgctatcctgatgctctcttttgaaaagtaaaattgtataaaccagcgtagtcacttttaattggctttcaaaaagccaaactttatgatctttactgttttaacacaggaatacaaccatctgcaccattcacatgtcagactaccttccttggagaccgtgagatatctattcctttgtggtttgggaagggacatttcttattggcagaaagcctttgttgcagggagtattgtccttattagagttcttaaaagcattctactaggaaggtgaaattgctgagataagaaaatatatgacatttcctgccatggtgcccagaatctaagacgctttgaaatattgacaaaaggaaattgtacttaacagatttttttcaaatgcatgtgtggagtgtctctaataaagtaccattatgaatttttattttaattcccttaggtggaagaagaaattgtgggccaaacagcagtgaccatattcttttttaattatactttaagttctagggtacacgtgcagaacatgcatttttgttacataggtatacacgtaccatacttagccccccatcccctgacaggtccgggtgtgtggtgttccccatcctgtgtccacgtgttctcattgttcagttcctgcttatgagtgagaatatgcggtgtttggttttctgttcttgtgttagtttgctgagattgatggtttccagcttcatccatgtccctgcaaaggacatgaactcatccttttttatggctgcatagtattccatggtgtatatgtttcacattttctttatccagtctatcattgatggacatttgggttggttccaagtctttgctattgtgaatagtgccgcaataaacatacgtgtgcgtgtgtctttatagtagcatgatttataatcctttgggtatatacccagtaatgggatcactgggtgaaacggtatttctagttctagatccttgaggagtcgacacactgtctcccacagtggttgaactaatttacactccaaccaacagtgtaaaagtgctcctgtttctccacctcctctccagcatctattgtttcctgactttttaatgattgccgttctaactggtgtgagatagtatctctctgtggctttgatttgcatttctctaatgaccaatgatgagcattttttcatatgtttgttggctgcataaatgtcttctttcgagaagtctctgttcatatgctttgcccactttttaatggggttgtttgtttttttcttgtagatttgttgaagttgtttgtagattctggatattagccctttgagcagtgaccattttataaagactttggcatttgatatgcttttctttttcagtctgggataccgagattctacagagaagggaacatatgaaaaaggactcactttgttgccatgaaattgtaaccagctcctaaatcagttagcttggccattcccttttccctctgctcatccaaaaccggccctcctctgggaagtaattatgataaggattggttttgaggtcctcttcctgaatcctcaaatttagtcctgttggttggaagagcacaaagctattccttaatatgcctaggaaaataattttctatttgaggattgtaatagtctggttgttgactgtcctctggcagaagtttctgcttctgcacctgggaagactgcagacagtgtcccaggacctcatctctaagtagtgtttcattaggaatataaatcaacagtttccctaacatattttgctttcgggaaagaaaatgaaaaattattttactggcacctgtgttgattgtgctgaagtaaaaggactcaaacagaattccttgtgctgaacagtgtctaagaagcatcatgatacaggaatagaaaaccacacactggatgttctcactcataaatgggagttgaacaatgagaacccgtggacacagggaggggaacatcacacactggggcatgtcggtgggtgggggcaggagagggagagcattaggacaaatacctaatgtgcacagggtttaaaacctagatgacaggttgataggtgcagcaaaccaccatggcacatgtatacctaggtaacaaacgcacacattctatacatgtatcccagaacttaaataaaaaagaagcatcatgatagagatgcagcaaagatcactcggatctggtcagccatcaagtcctcttttcaaatagacatcagcaaaaattaagtttagaaaaagcactgaggtgggaatcaggatatggggggttcgttctttattctgccacaaatccggggtatgtggccttggtcaagccattggacttcttttgacaagtttatttatctaacacttggatttgcagagattatatctaagaccctgtacagctctgtgaatctgtctcttcctaaccaaaggagcctctactatgtttagaccgagaaaaagattctcattcattagagcattttaaaatagtgctttaataggacttggctgttaaagtatgatcttggtgtactgaataatttcacaacaggaaacaaaaaccgttttttggcagggagggagggtttccagctgttcttggtgatgacttggcataggtttaaaaatgtctgttgtaggactcttttccacctgaatctcaccgtttcaaatgatgtctttgtagtatattcattgtgtgttaaaatattagacataattggaaaagaaggcagtcacatttgagaacacagagggcatactctgcagcagtcatggagattctgttattcaaatggctatgaaatgttaacatacactctttagagaaggaacaaatcaaacctatgttatcacagaacttctgatacactttcttattgagcgcccactggtggccacatgtgttctatatccactaacccagatgtacagaatattagaactcaagggttgtaagggatggcaatagatttaataacaaatgacatcttccattagattgatagtagctttctgaagtgccgtattgaaaagtattcagaaaagtctagctggaaagtgtcatgattcattattaatgtttgtcaagagcctggaaacaagatttgtatcataagtgccatggttagccttccttcagtcaccaggtctggtaccctcatagacaaagaaattgagggctagagaagctgagtgacttgccacatacttagcatgaaaccaggactaaaacacaagcaacttcacctcttccttttcctcctcctcctgtgctgtagaagaaaataagacttttataagggtatccccttataaataagcccctaatgcacagtcagtttaaataacaaactataaaatgacatcattgatagtggccaggtgagaagactgcaattcaatttggcctttcagacttcaagtcactcaggagaactccagtgttatgatccagtgccccagagaaaagcagttccttgtgaaccaccttcatttgcaagggctttagcaggataccagtggcactggtattttagtaaatacgtccatagtcttggtgaccacagtgtctttatctagaatcatgttctggatgaaaactatttgtcttaacttcaattcagacaagaaaaatgtaggaagcctacaatataaatgagatggtattcactgtagattgagagacagcttttctgggacatgagatgaaagtgattctaggatttcaagaaacttgactcctggaatccaaaacatacattgttttgcttttagctggaagaaacaatgtacgtttttaattcatacttgcttcttatgtaatatcaatacttaggaaacatttattgggcatctactattttactgttccttatgtagatgttggttatacaaaagtaaagatgacgtagtggcatagtatttgttcttaaggagcaagcaatacagtggagggtttaggtaaagtattacaggacagtatgataggtaggtatatgtcagaggacctgcagttagctctgtatgaagggatttaggaaggctttatcaagaggtcgtatatgaactcagttttgaaagatgactaagattttactgtcctgtcaattaaagaaggcaggaaacagtatgttcaaatatcctgactcacaaaagttcatgtcatgtttagaaattggtagttttaatataggatttgagagggggttgggacttctacagtctgaatgtttgtgtctcgccaaaaatcatatgttcaaatcctaatacagtagtccctccaccccattcatggttttgctttccacagtcaggtgagtacagtatggtaagatattttgagagacatcacgtttacataacttactacgatatggtgttggagttcacttcattactagttgttaatctcttactgttcctatttacaaactaaacttgatcctaggtatgtatgtataggagaaaaacatagtatgtattactataccagtagtttgttactgtctgcggtttcaggcatccactgggagttttggaacatatcccccatggataaaggaggactcctatacaaaggtgatagtattaggagatgagaactttgggaattgattaggtcatgagggcagagccctcatgagtgggattagtgtccttgtaaaagaggcctgagagagctagcttgtccattctaccatgtgaggaaatggcaagaatgcaccatctatgaaccaaaaagtgggccctcaccagacactgaatctgccagtgccttgatctagaaattcccggcttccaggactatgagaaataagtttctgttgtttgtaagccacaaagttgatggtattttgttatagaagcttgaatgaactaagcgagggagagacttagatccacagattttaagttatcatgctcctcattttatggcgcatgtaacacactggtctgtgcaaattctctggtttcccccacaggttttcactccaatctatatttagatatggacatattattgatggaaaacacagtgttattttttctctatatgttttatttacataaatggtggtgttgtataaatgttatgcaggcatagatacttggtgatgagtgtccagagatgagactggagagattgtttgggatcagattataaaggaatctaaccctttggaaagaaacacatttgattaatttattttgaaatggtacagatggccacttgaaggtcatgcggcatgaaggaagttgctccagggcaccaccctgtttcacatactagtatctaggactgaggttaaggtgctagactatttagattttgaaccctcctctactgtgttcctaactggggggaagttcattttagtttttgtgcctgactttcctaatctataaacaggacaaacatgactgcctacttcatatggtggatgtgaagattaaatgagttaatatgtgtaaaaagtgtctagagcctgtaaatagtaagcacgcaaatgttaacatttattattattctcttgctcaatttggttttcaattctgactttatagtaagtttcttatttatattatttctactacctttggcctaatagaatatagatctttaatttaaagttacatcttagcagaggagacggggaacagccatagatgttgagaggaaaggttcaagttttttgccctgtcaattatttgtggtgtgaacttggatttacatcataaactttagcttattcctttagacaggaaataatgcctacatcgtagatttgttatctagatgaaatgaaatggtgaaagttcacagtacatagtgggcccctcataacgttcgttgtatctgaattacttactgaatgtgtgttatccatgtactttgggttagaggaaattctgctccctagattatctgtctgcaggttgttttatgattcatcgtatagttggacctgagtaaacgtgttctattagcacagctcttgagaaagaatgtacttatcaaacaattctgcctcttcagctgtggattcagagagccagtgctttctttgatgaaggccacttcgtcagaatatgcagagaggtgttctgttggcttctgtcaggcaggtgtggttgctttggctggaattctttaagacacacaaattgcctctctgatattttatacaattagaatataaaatatattatctttggagcatattcatagtaggtattcaataagtgcttgtgaatgttgttcccaaattttattattagaaccgtgactgttgatttcccccaccacagtactgaacacttatttcaagggcagggggctgattatcatttacttttttatatcttccaatgcctagcacagtgcctaccatataataggtgactaagaaatgattgcaaataaaggaagaattaatgacttctagggagctaggacaaacatgccaacttcctctccttttgcatgtgactcccctccctttttgttctcttcttttctcttttcagctcctcccttcctcttaataatcaatgttgtgagtcacttaactagccctaactcacctttttagaagacaatatttctttcctctcttcacaaaaatgaaaggtgacatgtctctattataaagaaatggcctcagcaacttctggaaaaactctagtggttaatcagttactttttatttaaatatatatgcttaatgctgaattacattgtaaaactcccaagctgatttatggtctcagcctgccttaattaacatcgattccagggggatagtaaatgggaatggccttcacaattgaggttgaacaatgaactctctgggtgttgtccaatttgtaacatgatttacatggaagcaagcccttcctttcccggggttatccctttttcatctggtgtttaggacgggttatatataatccatagataggaacatttgctgtcaaatacttttgctgatttagagctaggccacagaatggtcactattaataaagaaggagaaaaaaaaaactaatctgagactttgcagggattccaggttcttgctatgtgtcatcgcttgtccagtctgtggcggttttatgaagtggccataatgaaagtcagattaaatgcacaggatatatacatttaatcaacagccattggagtctgtggtgctggaagagttataagagccccatgaatgcaaacttattgcaaaagaattcaaggggtgggggaatgaatgtctgctgaatggtactacctgacacaggacaccaaaaaactttccagagtgaatgatttaagtgtaaggtttggcttgtaaagctgccagctgcttggtttcaaaacttgaaacgtttccaaaacattggatgaggcactttatatgtgcactagagtaaatactctggttttactgccaatttaaatgtgctcagtttacagtaatgagcttgtataggcattaccttgtttatagaaagtggaacaggaagaaatgaacattaaccattaccagtagcaattcccattgccttctaccacaatattgatggcaagtttaatttcttccaatttgggactgtgtcacaactgacattggtgtgtatttggctttaatgtcatgttgcttcagcagaggaacacatgctgtgattcagcttgcctctgtcaaggctgatcagaccagttagttgtttcttactgtttttcctaaaacagatgtcaagagacagatatgggaattctgggacagtagaataggtaggtaccctgattacacgtaactgggtctgttttagccaagtctgttttctacaaatggatcactcatgggagccatttattttcccttaaaaattatttgggtgtgtttttatgctgtacatgaaagcagtggcctctgtctcttgggatgactggcacagaaatatccttatccctgggataaggctatttgactccttggatcatctcctagagataggaagatacttagactgaaagacataatttacttggcctggagaagaaagaaaatacagaaatttaaggagactccagcaaatacaatgcctagaatagagaagacactgagtaaatactgttgaaagagataagaaaggaagggaaggaagtagggagggaggggaagagggtgttagtaggaagagaccagggaaacccatagcttaagagacatatcccatgatttcagagatgtagatttcaagaggcaggaagatagagaaaaaaagaaggggaaggccccacgggggaaaactgagtttaacagatgttagcaaacttggacagagacacattaatctcaagggagatagattacgatgtgtgttactaaaaaaaacacaaagtgtgtctttttgagttcaactgatatcaaagtcctttttatacattgtctaggtggatcaaagactgctggttgccagggacctcttatctttatttctgctttaatttgcatggcttcttagaaccttttggcttaagtacacatatagggatgatgctacccaaggaattgcacacttccagacagtacaatttcttctgaattatgtgggatactagctaaatgcagaaattgaccaaaaccaaaagcataatctaggtctgcaaatagaattatgatgcacaagaatgtgaatatcacatttatttcttcatgtcatgggctgtccatgttttcaggctggtcttgctttaatggtttttctaacaatactttcatgatgaaaaaaaataaagctagttattcaacattgaatagtttaagtattgaatgcctaaattttgaagtttcatgggagatgagttccacttctttctcttagccctgtcagtatttattttccttggcttttaaaagtctcttcttcctgtttcctctacagtatttttcactccattttttaactgtccttcctaaatgtgtggttaatttataacataccttaaaaattctttctcttttctcataattctttttttctcttttctgaggtcttctttctatgactctgtctactacctatatgagttttctgatttatttactctcattctttgtgatttgggggccttgctgcttaaatacatattctacttactttgaggacagtgctgtggtagaggctgttgttaagaatccaaggggcaccttcatcatttgagcttttggtagaaggggagaaaagctaaatgtccatttctttcttctttgttacacttcttaaatcggggtatcagataatcttctgagaggagctaaagttaaagaagggctgatcaggccggctgaataattctactgaggatagagtttctttcttgtacttccccattccctactccaggtcatacttcctaattatttcttatttccccaaagtgttattctaacatgtcagccacacagatttctcttttctctgaagcaaactccttcactgcttatctatactatccatcttggcactaaatcacagtgtcttacgttatttaactttccttagagtaatcttgtcattgaagcattattataagctccagagtacacgtcttctgtggattttcagtcgtacttacaatttcatgctcagaagaggcctttagtatatattttgcagtgtcttctgtgaagtcaaatttctgctcaggtattcttttccttcttagttccaactggtgctgttcatgttatatcaacctgtttgacgggaggatgtgggagggagttgcgcaggtcccttaatgttaaaaagtggttgcatttcaactaagagccataactcttctttagacatttctttagactattattttttaaatttatgtattttaaaaggttaatagttgctgccaaaagttgctgcccagtgtctttctgtcattatgcatctagatcttggataaatatgtgtatgaacatgaatatgtgtttgtgtgtatatgtgtgtgcataattaaattttattttccagtgatttgttgatagtgtattgattatatattgatcttgtatcctgggactttgtgctaaatttgtacttctagcaatttttgtagattttttaaggaatttctacatagacaataatgtcatctaaaaatatactattacttcttttattttaaaactttggcctcctatttatttcatattataatagcaaatgttattacactattaaatagaagtagtaagagctatccttgcatacattattttttaatgtattgattaattaaaagaacagtgatctggaaattgatagggagctaaaggaaaatgcaaaagctgggtttactctagaggtgaatgccaataccagttctgggactagtaaaataaatctatgtccagcatcagcaaaatgcacatttttctcaagctctcacaaagcattcagcaagatagaccacattctggggtataaatcacactttaacaagtttaaaaaagtagaaattatgcaaaaaagatattctcagattacagtggaattaaactaaaacagaaagatagctggaaaaaccaaaaatatttggaaattaaagaacacacttctgaataacacatgagttaaagagtaagtctcaagagaaattaagaaatattttgaactaaatgaaaatacaacttaaaaaatttgtgggatgctgctaaagcagtatttagatagaaatgtatcacactgaatgcatatatttaaaaataagaaatagtctaagcttttttaggaaactagaaaaagaagagtaatgtaaacagaaacaaaaaaataacaaaaattatagcacagatcgattaaattgaaaatgaaaacaataaagacaataaaactgtagactggttctttgaaaaaaattaataaaattgctaaacatgtagcctggctaactaaaagaaaaagagaagacacaaattactaatatcagaaatgaaagagggactattgctactactgccacggacagtagaagaataatacagaaatattatacacaactctttgcccacaaatttgataatttaggtgaaatgggccaattcattgaaagatgcattctaccaaaactcaaagagaaatatgtatgaataggcctgtatctgttcaagaaattgaatcaataattaataacctttcaaaaaagaaagcactaagtccagatggtttcactggtgacttctaccaaacaaacataccaattatctacagtctcttccagaaagttgaagcagagggagcactaactcattttatgaggccatcgttaccctaatatcaaaaccagataaagagattacgagaatggaatactacaaactattacctctcatgaacatagatgcaaaaatccacaacaaaatattagcaaattgagtccaccaatgtataaaaagaattatacaccataaccaagcaggatttatttcaggcatacaaggctgatttggcattcaaaattcaattaatgtagtctgtcttatcaatgggctgacaaagaaaaaatcaggagatcatgtctgtacatgcagaaagagtatttgacaaaattcagcacccattcatcatataaagaaggaagactctcaaaaattatgaatagaggagaatctcctcaacctgatgaaaaacatctacataaaacctatagctaacataatatttaatggtgagaaactagatgctttcccactatgactgggatcaagacaggctaccccctcttgctgctgctattcaagattatactagaagttctagttaatgcagtaagaaaagaaaatgtatacagactgggaaggaaaaatgtcttttttcacagataacataattttctatgtagaaaatccttaagaatcaatccccctccaaaaaagaaaaaaacatctagaactgacgggattactataaatttgcaggattctatgttaatctacaaaagtcatttgatttcttatatactggtgatgaacatttggaatttgaaattaaaaacacggtatcatttacattaccactgaaatgcttaggaataaatataataaaatatgtacatttataagggaaaccacaaaacttcgatgaaagaaatcaaaggagatgtaaataaatggagagatacactatcgataggaagcctcaattattaagatgtcatttcttcccaagttaatatgtagattcaatgcaatcccaatcaaaatcctagtaagttattttgtagatattaacaaactaattataaagtttatatggaaaggcaaaagacctagaatagccaacacaatattgaaggaaaagaacaaaagaggaggactgatactatccaatttgaagagttactgtaaagctacagtaattaagatagtatggtactggcaaaaaaaaaatacagaaaaataagtgaaatagagaagagaaccaagaaatacattcacacaaatgtagtcaactgatccctgataaaggagcaaaagcacatagtggagaaaggattgtcttttcaacaaatcatgctggaaaaactagatattcacatgtaaaaaaaaaaaaaaaaagagtcctaacactgaacttacaacttccacaaaaattaactcacaatttaatattgagttaattgagaaatcatttttttggtataaaataatttatgacaaacttctggagaagagtgattagatttagtgttgtaaggtcattgtattgttttgggggaggtttaagatattgattaattttaaaggtgaagttgttaaatatgcatgataaaataccatgaataaacaaaaaaatacagtgtgcaacttccaaaccaatagaaggcagtaactgcattataaaatgagcaacaataacaacatactttaatcaactagaactaagaggcaagaaaggagaaaatagaaggtaaaataaagcatgtcaaatagaaagcatcaagtcctgatataacagaatatataacactaaatataatcccaatacatacaaatgcattttttatttgcacatatttatgggggtaaatgagatgttgtgttacatgaatataatgtggtaatcaagtctggatattaaaggtgtccatcacttaagtacagtacatttttgttaagtatagtcatccgaagctactatcaaacaatgaatttattccttctatcttactataggtatcctttaacctacctctcttcatcctctcccttcacccccactcacctgtcccagtgtctctgatctattttacattaccgctatgtgttcatattttttagatcccacatatgagaacatgcaatatttgtcttcttatgcctggcttattttacttgtaatgacttccagtcccatctacgttgctgcaaatgacatgattcatttcttttctatggctaaataatattccgttgggtacgcacgtgtgtgtgtgtgtgtgtgtgtgtgttgaggggcactttggttgattctgtatctttgctattgtgaatagtgctacaataaatatgctagtgcaggtatccctttgatatattgatttcttttgctttggatagataaccaatagtgggattgcttgatcaaatggtagttctattttcagttttttgagaaatccacatacactgttttccatagtggttgtattagtttacattcccaccagccatatacaagactttccttttctccacatccttgctggcatttgttatttttgtcttttttaaaattatactttaagttttagggtacatgtgcacaacgtgcaggtttgttacatatgtatacatgtgccatgttggtgtgctgcacccattaactactcatttaacattaggtatatctcctaatgctatccctacccccttcccccaccccacaccaggccccggtgtgtgatgttccccttcctgtgtccatgtgttctcattgttcaattcccacctatgagtgagaacatgtggtgtttggtttttcgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgttttataatcctttgggtatatacccagtaatggggtggctgggtcaaatggtatttctagttctagatccctgaggaatcgccacgctgacttccacaatggttgaactagtttacagtcccaccaacagtgtaaaagtgttcctatttctccacatcctctccagcacctgttgtttcctgactttttaatcatcgccattctaactggtgtgagatggtatctcattgtggttttgatttggatttctctgatgaccggtggtgatgagcattttttcaggtgtctgttggctgcataaatgtcttcttttgagaagtgtctgttcattctttgcccactttttgttggggttgtttttttcttgtaaatttaagttctttgtagattctggatattagccctgtgtcagatgggtagattgaaaaaattttctcccattctgtaggttgcctgttcactctgatgatagtttcttttgctgtgcagaagctctttagtctaattaaatcccatttgtctatgttggcttttgttgccattgctttggtgttttagtcatgaagtcttttcccatgcctatgtcctgaatggtattgcctaggttttcttctagggttttgacggttttaggtctaacatttaagtctttaatccatcttgagttaatttttgtacaaggtgtaaggaagggatccagtgtcagctttctgcatgtgactagccagttttcccagcactgtttattaaatagggaatcctttcaccatttcttgtttttgtcaggtttgtcaaagatcagatggttgtagatgtgtggtgttatttctgaggcctctgttgtgttccattggtctgtgtatctgtgctggtactagtaccaggctgttttggttactgtagccttgaagtcaggtagcatgatgcctctagctttgttctttttgcttaggatcgtagtggctttgcgggctcttttttggttctatgtgaactttagttttttccagttctttgaagaaagtcattggtagcttgatggggatggcattgaatctataaattaccttgggcagtatggccatttttacaatattgattcttcctatccatgagcatggaatgttcttccgtctgtttgtctcctcttttattttgttgagcagtggtttgtagttctccttgaagaggtccttcacatcccttgtaaattggattcctaggtattttattttttttctagcaattatgaatggaagttcactaatgatttggctctctgtccgttattggtgtataggaatgtttgtgatttttgcacattgattttgtatcctgagactatgctgaagttgcctattaaggagattttgggctgacacaatggggttttcgaaatatacaatcatgtcacctgcaaaccgggacaatttgacttcctcttttcctaattagataccctttatttctttctcttctctgattgccctgaccagaacttccaatactatgctgaagaggagtggtgagggagggcatccttgtcttgtgccagttttcaaagggaatgcttctagtttttgcccattcagtatgatattggctgtgagtttgtcataaatagctcttattattttgagatacattctatcaatacctagtttattgagagtttttaacatgaagagctgttgaattttgttgaaggccttttctgcatctattgagataatcatgtggtttttgtccttggttctgtttatgcgatggattatatttatcagtttgcatatgttgaaccagccttgcatcccagggatgaagccaacttgattgtgttggataagctttttgatgtgctgctggatttggtttgccagtattttattgaggattttcatagcagtgtccatcagggatattggtctaaaattgtctttttttgttgtgtctctgccagactttggtatcaggatgatgctggcctcataaaatgagttagggaggattccctctttttctattgattggaatagtttcagaaggaatggtaccagatcgtctttgctgtttgtacctctgttagaattgcactgtgattccatctggtcctggactttttggttggtaggctattattgcctcaatttcagaactgattattggtctattcagagattcagcttcttcctggtttattcttgggagggtgtatgtgtccaggaatttatccatttcttctagattttctagtttatttgcatagaggtgtttatagtattctctgatggtagtttgtatttctgtggaatcggtggtgatattccctttatcatttttatttgatttttctctcttttttattagtcttgctagcagtatatctgttttgttgatcttttcaaaaaaccagctcctggattcatcgatttttttttttttttaggggatttttatgtctctatctccttcagttctgctctcatcttagttatttcttgccttctgctagcttttgaatttgtttgctgttgcttctctagttcttttaattgtgatgttagggggttgagtttagatctttcctgctttctcttgtgggcatttactgctataaatttccctctacacactgctttaaatgtgtcccagagattctggtacgttgtgtctttgttctcattggtttcaaagaacatctttatttctgccttcatttcgttatttacccagtagtcattcaggagcaggttgttcagtttccatgtagttatgcggttttgagtgagtttcttaccctgagttctaatttgattgcactgtggtctgagagacagtttgttgtgatttctgttcttttacatttgctgaggagtgttttacttcaaattatgtggtcagttttagagtaagtgcgatgtggtgctgagaagaatgtatattgtgttgatttggggtagagagtcttaatagacttggtccacttggttcagtgctgagttcaagtcctggatatccttgttaaccttctttcttgtagatgtatctaatattgacagtggggtgttaaagtctcccattattattgtgtgggagtctaagtctctttgtaggtctctaaggacttgcttcatgagtctgggtgctcctgtattgggtgcatatgtgtttaggatagttagctcttcttgttgaattgatccctataccattatgtaatggccttttttgtctcttttgatctttgttggtttaaagtctgtttcatcagactgggattgcaacccctgcttttgtttttgctttccatttgcttggtagatattcctccatccctttattttgagcctgtgtgtgtctctgcagttgagatcagtatcttgaatacagcatacttatgggtcttgactctatccaatttagcagtctgtgtcttttaattagggcatttagcccatttacatttaaggttaatattgttatgtgtgaatttgatcctgtcattatgatgttagttggttattttgcccgttaattgatgcagtttcttcatagcatggatggtctttacaattttgcatgttttttgcagtggctggtaccagttgttcctttccatgtttagtgcttctttcaggagctcttgtaaggcaggactggtggtgacaaaatctctcagcatttgcttgtttgtgaaggattttatttctccttcacttatgaagcttagtttggctggatgggaaattctgggttgaaaattcttttctttaagaatgttgaatattggcccccactctcttctggcttttagagcttctgccaagggatctgctgttagtctgatgggcttccatttgtgggtaaccttacctttctctctggctgcccttaacattttttccttcatttcaaccttggtgaatctggcgatttatgtgtcttggggttgctcttcttgaggaatatctttgtggtggtctctgtatttcctaaatttgaatgctggcctgccttgctaggttggggaagttctcctggataatgtcctgaagagtgttttctaacttggttccattgtccccgtcactttcaggtacaccaatcaaacatagagttggtcttttcacatagtcccatatttcttggaggctttgtttctttcttttcactcttttttctctaatcttattttctcgctttatttcattaatttgatcttcaatcactgatagcctttcttctacttgattgaatcagctattgaagcttgtatgtgcattacgaagttctggtgccatggttttcagctccatcaggtcatttaaggtcttctctacactgtttattctagttagccattcatctaacctttttcaaggtttttagatttcttgtgatgggttagaacatgctcctttagctcagagaagtttgttattaccgaccttctgaagcctacttctgtcaactcatcaaactcattcacagtgcagttttgttccattgctggtgaggagctgtgatcctttggagaagaagaggtgctctggtttttagaattttcaccttttctgctcaggtttctcttctccccatctttgtggttttatctacctttggtctttgatattggtgacctacaaatggggttttggtgtggatgtcgtttttgttgatgttgatgctattcctttctgtttgttagttttccttctaacagtcaggcccctcagctgcaggtctgttggagtttgctgtaggtccactgtttgcctgggtatcaccagcagagactgcagaagagcaaataatgcagaacagcaaatattgctgcctaatccttcctctggaagcttcatctcagaggggcacctgcctgtatgaggtgtctttaggcccctactgggagggtctcccagtcagcctacagtgggtgtcagggacccacttgaggaggcagtttgtccattctcatagctcaaacaccgtgctgggaaaaccactgctgtcttcagagctgtccctgtcttcagggacgtttaagtctgcagaagttgtctgctgccttttgttcagctatgccctgcccacagaggtggagtctagagaggcagtagggcttgctgagctgtagtgggctccacccagttcaatcttctggccactttgtttacctgctactcaagcctcagcaatggcagacacccctcctccgaccaggctgcagccttggaggtcaatctcagactgctgcactagcagtgagcaaggctccgtgggcatgggacccgccgaacctggcatgggagggaatacgttggtctgctgcttgctaagactgtgggaatagcacagtatttgggcaagagtgtactgttcctccacgtacaatctgtcatggcttcccttggctaggaaagggaaatcccctgaccccttgtgcttcctgggtgaggtgatgtcccaccctgcgttggctcaccctctgtgggctgcacccactgtcgaaccagtcccagtgaaatgaaccgggtaccttagttggaaatgcagaaatcacctgtcttctgtgttcaccttgctgggagctgcagaccagagctcttactatttggccatcttggaagcataccgataggagtgggatgttgattttatcaaatgctttttctgcatctattgagatgattatatggttttggtccttcattctgtagattttcagtgtatcatgtttgctgatttgtgtatgttgaaccatccttgcattcctggtaaaaatcctactttatcatagtgtgttatcttttcaatgtgctgttgatttaggtttgttagtattttgttgaagatttttgtgtctatttcatcagggatattggcttgtagttttcttattttgttgttgtatccttgtctgattttggtattagggtgatgctagccttatagaatgatttagagagaattcccttgatatggtttggatgtatgtcccctccaaatctcatgtggcaatgtgatccccaatgttggaggtggagcctggtgggaggtgtttgtttcatgggactggatctgtcagtagtggcttggtgcactctctgaggtaatgagtgagttcttgctctgtgagttcacatgagagctagttgtttaaagaagtctggcatttcctcttttctctcttgctctctctgtcaccatgtaacacacctgcttccccttcacattctgccgtgattgtaagcttcctgtggcctcactaagagcagatgctggcaccctacttctcatatggcctgcagaatcataagccaagataaattctttttaaattatctatcctcaggtattcctttacggcaatacaaaacagactaacacattcctcctgtttgatttttttgaatagtttcaggaggattgatgttagttattctttgtatgtttggtagaatttggctggattcttgtcttgggcttttctttattgagaaccttgttattactgattcaatattgctgcttgttattgagctgttcaggttttctgtttcttcctgattcaatcttggtagcttatatgtttccaggaatgtatccatctcccctaggtttttcagtttgtcaatgtgtagttcttcagagattactgtggtatccattgtaatgtctctgttttcaattttcaattctgattttgtttgattcttctcctttttaggttagtctaggtagcagtttatcgattttgtttatctcttcaaagaaccagctttttgttttgttgatcctgttgtattctttttagtctctgtttcatttagttacatctgatctttattatttattttcttctgctaatttggggtttggtttcttcgcgtttttctagtttctcaaggtacattgataaagattattaatttataatctttctactttttttagatgtaggcattaattgctataaaatttcctcttagcactgcttttgttattcccaagagttttggtatgttgtttctcttttcatttgtttcaagaagtttttaaatttctatttttatttgttgacacagtggtcattcaggagcatgttgtttaatttccatgtatttgtatcgtttccagagttgttcttggcattgatttctagttttattcctttgttgtctgaggagatacttgatatgattttttaaaaattgctgagatttattttgtggtccaacatatggtctgttctggagaatattgcatgtgctgatgaaaaggatgtatagtctgcagtagttggatagaatgttaggtctatttggtgtaaagtctagtttaaatccagtgctttttggttgattttctgcctagatgatctgtctagtgctgacagtgagggtgttgaagtcccccactattgtattgtagtctgtctatttagatctagtaatatttgctctatgaatctgggtgctccagtgtttgatacatatatatttagattttatattctcttgttgaattgattccctcatattatataatgaacttcttggcttaaaatctgtttttatctgatataaatacagctactcctgctcacatttggtttccatgtgagtggaatatcttttttcactttttttcatctcttaactttcagtctacatttgtctttactggtaaagtgagtttcttctaggcagtataaaattggatcattttttaaaaatccattcagccattatatctcttttctggttgttttatatattctttgcctctttttttttcttattgtttacactgtagtttggattcctgtagtggtaccatttgagtcttttctcttcctcctttgtgtgattactttacaaatgagttttatacttccatatttcagagttaatattttgagcattttttttgagatggaattttgcttttgttgcccaggctggagtgcaatggtgcaatctcagctcactgcaacctccacctcccaggttcaagcgattctcctgcctcagccttcccagtagctgagattacaggcatgtgccaccacgcctggctaattttgtattttcagtggagaggaggtttctccatgatttggtcaggctggtcttgagctcccaacctcaggtgctccacccacctcggcctcccaaaatgctgggattacaagcatgcaccaccctgcccagccctattttgagcatttcttgtagggtcagtcctagtggtaatgaattccttcagtctttgcttatctgggaatcagtctatttcgccctcatttgtgaaggataattttgctagagataatattctgggttggcagttccttttttttttttcccagcactttgaatataccatctcattctcttctggcctgtaaggtttctgctgagaaatctgctgttagtttgatggggtttcctttataggtgactagatgcttttctgttgctgttgttaggattttctctttatcattgacttcagacagtctgataacaatatgctatgtagaaaaccttttcatattgtatctgcctgagaatcattaagcatcctgtatctgcatgtgttaaatattgctaggcttggcaagttttcatctttgtttcttgtttcttgattatactaataatttgtaaatttggtcactttaaaattgtcccaagtgtcacaaaggctttgcttatattctttaaattctctgttctttgttttgttttactggattatttcaaaagacctgtcttgaagattagaaattattttgcctggttctaagattttaaatgcatttttttcccttcaatgaattattctgttccagatttctatttgtttctttaaaaaaaaatttatctctttggtaagtttctcatttatttcctgaattatttttctgattttttatgttcagaattcacttgtatctcactaagattcttgaaagtcaatattttgaattctttatctgggattttgaaattttctgattaagatctgttgatggagtatggtgttcctttggaggtgtcatatttcttcgctttttcatgttgtccttatgttgatatctgcacatctggtataacagttggttcttcctatttttgaatttactttcataggggaggaatttttcctgaaggtgtatatatggtgttggttggatggggcattttggctttgattctgggtggatgcagtggtgtagtctctatatgatttctttggcagtaaacaacatcagtgatatctgtgatttccttggtaagttatagtgtggttattagcagaggctgtggtgaagttgtgctgaggactgggatgccaggtaggccagtctttaggccctagtggttgcagtggtgggttgagtgtgcctgtctttgtgcctcagtgtggaataccctggcacctgtgttggagcaggctgattcttggccttgaggtggctttccccccggaggtagtggcagcagtggaccaggtggttggatgtgttctcaggtccctaggcagcttgtatggcatggcaatggcagtagcagtagtaggatgatcctctgcatcctgagtagtgtgcatggatattgggagtggctgtgatgtgctggacaggcaagtctccaggcccgaggttgcacttgcaggtagatttcagcttatgtggtagtggctgggaagttaggcccaacctcagtaccctgtacggaatgttcaggtacccaaggtggtagattgggttgggcaatctccaggacctcaatctatgtgctctgtctcgggaatggggaacaaagtgaggccagatgggcttttgttcagcccccacagtggtgagaggaggcactagctgtgatgggcaggggcagggcaattcttaggccctaggcagagtgcttgagtgaggggcagtagcagctgcattgaggccctgccactggagaggatttggccatcatcagtggccacagcctggaccggcaggtggggaattgtgcctctttcatgccccagttttagtgaggcttgatcccctaccctggtggcggtagcctgcacctaactcatccgcctgcaccagctgcagcaacccctgcccagctcaccaccaattccagcagcaacttgtgtctccatcttagatctcagcaacacatgtctaccagcactgggtgcttcagctcatgtctcactggcttcttagccttggctacaggagcactcccagcttgccctgctgtcccagcagtaatagcctgagtttccttaatgcctcagtcctggaactgctgggccccaggacagcacgacgtttgtcaaaggctaggtttggaaatgatgccttgctgtagctgcttaggtctcagaaaggatgtggggcccagtgttaagttctctcctaggagcagttccatttcatggtctcttggcagctccctgtgttagtttcggggcttgggaggattgagggcttttcaagtggccagaattgcacaattccacggtggggatgttggctgctggaagtctcccactcacccatttcccactttgggaaatcactcctggctcccagctgatcccagtcagggaggatgcaagaggcaacctcttttcttacttttggtgcttcctgtcccttctttgttgaattccggtgttctcttggataatatatttgaagtgtgactgtctatatactgttctggtttttctaagtggaggagtcagtcatataaactgcttctagtgaaccctccccaactcaaaaagttaatagaaatatattaaacttgctagttaaaatgcagattttcatattaaataaaatctaaccatatgtcacttacagagacacatcaaaataataaagatatagttgagagcagaaagacaggaaaagataaatgagacaaatactggagaaaggcttgggtagctatgctactattaaacaaaataggctctaaaattggaagctttattagtaataaagagcatcacttcatattgataaatggtttaccagagagatctaatggttatgaacttatattcactaataaaataccccgaaaattataaaggtagaaatttagagttaaggaatatgttgataaatccaccaccatgggaaatttcagcatggctttctcagtgatcatagtacaaacataaaacgttaatgacaatcaagatgatcctaatgcattttacaaaattgatacaataaacacagaaacctgcatcaaataaatactacatttgatcaagaaaatgaaagaaaatatctaagaataaataaattaaaaatacaggttagtggttacctctagtggcagggtgggtcaagctggaggacgggattaggaagaaacacacaggtagcttcagtaatactaataatgttccagtgcttgaatgatgtgttcatggtatattttaatatggtagatcttagcttgcatttatattacatatgtttttaccacatctattaaatataagaaaattttgttcctcacatattctcctcgttcttcagtgtgtttcagatttgttcttggtgtgggaggtactgtatttctgaccatatcaggaaagatgttagaaagtgattcatgtcaataccatttgacctagcaatcccattactgggtatacacccaaaggaatataaatcatattataaagatacatgcacacgtatgttcattgcagcactattcacaatagcaaaggtgtggaatcaacccaaatacccatcaatggataaagaaaatgtggtacatatacaccgtggaatactatgcagccatacaaaggaatgagatcatatcctttacaggtacttggatggagctggaagccattatcctcagcaaactaacacaggaacagaaaaccaaacaccacatgttctcacttataagtgggagttgcacaatgagaacacttggattcaaggaagggaataacacatgctggggcctgttggagggggtgggcggagggagagcatcaggataaaaaagctaatgcatggggggcttaaacctaggtgatgtgatgataggtgcagcaaaccaccgtggcacatgtttacatgcataacaaacctgcatgtcctgcacatgtatcccagaacttaaataacatttaaaaaataataataaaaaagaaagtgattcatttcctctctcagcagacattccattttggttaatgttagctaagtgcctatcattctgtctttttaaaaccaacaacaacctataatatgtcagtggacagttagtccttcacaaccacaatggaaagaaagggatatgaactaatccctccaacctctgagaaacctagattagataggtgccttcttttatggaccatctgttctttttaccttcggttacagcatcacagaattacatgattttagtaagtcagcatttctatattttccaaatgaagaaactgagcaacagtccagtaacttagggtcagatacactttctactttcaaagacctctgtagtaaagcccacatttttcctcatactaattctgaaattcagtaaactacaaagcaaaatattctggtttcttatactgagattaacatggctttaacttaaaatgatttggcatcattgggccatgtttcaagacagagcttgagtggcttattttattttccacaaagtcacatttaaagaaactcttgtgaagatgttgaatcctcgtttcttcgtttaacaaatttgtttggggcatttaaaatatgaaaggtaggcactgaaagatgacactgacttttaaacttttttttttgctttccattttgaaataatttcagatttacaaaaataaagttcaaaaatagtgcaaaaatttctgtgtacacttcatgcagattccccaaatgatcttacaattataaaagttataaaaatcaggaaattaacattgacaaaatattatcatctaacctaaaaatcttattcaaatttcaccaattgtcccaataatatgtattttttttcctggcccatcagagaatccatggttacatgatgcatttaatttttatgtcttattagtgacctttaatttggaacagttgttttcattttactagcctctcatgaccttggcactttaagtaagtataggacaattattttgtggaatatgctttagtttggatttgcctgttgtatcctcatgtttgaatttaggttatgccttttgggtaagattaccacagaactgatcttgtctttctcagcatatcatatcagctgcacatgatatcaatttgtcccattgctggtgacatcagctttaatcatttgattaaggtggtgtctgccaagtttctccaacataaagttactattttttcttttgtaattaagtatcttgaggggagatattttgaaactacatgaatatacatcatacatttttcattgcatatttgcccaccaattttactatctagtgatgatttttacctgaagcagttattactatggtattttacaaataataatcatctaatcccatcatctcttcacatctagtagttggaattctactgtgaagaagagcgcctccttatcccacatttatttatttattcatttaaaaatgtatatcattatgaacttttggatgtctttttcattctatgggtcataatctattaccagcattatttattttttgtttaaattattccagtattgtccattggtagcctcttcatggtgacttctgtatctttttattatcttcctatccatttttaagtatttacttgatttcaggcaccacaatgttccaggctcatcttgtactttccctgatacagttctgaaataaaccatttctccaaggagccctggtcagggaataatgctatggacaggattcaaaactttcgacattgcctagagagctgcaaacattcaagtactgaccatgaagatatttgttattccatgtaccaacaaagttgtccatataattttttaagtgtcattttataagactaggtctacaaaaataataatgtagtaaaattaaaattttaattttggcacaccaggaaaaatagccatcacatttaccatctggtttcaatgtattcattttatttttatttttatttttatgaataatttacagaagtaagaataaagagatggtaaaaaaaacagcaaaataagaatttaaacatagcaaaccacgtttttatttcatattttcctgattttggaggtaatgtaacctgaaattggcaatgcctttgaatgcaaataactggtcatgagctgtcgtatatgaacctagaacattatcatctcgtaaatactggctccagattttaaacagatctctagtaggttatagctcatcattatctctggttcttcctgcatatgcattattatcacagtgtaatgctatggagaaatttgagggttcatgattttgtagaaaagaaggtggccatgtttttgtttcacaattacaaaaatattttcatttttacttttataaatgtcaatcagattgagcaacccaatgaacttttaaaatttctacataatgtctgtctgttccagtcacctttacatatatacctaccttcagcatttgtccatttatgaatatcaagtaaattttatcaacaaatactataaaagataaaataattgtcatatgtccttttatcagagcaggatggtccaggttcttgtgcaaaatactaaatgatgaagtccttcctattaaataattaatgggttagaatatcatgtttcctttttgtctttgtaaatatattgtttactctgattctcaagtctgacagaatttatctgaaggactcatagcccaagattttgcttctatggtcagttttacctcatcattagaatctcaagtgctctgtctctgccttcattttctcattcatctaattattgtgaaatatctttctcttaattttattctttatcccattatgggcagaaaattaagaattccaaattcttaactttgtttaatggaagctgaaaagaatatggcaaagatggcatctctagacttcttttataactttttgaaagatgtattacacaacacaattagaaaacggaaggatgatacagtggtgacattcatttctaggcaatttcgtaatttttttttccttattttagttttttagcacaattagaaataattgatgagtgatgatgaagtaatttctagcatgatgaagtagcaaaatactttaaaatacaggaaatataagatcactaaaatatcataatgtatcttagatcctataatgcatcttagatttataaaatgatcaatagactaagtgatgaagaaaatgagtttaacttactaaaaataagtattttttccttttgatttttggaaaacctgtaagaaacaaaagtcatgaaatatcagtctttacaaataattaaaactgctgcacagagaaacctaaaaactgaacttggggccgggtgcagtggctcacgcctgtaatcccagcactttgggaggcaggcagatcacctgaggtcaggggttcatgaccagcctggccaacaaggtgaaaccccgtctctactaaaaatacaaaaattagctgggcatggtggtgggtgcctgtaatccctgctactcgggaggctgaggcagcagaatcacttgaaccccgggcggcagaggttgcattgagctgagattgagtgccactgcactctagcctgggtgacagatcaaggctctgtcttaaaaaaaaaaaaaaaaaaaaattaggatcagtgggccttggtgatactgcaaaggttaaaaagtttgattcagtcacatggtgaataaaaggatagggacatgggtaagaccactttttccctaaacctgataatacccaagaagtggatccttaatgaaactaactttttaattttctccttttgttacctggactttatactgtgttcaaaggagcatgaaaatgtaatgagctatcagctgtgagcaaatttattaaatagagtgaatgaaaagagaaccagaccaataatttaagaattctaactagctcaggcttggacattaactagttctgtttctttgggctgactaatcctggaaattatgtgtattggaaagaacacattgttgagtcagccacaacaagaacctgcttctttggactcaagctccctgcctctcaattttctcatgtgtaatagagagaaaaccctgcttcacggggttattgtaagtactaaataaactactagagactgtcagactctggagggctggaactctcttaaccatctttatttttcctgtgactagaagttatctgagtatttattgggtaaattttgttacatgtgtttatgaactgtgtattataaactgtaaaatgtacaattacaaggtcattttgtttgtatcaatacagctgtgttaagtgctctacaaatttaaggtattttcctttatcttaaaaatcctttgggaaaagaaagttatagtttaatcagtgcctccttctacatgggctcatagtttttatcaaatcaaggaaaacatgtaaaaggaaagctttgggacattttctagaatttgatatttaccaagtgtagatttatatttattaagcctcatctctgattattttttaaatggcaggcactaaataattatcattgtttttgtcctaaattagatgactgactggttcataagttcagaaatttcactgtggtgctgtaaattttatagagtaaaacatcttcgtatgtcctctaagattacatggtctaaaaatattagtttaggtttctcactcaataagaatttaaaatttttctggccttttcttttcccttgtcctttaactcatttattacaaatcttgtgagaaattgacttgaataatttcccaaatcttcagtctctttgccattttaatctcaatttcatacatagggagaccaagccttttaagaaatcctggggtgatcatttgaaaattacaccccacttgctaactccccatccccatcttttttggctctgcaagatagcctattcagcaaagggaaataaatctaacttggatttacacatataacttgttgaactaactagttagtttggttagagtcattgttcaggacctgagtataaattaggtgaatgcttattgcagcaccattcaagtttccttgagaagtcacttaggcctgtggcagagaaagtaggatctaaggcttgatgactgtaagtttgatctgctatttaaccctcatggatactagccagagcttgggctatcgataactcttgccttagcatcagtgtatgattgtatgtatgtgagacactctatccttatttgtatctttagttagttgacaggttcatgaaaggtaagaactgtagttagcctttggatgatgttaaagcaaaaatatagaggaaattcctaaattggcgttgagtctagaagggtctcttaaaacacttcaaattgtatacttttattatacaacaagtgttattaccatagtagttccgtaacacttggccgttgactggctgcttatcacctgtgtcacagatcccattctgttatctactcccttagatctttataaacaacgagtggcagaactcagagagtgggagagtgttccctgtctataatccagccacaggagaacaggtgtgtgaagttcaagaagcagacaaggtatgtcttttgtagataaaagatttcctatgaaataactgccttcaaacagcagagcagcaaacatatgctctcagtacaccactacatgctcatgcttcacttttttcatgacagtggatggttcttcctttatttggagtgtttttcttcagttgtgcctcttcctctctaacaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcagtaagtaacctaagaaaacattaagtctttaacccacatttgccattctgctgaaatttacattcttcggctgtattttattttatttttatttattttattttttgagacggagtctagctctgtcgcccaggctggagcgcagtggcacgatttcagctcactgcaacctctgcctcccaggtacaagcgattctcctgcctcagcctcctgagtagctgggattacgtgcacgtgccaccacacctggctaatttttgtatttttagtagagacggggtttcactatgttggtcaggctggtcttgagctcctaaaaggatactttgaagcagacctggggaaaaagcaaaggaataggtaatacatatgaaaaatgagacatgtttggatttggggatcagatggagaaggagaaatggaggatcagctgaatatcttttctcactgaattttgaagagaaaactggagcttgccatgactggtaagtaccttcttttctaaaactccccctccccatgacaaattaaaaacagtcaagcaacaagagagtcaccatgctgcttgcagaaaacgagtatcaaatgattcttatgagaatgaaatagaacaagtttttacctccccagagttaacctctcttgagtaaaaggaatccttcagaaccagaggggatggtacggacctctcatacacttctgctccgtttgccctgtcattctgtgagccagtagaaaggagagacagcaggagatagcaacttcctttcactaaaacaatgattttcctcacataacgaacttctcctgccctaatgggttttgttgttgttgctgtttttaaaataaaagtcaatttcttagagaatataaactttttggaaactgaaagcatttaggaatgtatgcactatacatttgggatctccacctggtatcaatgaatatttagggtttccttgttcagtcagggcattcaagccatgagtactatatcctttcccctacttgggaaaataggtcactattgggcttgcttctggggaaggaatcattttttccctttctcagtgtccctcctaccatagttcttcccttctaccatccccctcaggaatctgttcatagtatgggaacaaaatgattcctttatggaaatggtttgggattctagctatatataacatttatgtgtatataaaaatattttctaatctggcactctagggaatactcttccaatgaggtgtttattcatactgtgaaaaaggtgtttcatggtgaagaaattcctccttgcagattcacaagacactgggcatattaaaggctcaggaaaagcctactaaatgcttctcaagcttatttgagtctcatcaccatttttctggctaacataccaatatcatgcaaaaccaagttttttgggacacattacttgtcttttcactggattatcattttcttgagaattaaacttgtattttacctttttttggtaatcctagcatggttcttagcacataaatggcaaatgagggcacataggttgtcaataaatgactgtttaattgagctaaagatatatgatatctatagcattggattaacactgtgctagaagatgattaattaatttctccagttatattttcatataataaaactcaaatgcctttctttttcttctctgtgtctcactgatcaggtctcttttcctaccacacctaaatgagattcctgttttaaacactctcaagctatgagaaaagtgagttttagtaagaggtagcctgtggaagaaaggggagctcctgactggaaaactgaagctaatcctgcatccaaagtaaacacaattgaaaatagtcctagagctggcaattgtcagtggatttgactggtgtcggcagctcacagggaccatttaggcagcccaaattctggttattgacactattcactctaagctgtgcagattttggtgctatgctagctgtatagagaatgtaatgcctatcttgtaaacatatacatgttctaaaaagtactaggaaatagtttgattcccttttttaagggtgagccaatatacagtgataagtaacatgatatttttaaataagcttcattttatacacatactaagtagataaattacactggaagtcatagtattttcatctcattgattggagaatattttaattttagctttgtcagagatcaaataattttcacaccagtatgtcttataaaatacacttgtaggaaaaaaagaaaattacaaacatgtttgttaatttcatttgtcgaacttgtaacacctttaatatttctcaagtcaaaatactcttctcatttcagcgtgttcattgtttttgttacggacttagccagttcaggaacatgtcgttaaaataacaatgtttataatgtaaagcagttcaatattgctatttttattaaatggagcagatatttcactcttaataggtaatggttgttaatgtaaatgtttacaaaaaaccagcctttaagttgttaacatctgggcttccctagaggagatcttgtttatttggtggtaataaataaacttgctgtgcaccatggatattccatttctcagcaggggtcttggcagctgtggagaacactttctattctcatcagttgcataaagagcccatgtttctgctcctctttatggattcagattactggtgtagatgccaaaaaatccccagtgagctctgatcattaatataacggaagctgttttgacaagcagaacatttctttatcattagttaaagaaatattgtgttaacgtatttggatagtggttactggaagcacaggaatatgcacatatatactcattgtggtttttactaggaactagaccaaactggcagtactagaaatctttttatttgagaattcatagttgaccaggtatgcaactccatatgcatttgtattctctctcttccttttttcttctgctctagaaattagtgtatcgctggaaagttctggggacttagtatctctccatttctcttccaacagaccatggaatccctaaatggtggcaaaccattcctgcaagctttttatgtggatttgcagggcgtcatcaaaacctttcgatattacgcaggctgggctgataaaattcatgggatgaccattcctgtaggtatgtgaaatctgagtacgttgaaaaggaaaacgtgaaaccaccagaaatgcgctttggccaccaaacacaaacagcagtcacacagaatacagatatgagcacacttacagcagttagaactgagtgaagaaccaaccaaattatgtcactgactctgacaacatccctttttctatagatagaaatatataagtacaggggcatgccacttaatacatcattcatctaaggaagaggtatgtatttgtcagctggtaagtggtcagcattgtgctagattaggtgctggggtaggtatgaaggggcattattgggtggagggaagtcatggaaaattccaacgaggttaagacttgctccttgccctcctgaaacatataagatctactctttggaaggaaatattctaagtgttaacagttgtctctgagtggtgagattatggctgattttcagtgtctttttaatatttttctctactttctatatttctcgaacggccgtgaattactttcataatctatacaaacaacactaatcctaacccctttttattattaagattcaggttacatgacagaatcaacaatacaaaaaacttaaaggcccctataggagtgttataattgggtgctaagttgtgtactttacctgtcagtgctgtagccctttaaatgagagggaaagtatggaagactaaagcaactaaagcagtcagtgaagagatttttatctgtgcttgaatactagtgatagctaataccaattgagtgctttcacagcaaccccaagagaaaggcactgttacaaacatcttcagtttacaaaagtggaaagaggtctggcgaagtaaaattagttttcctaattcacagagtaaataagttttagagctaaaactttgacgttagaacctaggcttgtaaccacttcattagagaattcaaaatagatcctaggaggaagagatatccttataggaaagggatggactgaaagagatagtaagtggtgaatagacataaggaaaggaaatgcacatttattgagtggatactagatgccacttagcactgtgccaggtgttctacctgtgttctccagaaggcagtctgctttccatggagagtgcatagtagcaggattggaaagtaatgctcaggacttcgaagtgtctcttttgggccttcttagccaggctgagcagtactgatttactaaaaaagggagtggtttggctgatagtgtggatggctgggaatagttcttctccaatttaatgtgctcatgaatcactgagggtctttttcaagtgcagtttttgactgaataagtctggggtggggcctgagactctgcatgtctaaccagcttctggtcctctgcattgagtagcaaggagaggatgcagcagaaccaagttaggtggctgttgtgatgcctcatgtaggtgtggtatgacaagggtaagaataatttacagtgagaatggagatgatttagagacaagacttccaaggattattttttaaattgcccctacaaatgatgatgacatgtggaatgttagtttttagaaaatgggtttctgattgtaggggctcttcccttccatctagaggtttttcccttgttcaactgactgagaagggtggagaagattgcccttggggaaagtcagaatcttagttcagttctgactctaaggatattacagaacagctgttttccagcatcacttgcaagatgtggggatggcctaagtgaggtagaaagtcactattcgttatgagcatacctattagagggcctgagaattaaaacctttgtcaacagtgggacacatgtcagtctttttaggtgggcctgtcctgtatcagtacagaaaggtaaatttacaagatcaaagtccctagttgttggtttttttggtccccactccacctgtcatttcattattaaaacaacaaatatgtttcaggtgtttaaatatcttttcaaactatttacaaagctctgaggaagattgtgaaacagaaggcaatgcacatagatctctatttggcctaacggtaccttggttttcttttacttcctcaggagggaagatcctgattagataaagctaaatattgattgacatccctgataatgtttgaagctttaatgtaacttgatctggcaatagaggtggttggcccataagcctcactgttttcatctgatgcgttttggagatcctgtggatgcttatctacgagttataaatacagggcatagaaaaggctctcatagggctctcacagtagtctttccccactttactcattaactgttgttcagtcaatgaaggaaaaaaaacgatgaattctcttaaactctaagtaactgtttttccccaaaaagtttttctgaaagtgcatttagagtcatactaggatgaggtaccctccctgccatcaggcctgttgacagaattctcaggaggctgaagtttgggtcataagagctctctccatggtgtctcaaacagatgagggaaggatggaggtagaggttaacttggcagctgtcctctcttttccagttttagatacatttgggcttgcctagaggccacttagaattcagccaacaatgtctttagctagtctagtgcttagtgaatgtagctggactaaatcaggggagtcataggggaagatcacagaaaggggtatcgtaatcataattattcacttgttctcaaatttgttcagtaaattaatccatttgtatttgtcttttgtaactccataatttaacatcagcttcattttgtctctgcatacttggcttttttttttttcacagtgaagtctggaatatagaaagtccgttagtctttaaccatgagatctttattgtgctaaatgcattttcctacaaaacaacctaattttatgttgggaattataaagaaataatgtactttatatttgcatagaatttaaaagtataaaatattcttttatgtacaatatctatgtgattctgtgtgtgatctgatgagatagtctggattttaaatggtattttacccattttacatctaagaaaataagactgcaagggtttagtgtcttgtagaaggtcacatggctagtaagtgggagacgtgagattcaaacttaagtgttgttctgcctaagccatgataaattctcttcttatggagattggttcagcaaggcaggaaggtggccctgatgaagtctttaccccagtgcagatttttatactaatatgatgaagtctttaccccagtgcagatttttatactaatatatggtttattctcatcattcatagtagttatgttttataaagttgtcacgaacactgaattagcaaatatggaactattgctcctaggggaaataaaagattaggttcctgtgagcttctgatcacaacattcttgtctgctgatcagagaatggccttgatttatgtgtttctgttgaaagattctttgtttaatatatattgttgatttatgaacactgaactcatggccaaccagacagaagtactataactgatgcctgaatgaagcttgtgtgacacatgtattttctctgtaaggcacattacagcattcttgcacttaggaacactagacagcactcaacactatgcttaggggccattttaaacagcaaaattgtgaacaaaaggcacaaaaatatgaaaaatgtggcactaaacagaccacaaaaaaggacactttttttttttttttttaacaatatgagagctgaagcaagaaggcagagtgtcaccttgctcaaccccagctgagaatttgtgcatcaggtgactcaaaattttccctgctttggggaaatgcaaattaaaaccacagctgaaccacctcactactgcaaaaaaaaaaaaagtccataatttaaaaataaaaaaaatagatgttggcgtggatgtggtgagagggaacacttttacacactgctggttgggaatgtaaactagtacaatcactacagaaaacagtatggagattccttaaagaactaaaagtggcactaccatttggtccagcaatcccactaatgggtgtacctacccagggaaaataattcattatatgaaaaagacacatgcacatgcatgtctatagcagtacaatttgaaactgcaaaaatatggtaccaacctaactgcacgtcagccaacgagtggataaagaaggtgtggtaaatatgcaccatggaatactactctgacataaaacagaatgaaataatggtctttgcaacatcttgaatggagctggaggccattattctaagtgaagtaactcaggaatggaaaaccaaatatcttatattctcacttctaagtaagtgctaagctatgaggatgcaaaggcgtaagactgttataatggactttggggaaggatgggagtggggtgagtgataaaagactacatattgggtacagtgtacactacccaggtgacagatgcaccaaaatcttggaaaccactgctaaagaacttattcatgtaaccaaacaccacctgtactcccaaaactattgaaataaaaaaaaaaaaatccctgctttggatatacatgcccgtaaatgactctgagaacactctgtacttatttttgggttacaaataaattttaggtagtaggcaagtccttaaatatggaatccacaaataatgaaaatcgactgtatctagagcctacttttctcaagatagcatttatgaagcttaaatgttctggaacacttgaggtggggatctccctgcctagatcctaatcatatgggtaaagggggctttcatagtgagtgtcagagatagtaacacagttctgtttggtcacccataaaaaaagaacctgaaatagggttttttgttgttaaatttttagatgtaagactgctttacaacattgaattatactccatggttcatccagcataacatctctaacactaaacaaccaaaaagaatgggaagaaataagccattatgtctttcactcattcccatttgggaaggctagggaaaggtatcatgtaattggaagggattttcttttacctcctttctgtggcatcaactttgatctcttattccttcacccatttcttcatacattcatttattcagcagattttttttagcatctgctatgtttcagctcctgtattaggcattgggttacaaaggcaaataactaagatgtttataggacagtaagaaaaacaagtagcgaagcaactgcaatatagtgtgatctatttagatatggaagcatgaaatttggtgggacaccataggagagacatctcctagtattaaggcttcctggagagggtggtgggatgtctaagtgataacctgaaggacaagttaagtgaacatggagtcagggacattacaggcagtgggagtagctggcacaaagtatgagggaggagagtaccatgagttagtggatctaaaagtataagcagatatgaaagacagtagagccccaagtctgggtcagccatgctgcaagttttattctgtaggcaatagtgagtcaccaaattaaataggtgagtgccttgatcaaaattacattttaggaattgcatcaaatctgtatattgctttggaaagtatggtcattttaacaatattgagtcttctaatccatgaacatggggtgtttttccatttgtgtcatcggtgatttttttcattagtattttgtacttctgcttgtagagatctttcacctccttaattaaatattgttaggtattttggaggggctattgtaaataaaatgaacctaagtgctgttcaatggatgactggataaaatatatatatatatgtatatatatacacacacacacacacgcacacacacaaatcatgggatactacacagccataaaaattatgaaatcatttcttttgcagcaacatggatggggttggaggccattatactgaaataagtgaaataacccagaaacagaaactaataccacatgctttcacttataagtgagagctaagcggtaggtaaacatggacatacggagagacctaatacacattgggagccttcaaaaggagggagagtgagagggggctgaggattgaaaactacctgttgggtaccacgttgactattctggtgatgggcgcactagaagcccaaggctcatagttatgcaatatatccatgtaacaaatctgcacataaacccgttgaatctatttgaaaaattgcattttagaaagagcactttgactacaaatggataatcagttagagacagcaagtacttgttttatttctccccataaaggatagatttcactttgactacagatggataatcagttagagagagcaaatacctgcttaatttctccccgtaaagggtagccttcaactagaatacttgggaaggagacaaaagggttatctcatgaccacttttgagcaatgaaaaagtgggtggctgcttctctctctgaattggaaatttctcccaccactcttcattctgtttcgctcaaggcccacagctggatgttattgcacaattatgcaatactagtttgattcacaagagtcttgatgttgtttcctttacaacactatccattatttcctgccatggtacccaatggagccattgtctctgaccataaatcctaagctttgacccttttacgatggcagtgcctaattatgatgataaataataatcattactatgacctatggaacacttttttacctgttacattatcgctaatgttatagcagccctaaagaaaagtattgttttctccattttgagtatttttaacctgtattcaaatcctcttctctcacgtctacaacctctttgtgatgaaggaaggatcaacgcttggttttcatttacttagggagaaatggaagttaatttgtattgccttagatttttctctgtagcaagtgttgattttactgattttatgtaagcagaaaaaaatgtccatgttttaagctgaattctgatattaaaatggacttacgatatgttagcatatagaaaaggttaaaaactacccaggtcatatataactttccatttcaccctcttccagtttaacctgttaaagaataggatacaaatacacaaagatagtgattcagatcctaagattttgccttgaatcagcttgatctggtttactgtcattaacaaatgcatagggtgaaatctgaagtattcttgttccatcagaataagagtgaggggtgatttgctctgcccacctaacaacaaccagggcttgcttgttagtgggacctgaattgattgtgacaggaggtcatgaagtcagcttcacaaggaacctttttaagaggttgaagctgaaaagggcctcagggatccctaaggctgatctcctgattttacagagaaggtccagagaagtaaactaacttttgttacgatcatgtagtggaatagtcgtagagctaagctatcttcatgacagactcaggaacataatctaacttcttagaaactaccagcagacttctgggaagaaaagcatcagtacacttcatactaacatacagtttcagcgtttgtataggcatttatagagtttatcatcatagttataaaatgttgggtgaggtctgttcaacgtcaacatgatgggaatctgctacagtacatacataatggaatagttcaatgtaatcatctcattttttaatactgtggtcatcaaagaattgccagctccttgaaaggtaattctgtctacaaattagggattggaagatgaccttcattcactgaattgtgttacagatttttatgctattgaataaaatcgtttttattgttactaggtatataaaatttgctacagttcttgtagtgttcttagtgttataattggaagctatttgacttccatatttgacaaatttctcaatttctggcacatttcagattcttctgattttatcactgtttacagattgcttagtcatactcactctagtttatattaatatataggatgtgccaatgcgagatatttttatgagactaaaaattccatcagtttctttcaggcaactgtaagatctgatttaagaagtaatgtttgccttgaatgaattatccaaataattaaatttttctaattaaatatttctctctcttctgtgtagtttgataaggccccatcaaaaaacatagaacagtggctcagtagttcgcaaatatagtagaggcttattgtactgttgatctctagcagcaagggctgttcttaatataattatagaaatggctcaatgcacacatactcagtaaaatttaattcacagctcagccaaattcatagcataatgaagtatttaattgtaagatttttatattttccataagttgtaaactactatttggtcattaaaagcacccaggtatcaaaactcatcagaaaagttacctctgactgggtcttaaaataacccccctttaagagcaatatctgttagtctgcgttttaccttctgagtgaaagggaaaagagacagagatcaaaagtcctacacgtgtgacttagtatttgttttgatctctcatcttttctttagttttctccatcatagttgtgttctcacctattgacctacaatgtggtatccagaacattttctggtgtccccatcaaatgcagtccttttttatgctaagtctgagcactctctgtaatccctcatatttgctaagaagatccaaaaccattcataccctacaatggagtatctgaatttgggtggagactgtttttatatcaggctgttgagcttacagcacaaagctagagaaatgaaggaaacaaccttctaagtcatcctgccatactgagagaccattgttagcataaaagatggaaaattggctttaattttttctaggcagagaagagtactcattatgtatcatctgaggtatagatgagagggagaattaacactgtctccatttcgagttggctctgcctagatgaaagggagagaggcgcttagtcctgggctcacctattccagggaatgtttctctgtagtgttccctttataacaagtttccatgtgttctgtgttcatattacaaaagagttgtcattgaggttttttctttgtttatttttaccccatttgtgattgttcttgacattatactctaattctgtgatttgtgattatccacctaaatccaacaccttcctcacaagagtcattaatatgtttttatgggtaaagaacttgaagtctgaagacccagatccaagtccaggagcctcaaccagtggtgccactttggacttaacctctctgtgccatattttctctgtttataagatgctgataatgatagttgctctatttttttcagagagttttgagtgtaaaatgagataaggatgtgaaaattataaggctctacagaaattctaatagtgttttcattctttttttttttttttttttaacaattttgaagtattaaaaatacagatcagattctcctacactatatactcctttcaggaaaattagtagagttattagagagacaaaaaataaataaaaatgaaggcagacaactgtgaagcaaccatagggcatcataatacacgtggactcccctttacactcctgatcttgctactcagagtgtggtctgtggatcagaagcatgagcctcagctgagagcatgtagaaatgcagactctctggtcccatcctagacctgttgattcagaatctgtatattcacgagatctccagttgcttagtgtgtacattcaagtttgagaatcaccatatagcatcccgtgtagcactggtagcattcaagatgattctatacagtaagcaagtaaacttttttaattttaattccttggtttgaagaatattagaagaaaatattaccagcccatgaaacctgttattttagattttagattttccttaaggctaacaggtagctatttacatatttctaacaggtgagttaatttaacagaaattaagtaaatgacagagcaaatgatacttggaaatggcaaaaattatgaagatggcttttataactggtcttacggtaaccctgatttagaagttcagtggaattcatagtagggtcttagtagctgtgaatgacttctggggtgctgttagccctagctgaaggtgcccacagaaggcttagctcttgtgtttgtcaggcaccccagatcagactaggggtgtcacctttcaccatccacgtgaaaatgcaaagtgagattacaaggtctagggccctttattttattttagttctggattacctgtgcaggtttgttacacaggtaaacgtgtgccatggtggtttgctgcacctgtcaacccatcacctaggtattaagcccagcatgcattagctatttatcttgatattctgccttcccccacccctccccagaaaggtgccaatgtctgttgttccccttcctgtgtccatgtgtgttcagctcccccaatacatgaaaatatgtgatgttcggttttctgttcctgtgttagttcctgtgttaatggcttccagctccatctattgtccctgcaaaggtcatgatcccattcctttttatggctgcatagtattccttgatgtatatataccacattctctttatccagtctatcattgatggggatttgggttgattccacgtctttgctattgtgaatagtgctgcaatgaacatacacatgcatgtatctttataacagaatgatttatattcctttgggtatatactcagtaatgggactgctgggtaaaatggtatttctggttctcggtctttgaggaattgccacactgtcttccacaatggttgaactaatttacattcccaccaacagtgggaatgtaaacaaagtgggaaataggaacagtgttcctatttttccacacctttgccagcatctgttgtttcttgactttttaataattgcccttctgagtggggtgagatggtttctcattgtggtttagattgcatttctctaatgatcattgatgatgagctttttttcatgttttttggctgcgtgactgtcttcttttgagaagtgtctgttcatgtccttttgcccactttttaatggggttatttttttcttctaaatttgtttaaattccttgtagattctggatagtagacctttgtcagatgcatagattgcaaaaaatttctcccattctgtaggctgttcactctgatagttccttttgctgtgcagaagctcttttgtttaattagatccaaattgtcaatttttgcttttgttgcgattgcttttgacgttttcatcatgcaatcttgcctatgcccatgtcctgaatggtattgcctagattttcttgtagagttttcatagttttgggttttgcacttaagtctttaattcatcttgaggtaatttttgtataagatgtaaagaaggggtccagttttaattttctgcatattgctagctagttttcccagcaccatttattatatggggaatcctttccccattgtttgtttttgtcaggtttgtcgaagatcagatggttgtagatgtgtggtcttatctctgatttctctattctgttccattggtctgtgtgtctgtttttgtaccagtaccatgttgttttggttactgtagccttgtagtatagtttgaagtcaggtagcatgatgcctccagctttgttctttttgcttaggattgtcttggctatatgggctctttaggttccatatgaaatttaaagttattttttctaattctgtgaagaatgtcagtggtagtttaatgacaatagcattgaatttttaaattactttgggcattatagccattttcatggtattgattcttcctatccatgagcatggaatgtttttccatttgtttgtatcctctctgatttccctgattagtggtttttagttctccttgaagaggtccttcacttcctttattagctgtatttcttaggtactttattctgtttgtatcaattatgaatgggagtttattcatgatttagctctctgcttgtctattgttggtgtataggaatggttgtgatttttgcacattgattctgtatcctgagacttagttgaagttgcttatcagcttaagaagcttttgtgctgagacaatggggttttctagatataggaccatgtcatctgcaaaaagagacagttttactttctctcttcctatttgaatgccctttatttctttctcttgcctgagaaagaactggccagaacttccaatactatgttgaataggagtggtgaaagagggcatccttgtcttgtgctagttttcaaggggaatgcttccatcttttgcctgttcagtatgatattggctgtgagtttgccataaatgactcttaattattttgaggtatgttccatcaatgcctctactttattgagagtttttaacctgaaggaatgttgaattttattgaaagtagcctcctttctttgtcccttcaactcagtgctcttttgggaagagttcaagcacaaaaatagcgtttattttttaatttgctacttagactaactgtagggactagaagattctgtctctttccctgtgttagcctgtagctaaatgcttttcaaatatgtgaacggtttatccaagagagttttaattcctcataactcagtttctcttgagacacaattatggagtcaaactcaattcctcatgaggtccgacttttaagatttttgtctacattttcttccctttcacttttttcggtaacttgtgatattatttaagtaaaacaactaaatgtctaagcatcataaaatgtgtagggggaaatggtttatgaattgccatgcagtgcttgtgtagttgccttgtgagtttttttttctgaaccattccaggttcctacatgtgctgctaaaataaacacgtgtactcttctgttcatcttccaatttttttcctcagccccatttgcactctttcttgacattactctctgattctgtggtctgtgactatccacctgaacccatcaccttaaccaacttagagagttcagttgcagaagattttcttgtaaatgaaactctagcttattgatcagtggtgttgctcctcatgaaaaaccttttcagagatttacaaattgaagaagcatggtaatttgtagtcttgtaaagaatgatatccagaagattctttagttatctgcatacaaagctaaatagttaatttgatgtttaaagtattactcagacttcatactgtcatcctatggacagttgcaacatcttcgctattttttctcgtaatagatattttaaattaatttcatacagttgcagaatccagcctacttctgaatttcttccatttaaaatatacataaaacaaagtcaagagataagtagcagattggggaaaaatctttgcaatattatgacagaggcctaatttccttaatatccatagagctcttcaaatggctaaaaagaataacccaatagaaaaatagcaaacaatataagcatgaaaagatgttcactctatcattaaacataaatcaaaacaagttgcagttttccagctatcagattagctgaaatgaaaatgttggaaaaacctcagtgttaaagagtaggaaaaatagcgtgttgttgaaattatgaattgttaaacttttctgaagggtgatttggcaatatttttgaaaatctgaaatgtacatacacttagatcaagaaattccacagatatgaaaagatatgtttgtaatgatagtctttgcagcattatttataatagcctaaactgaaagtgacttctatgtcccttagtaggagggtttacagtagtaacattgtttattgagcccatggaataacctgcagccactaaaaagacgtcctagctttacaggaaaaaaaaaaaaaagagggaaaaacaaaatataaaagactgaataatatcccgtttgtataaaaaaaaagaggataaaaggatcctataaatacttgtatgtgaataaaagttccttgaaaagaggaaacagataattatggcaagagggggtagagatcagagatccagaggatagagagtgacactgggagagtaagagagagagagagagagagaggccaagactttaatgtaattatttaaaaaataaataattttgaatatgtcaaaacaattttgtgtgataaatgtgatttaggtgtgttgagagacagtgataaacaatctgattcatatcgcttctcttttcccgacccacacagtcctcctgtccccaccttcatttccacctataatagttatgctttcatgaatattagctgagtgttttcacttgccttaggggactgcttttgagagagaaaacaagtatcagtgaagtggcctaagggccggcagtggagggaaaaataaagactttgcccagtatttaaaatgaaaagctatctgctaaaaatgagccattctttggtaattttaattaaccatttaaaataattcagataaaagcaatgacattttcctaaagatgaatttggtttggacttcctgtataattatttcagttgcctattactcctgtaaggaaaacaaggttattaagtttttctgaagctctttttcttttagcccctaggacattctcatttctatgtctagtttgggggcagacgctttggattattgatggagttctttttagaaatggacttttaccttctttaaatagccctggacatgcctatgtctcatcactacccaggaagtacattttgacacctggattgagttatgaaatatatcttttactcctcactttttccagttgccgagcattttaaatttgcccaatagcattttacttagtttattttaatacttcagaaagttatttaaaggtttgttgactcagtttttaaatcaaacaactgttctacatgttattttaatatttaacataaaattcaatttttacatatttttcagctgtcccctctgccaccctgaggacttcttgtatcataaatttgtcattcattttgccttagagatcctttcctcaatactgcatttgggtgtctgagagatatatccagaaatatgctatgtccagtgttaggcttctaccagctttcatgcacggttgagtaggatgttttttcaagtttatttctgtttgtttttttttttttttttttgcagccaccaaagttctccctttgcattttttttcctaatctaaactttctgggagtgaccatgcttttttctttcagatggagactattttacctttacaagacatgaacccattggagtgtgtggacagatcatcccagtgagtgtatttcctcgcacctcgtatttattttcatttgacccagttctcttaaagacacataaaacatggtcctcagcgatgtgtgttttccattactggaggaaaaaaaactgagctcatgttgttgacatatctttaacagcctccctgcaaatgcttatttgaacaggttaatagggtttcagctctgttaccaggagttgaattctcaagtcatggaattctcatgattaaaataagcaaagcacagtgtattaataacctgcccttggttattatgtccattctgcttatggaaaattaatgctttgttatagttgtttattttttagaactgtgactcaccatccttccaggcatattattttatatgatcttttaatcccattctttcccactgtttcttttctcaagaatctagatagaagatgctacagaagacacagcactacagttaacgtcacagtcataattgaaaccatgccgagctgttatgtgtcttgtaaagagaaatagatgtagtgcttagtgtttggattggaacattaaacattgtccctttgttcctgtctgtctctcatacacacccttggtacaatacaaaacatgaccatagcttttaacagtactagctaatagttctggcagggatttcaaggggatgctcaaagtaaactcttacagtatagacaagaagttttcttttttcaaagtacagtagtataactcaagataatctttggcattgggaaccaaagatgtggggaagatataatatttatttgaataattgatgaatcccaggttactgtgaaatttattagagaatgccaagggaaaatgagaggtttgatttaagttctcttgctcttaaaggccctggggaaatcctacttggaccagctctgggatgaggtctgtcaccttcctcgtaggattcaaacttacttttcttgcccttgcccagactctcaacgctgcagcttcactgacaggacaagagctgcttgtcagccagctctggctcaattactgcactttaagatttatacactgtagatggaattaaaacattacggtggactcccaagtttataaacaactaaggggaaaagaaattgggtgtttggtgaaggcaagacacttgtatatttttgcaagcttgccagagccagtgagaagccttgaaggatggcagctgagatgcttcaggcagaaacacattgtggtcaagggctgaagccaggggatgaggatttctgttttctttcttaatgaaattatcaatgacacctgatagtactgaggctcatgcctgagcttatgacaatacaagcttaatatctttttaaaatcagtttaaaccattttagaccccaacctcatctactcatgtaaatgttactgtagtctccaatagcttcttttacagtggaaaagagacaaatgaaaatttttgcatactcatcagtatatgcagtttattttttgtaatcatatatgtttgtgacaatgcatgtatctaaagaaaaagtactaccttgaaatacacattgacttaactacaactcagttagaattttctagtttttccatgttgaagagctttcataccagtgtgaaaattgtgatgtaaaaatctcagatgcaagaaaagttttcatacacgagaacttattggaaccaaagcctaattaaaaaaaacataaaaacagtgacaaaacaaaacaaagaagtaacaaaactcccttttcacagtgggatttcttttggtgggtagttggagtatagtaattggttggtcagagagaaaaggagagatttccaaggtcagtgctattctattcttaatgaagtaattgaaaatccaaacatctgtactttgtagtggacaagatttatgtcgaggactagtttgagaaatatgagaagtcacagcttgaaaacaaagtagtggaagaatgtttttccatctatcaactttgagttttttcctttcagtggaacttccccctgctgatgtttgcctggaaaatagctccagctttgtgctgtggcaatacagtagttattaagccagcagagcaaacaccactcagtgcactctacatgggagccctcatcaaggaggtaagagaaacggacttcgggagtgcttctgactccccttacagctggagcctactagagcatatctcatttaacatgatgcatcagctttcatcagccacgtttcctcctgttctgttttcttaggctggctttcctcccggggtcatcaatattttgccaggatatgggccaacggctggggcagcaatagcttctcacattggcatagacaagattgcattcacagggtctactgaggtaggtatctgaaaaaccagggcttgaggaacagtcttgcaaatgagttgaggggttacaaaaacaataaaactagtacccataggctagacaccaaaagggcagtgagtacccaagcccacaaaggataacattggtgtcatagaacactggtggatgtgaaagcaaaggcacacagggaccatttgaccccacagatatctgagcatttttgtgataccatctgtgtaagaactatcccagaaggtggggttctagacactttgttgaatagcggcagaagcaagttaagaagctggaaatctaaactagtctctggtaaggataagaatggagacacaagctttcccttctcattgtttggacaggtccggtaggtgcaattggcaactcactataccccatgaaccttaagagatgatatagagcagggctcagcacattttttttctgtatagggctagatagtaaatgtaaattttggaggcaacgtggtctctgttgcaactactcagccatgccatagtatcaccaaacagtcatagataatattgagtgtggctatgtgccaattaaagtttatttatagacatggaaattggaatttttacataatttgtatggattacaaatgctaatctttttattgtttctagacatttaaacatgcaaaaactggttttagcttgtaggccataccaaaacagcagggtatatttgacccatgggccatagtttacagatccctgttacagagtcacaagtcagcttaagaagatttataaatgttactcaaatatctctgatccaggtaacagatgataggaaagtctgattcattgtttcaagtagaacctcacagatgatatcatcattgaacaaaggatgtccgcaggtctagaacagtgctatctaatagaatgagagcaacatttgtcatttaaaataagctagtagccacattaaaaaatacgtgaaattaatgttaataactttaatccagtattttcaaaatattgcaacatataatcactataagttattaatacaatattttgcattctttttcatatgcattctttgaaatatggtatgtgttttacattgacagcacatctcttcagactagccacatttcacgttctccattgccatgcgtgctaccgtattggacagcacagatctagaaacattttatcagttgatacagagttaattatacttggttaaactgactcacagtagtaaatttaataaaagatttattaataaacttgaatattaattcagttagattactgagttttgtgtttgtcgagttaaccttgtttgtttccaaatattttattctagttgtatttgttattgtaattttgcagtttaatgaaatatttaaaccaaaatgtgagtatgaaagggaattattaattattctgaagtttaatgctttgaaaatatttgctaaaggctagatgctaagaaaaactaaagatgcaatcaatttaagacaactgtaaaagactggggaaaaatataaacctagatagaatgggcacctggaattgctttgcaaatgttcttaagtccttacttcactttaaggaaattgaaaccagaaatcataaataataatttaggggtgtgatttaatcagaagagacaggtggacccatgattaagtaaagttcttggttctatatcaaaagactggagaaatgaaatatttaaagtatctttttctgctttaacctttttctgttgaccaaccaatggtcctgattgagtcagtcaagaggcttctattgtgtaatttttttttttttttttttgagatggagtttcactcttttgcccaggctggattgaagtggcacaatcttgtctcacagcaacctccgccccccaggttcaagcgattctcctgcctcagcctcccaagtagctgggattataggcacctaccaccatgcccggctaattttcgtatttttagtagagacgggggttttgccatgttggccaagctggtctcgaactcctgtcctcaggtaattcacctgccttggcctcccaaagtgctaggattacaggcatgagccacggtgtccggcctattgtgtaactttttaaattaaaaatgacagcataatatgtcaaacaagagataacaccttgtcatgttagtacctacatctccggcatttatttttaacagctgcatagaatactcttgcatcagtatatcatcatttaatcctgtattaatgtacacttgagggtggtttttccactaatttttcctattaaacagactgctgaaataaaaacctttggagacccaagaaaaattttacttgtaaatctgtaactgtatacacatatgtatatacgtatacacacacgtatatgtgtacatattagatgctcagttggatatggttctagaagtggaattgcaaaataaaaacatatttacaacttgcttaccaagaaggccttagagtattggtttcatttataagaggttaggtatgttaatcttttgtttgttgtagaatttgaaaatatgtttgttctttgctttttaatttttttaaaacagttgtttgccatgtgcagattttaaattctcatgtagtcttctcctttagtctttttctgacagcttctggatttcctgtcattttttttttttttttttttttgagacggagtctcgctctgtcgcccaggctggactgcggactgcagtgacgcaatctcggctcactgcaagctccgtcctgtcatttttgaacaaacccctttaagattatacaaacggcccttaatattttctttcagtacttttatggttttgttgtttaaatctttaatctggttggaatttattttcatgtataatgaaaggtgagggttgtttgtttataaatgaatgtttagttacttcaaaacaatttattaaacagtctacccctttgcaactcatctgaatataacattacatgatgcctgaatataacattacatgatgcatttccatatatacaggttggagcaaaagtaatttgattaatggcaaaaactgcaatgacttttgcaccaaactatacaggaaatttctgttttagagctcataattttttctgttctttcactagtaccagactgccttaattactaggttttataagatgtgttactataatataggcaacataccctcttatttggtttttcaaagcccatttattcttttagaagaaatttcaaaccgattttctaagtaccttatgttactctaaaaaactttgattggaattttgattggcataacattacatgtccatattaaaatgaggaaaaatgctatctttaccatattgactcctcatctaggaatatgatataatatgataaaaatcccttcaattatttgttgtaatgttcatcactgatgtcatcatataggtgttaggaatttcttgataaattaacttctagcatttaatgttttcttccaagatatttcagtctaaaaacgagtaacatttttgagatggagtcttgccctgtcacccaggctggagcgcaatggcgtgatctcggctccctgaaaccgctgcctcccgggttcaagtgattcgtagctgggactacaggcacgcaccaccatgcctggctaattttttttatcttaagtagagatggggtttcaccatgttggctaggctggtcttgaactcctgacctcatgatccaccagcctcagcctcccaaaatgctgggattacaggtgtgagccactgcgcccggcacataacaatatcaggtagtggaagttaaattgaataaatggaatctcctctttcaggccagacaagaagccacatagtgagtccataaaaccataagtgcttattgcaaggcagcttgggttcaaatctgttttgccactgaagatcttttaacgttttaaatgactttactgaagtataatttacatacaataaaatgcacccatttaagtaccatgtatatacacctgtgtaaccatccgaatcaagatgtagattgtttccatgccttagaaagatttctcatgcctctttgcaggtaacacccttggcttctggcaaccactgattctttttaattatttttgcctattctagaatttcatataaatggaataatatctactcttcgtgttttcatttttgttgttcaacattcaatgtattaatgatatggtcgggtctaaaatcccccattttgatttgttttctctttgtccatattttccctctttgtctgccttcttttggttgagttagataattttaccactctttttattctattttgcattattagctgtacctctttttaaagtgtttgctttagtgtgtacaatatgcacctcaatcacagtctaccattaaatactttatgttacttcatatacagtgtggtaaccatacagcagcattgttccaatctcatcctttgtgttattgttgccctataatttacttagacataggttatatgccccacaatacattgctgctgtttttgttttaaaatttgttttttgaataagaatacaaaattattgtctgtttactcacatacttgctattcctggcctccttccttgtttgtgttgtaggcccatttccttctggcataattttccttatctgtaacgatctttaacgtttcttgtagcgtaggtctactagtgatgacttctctcagcttttgtttgtctaaaaaatggcttcattttgtcttcacctttttttttttttttttttgaggggtcagcctcactgtcgctcaggctggagtgcagtagttgctcaggctcactgcaagctctgcctcccaggtttgcgccattctcctgcctcagccttccgagtagctgggactacaggcacccgctaccatgcctggttaatttttttgtatttatttttagcagagacggggttccaccatgttagccaggatggtctggatctcgtgacctcgtgatccgcccgcctcggcctcccaaagtgctgggattacaggcatgagccactgtacccggcctgtcttcactttttaataactaacttttttttctggatataaaattctaatgtgacagtttgtgttttattttactttcaagacttcaaagatatcattctggcatgtttctgactttactgtttctgatgagatacagcaatcattgttatctttattttacggtaagtaatgtttcttttcccccagactgcttttgagagagtttctttttgtcagttttcagcaatttgattgtgatgtacttttgtgtattttgttggttcgttaaaatttctgtatatctgtgagtttatagttttcatcaaactgggaaacattttgaccattattttttcaaatcttttttttttgctttctacttccgccttctgtttacagatatgttaggtcatttgtcattatcccatgggtcactgggactcttttatttccagcatttttttcctttgtgcttccggctaggtaactttcattgtcatctttgacgttcgtatattcttctgtaatgcttaatctgcttcagagattttgttaagttctagaaattccatgattttttaaatatcttatattttcttcctcgctacacccctttattcctttaaatttgtgtagacatctattttacaatccttgtctgtggccgggcgtggtggcccacacctggaatcctagtactctgggaggctgaggcaggtggatcacctgaggtcaggaatccgagaccaacccggccaacatagtgaaactctatctctagccaggcgtggtgttgcacacctgtagtctcagctactcaggaggttgaggcaggagaattccttgaacccaggaggcagaggttgcagtgagccaagatcacaccaccgcactccagcctgggcgacgggagtgagactccatctaataataataataatataataatgaaatccttgtctgttacttttaacttctctgtcgtctctgaatttgactggagtttttcctgtttatgggtccttttttttttttttttttttttggcttttctgttaattttgaaaggatactggacattgtgaccattatattgctgaacttagagattttgttgtttttctttaaagaatgtcaaactttttttttcctaaaaggtagttaagttacttgaggttcagcttgtctcttttggaacttacctttaagctttgttaagactagtttattcttattaataagctgaaatccttctgaggtttctgttgaatgtccccagtgttcaacaagatctttcttatctgtctggtcagaattcagaccatcatattctgctttggtctcctcataccatactgcaatctagaaagtttaggcacaaaaggatttccttttctctagattcatagtcccatactgcctgatatccaatgtttgaataaaacaatttcatatacttttctagttgtttataatggtaaaacaagtccagtgtcggttactccattacaattagaagcagaagtctctctggcaccttttgattaattttgatattgtttgattttctttaggtttcatgcagatcacctttacagttaatgaggttactattttatttacttcagttggtcaaaccaaagtattaggaatacaaccataaggacatactggatttggaaaagcccttgatttaattaattaatattgaatatttaagcagtactttactctcataagtaactcctttttcatctttgagctgatttgcttatcagtttagtcttgatttttataagttttactttcaaaagatggcagtttctggtcatatatgaagatttgtggggaggacattctctttggagtctatcccttaggccttctcagtacctcaaatagtatcttatgtatagtaaacatacatagtaaatatttgttgctacatgaaggaggaaagactgaatttggtaaataaaaacttaatctcagagctagaaggtgaggtatcagtagaaccctcccctgctttaaaatgccaccataagcatagggtttactattttttacttcatagctatataattatggaccagccacttggttttgtacaaaattggtttaataatagcatacatacctgtttctcagggtcatgggaattaaatgcaatatgagtttgggaaattttaagcagtaagcaaatgttagtttgtaatatgacatcagcatctcaagaagggagagagctctaggggttgggtggtctatcaaggtttcaagagaaagagggatttgagggtctgtaggatatagataagtagagtgaattgggaagaaagggcagtgttagtcaacaactcgaagcaggagaacacaaagtcttagtggaataacggaattgggaagggactggggagaaacgttgggagtcagatgaactgggaaataatatgcacatcaaggcattggaaataattctgggtcaaaaaattgtggccaacatgtagaagataccacagacaaagatatcacaagaaaactatataccaacatcttatgagtatagatggaaaaatcctcgacaaaatagtagcaaacaaaatccagaaatatataaaaatgattatataccatgaccaagtgggatttatcccaggaatgcaagattggttttatatatgtaaaaaaatcaatgtaatactccatagtaatggaataaaggacaaaaaccaggtgatcatcacagaagaaacgtgacaaaatctaataccacacagaaacatgtacaaaaatgttcacagcagtattattcctaattgccaaaaagtggaaacaactcaaatgtccattaaatgataagcggattaacaaaaagtggtctatccatacaatggaatactgttcacccataaaaaggagtgaggtatttatacatgctgcagcctgaatgagccttgaaaacactataccaaatgaaagaatccagttacaaaagactgtatcatgtgactgtatgaaatatccagaataggcaaatctataaacagaaagttgattagtggttgcaaaggactgggagaatggaaagtgactgctgatggaatatgaagtatctttttggggtatttatgtcctcagatagaagtaatggttgtgatggatgcacaactctgttaatatactaaaatccactgaattgtacacatcaaaagagtggattttatggtatatgagttatatctcaagctgtgaaaaatcaattaattttacaaagtattaaaggctttacattttggatattaatagccaacattgatttagcacttactttgtgtcaagtacctgctaaatgctttgaatacattattacagcaaccctacagcattgagcaaagtgtggctaagaggggttacattacctgcccagggttacatgctagttagttgtagggctgagagtcacacccagggcctatattccatattacagtggtacactgcctcccaggctaagggactatacaccctcccataggggagagccattaaaattcggaatgacatattaatggaggtacttaggaaggataatttctcagtgcagcatgcttaggtcatagacacattgtaactccgttttttcctaaaattcacttcaaaattgcatctttagcctctttaaattccatttgttacaatacagggtttccatttgacactgtctgatataggacatgaaaatttaaaacttaagttgtttccagtcaattccacaaacatttatcaagcacttatagatcttggagaggcaaaggtggtgttttatgtgattcagtctagcccaagagataatctgtgaatatgtaactattagagtgtggtgtgttatgggagcatggagagaagagaattctctgcatcattacctaaaaatgtcatgattttcaagatgataagatcaaggacaaaactaaagttctgtcatttaatataattttcaaatgtatctgtatctaggagaagtgtcatcagttgaagatatttacatttgaatgaaaagctactttattcaaagataaaagtattttaagaaaaagataattctccatcttaattccacagttgttaatagtcacaactggcaagaatttaaggctgtcttccttttctcttaacattaatctctttggagaaaatggaactgtagttttatgggaaccaaaatacaaaaagaaattcgaggaaaggaatgctagctgtgaggaccctcgtgagtcctcagggactcacaatgtgttatttgatattggcagataatcaacaaatagtggtatcatttattctcaacatcatttcctatgccagatattaaagaatcagcactttgtaaaagctcgatacatattttgctggaaggtaggatgggatattaggtttcactgtttcctttcaatagcgaatgcagttttgttgtcattcctgcagttgtacttttaacagtcatttaaacaccagagctgcagattttttttgaattcagtgtctatccttagaagtctctttaataggatgtgaaaaaccttatagagatgggaaaataaaaacaaacaacacatccctaagaacctaaatcataccagatgggacatgttgagaagggtagtgtgtgtctgatttcctagggtcgttaactcttggtaggtgagccaacactgaacatgacatgctcagtgactgctaaacatgtagcctcagtgttctagtgagagtagttaatagtcagggggtaccaaagtgtgtaaaagctggagaaaatactaggctttcctcaacagtgatttcccatgaatcatctttttacacttcagattatattattcttaaccacattgagggcaagtaatgtccatctacaaaactatgcagatggcttgtcataagcaaagataattcccaagctgaacagtaaatgatcaatctgattaagctaattatcaacaaagaccaacccataaagtttaacgttactttaggatttttacagcattaatgtagttcagcctgagttaatttctcttcatcctttacttagagtctcttaaaagaaaacaaagtactcctcagtgctttcttaaaatgaaagtttgacagaatagtatatcacaactctatagtttgcgtctctctaaaccaactaaaggaaatcatcactttttcagtaagttttgaacatagtcttcaaatcatactaaaggaatcaagattaaatatgtcagtcatatcagaaaactagacaacttaaacatctattatacttgagtggattcattcacattacatgttattatttaatctttccaggcctcagatatcccagctgtagattagagatgattgtacctacctcatggattgtgaggatgaaagatgatttgaatgtgttccccagaaagagtgtgtttgttatttaatctacaatgcaatagtgttgagagatgggcactagtgaggggtgttcaggtgggtactaatctgttaacccacattaatagattaatgccattataaaagggcttgagattgcacattgaatctcgtgctgtcttgtcgtctcttgctcttccatctttcaccatgggatgacaccacaggaagtcgttcaccacatgtgggtctctcaaccttggacttcccagcctctcgaactgtaagaaatgaatttcctttctctattaggtatccagtctgggacattatagctaaactgaatggactaagaaaagctagtatatctagagtgtttagcactggatctaattcttagtaaagtgtcagtaaatattaactgtcattgttttctatttatttttaaaatgaagtttatgggacaattaatgcttggggaagtgtggtataatagatgaggcactggatttgatccacaaatcatggatcaaattccagctttcctgctgtgtgacttttggcgaattgtttagtctgttatttcatgtcttcttccattagtaaggcctatgaatcactccttacaggctcatttgaagattgaaataatgtatttgaaagttccaagcatattgcttggcatatagtaagaattcagtaactattaggtgaatctgaaacttccatttgcaaataatatatttgtcaataactacattctgctctcctctggcagctttactctcctttcgtttattttgtagcttttgtaaatattttacaaatatttttggctaccagtcagtgtttgtgtgtgtctgtgtgtgtgtgtgtgtgtgtgtgtgtgtgtgtgtgtgtttgctcttctatttcacttcttggaagactgccttcgtgcttgcttggataaaatgatgatgaatcctttttcttttttggtaaaatagtgtactagatttagaatacagtgcaggaacccaggagctggttttttgaaaagataaacaagatagaccactagccagactaataaagagaaaaagagaaaagaatcaaatagacacaataagaaacgataaaggggttatcaccacggatcccacagaaatacaaactaccatcagagaatactgtaagactaaaccaggaagaagttgaatccctgaacagaccaacaataggctctgaaattgaggcaataattaatagcctacccaccaaaaagaaaagcccaggaccagacggattcacagctgaattctatcagaggtacaaagaagaggtggtaccattccttctgaaacaattccaaacaatagaaaaagagggactcctccctaactcattttatgaggccagcatcatcctgataccaaaacctggcagagacacaacaaaaacagaaaatttcaggccaatatccctgatgaacaatccagcagcacatcaaaaagcttatccacccctgtcccgtgtggccccatcccgcagcctgccagccatgagttccacgcagttcaacaaaggcgtctagtatgggctgtcagccgaggtcaagaactggctcctgcccaaatatgacccccagaaggaggcagagcttcacagctggatcaagggactcacctgcatctccattgagcctgacttccagaagagcctgaaggacgggattatcttatgcatactcatgaacaagctgcagccggcctcattccccaagatcaaccactccatgcagaagtggcaccagctggaaaacctctccaacttcatcaaggctgtagtcagctatgacatgaaccccatggacctgttcaaggccaacaacctgtttgagagtgggaacatgaggcacatgcaggtgtctctttttgccctagcagggaaggtcaagactaagaggccgcagagcggggtggacattggcatcaaatactcagagaagcaggagcagaacttcagtgacgccgccatgaaggctggccagtgcgtcatcgggctgcaaatgggcaccaacaaatgtaccagccagttgggcatgaccgtgtatggcgtgaagaggcatctgtgtgaccccaagaatcacatcctgcccccccatggaccactcgatcattggcctccagatgggtacaaataactgtgccagccaggtgagcatgacagctcctgggacgcggcagcacatctgtgacaccaagctgggaaccgacaagtgtggtaattcctccatgtccctgcagatgggctacacccagggtaccaaccatagtagccaggtctttggcctgggccagcatatatgtgaccccaagtactgcctgccaggcacagtggctgacggggctcccttgggtgctggcaactgcctgggcccaggagaggtccctgaatatcccccttactaccaggaggaggctggctactgaggctcccagcacactctctccccacattatctccctttctgggtttttgggtttttctgtgttttcatcttttttttcttaacctgttcagtgctgccaatcaaccgagggtctgtgagtggcaacgtggaatcaggcagcagggctttcttcccccttgccttggtccttcgcaggaatgagccaccaggctgtggaggagaaggggtcaaggccatatcccaatatgtgtatggtgagggtccctgctggcacgtccaggctgccagcagagctgtgccggggagaagagacctgggcttggagggaaccagtacccggaggtttccagttgccttgcctcttcccacttttgtcagccgatcagtttgtggtttctatacccgcaaaagtttcaggatgcattaacaaaagaaaaatacatttttttttcctgaggaatggggtggggacagtggagagggtgctgggaaatgagtcccctgggaaagggggcctgtctatgatgctaaatatctcaggctcccaagtggctggatttccctaggaccctcaggccaacagacctcagacctgcctcagggcccagtggggaaagtgaggcctgtacaaggaagtggatgctgagtggttgggcctaatccccccaactccccacaccaccaccgtggcctcagtagggtttttttcttagtagttgttgcccagtctggagtgcagtggcatgatcttggctcactgcacctccacctcctgagctcaagggattctcctgcctcagccccccaagtatctgggattacagacatgtgccaccatgcttggctacttttgtatttttagtagagacgaggtttcaccatgttagccaggctggtctcaaactcctggcctcaggtaatccacgcaccttggcctccctaagtgctgagattacaggcgtgagccaccgtgcccggccccttagtaggtcttaaggagccccagcccttctccccttctgggcctgaccagctatactgctccatctcccccggccacatgcccctccaagtactgcacagggaccccccacccaggggccctgctccatgagataatgtgaaatatgactgtggaccaaacacaataaaacctctgtctgtaaggaaaaaaaaaatcttatccaccacaatccagtcggctttatccctgctatgcaaggctggttcaacatatgcagatcaataaatgtaatatatcacaaacggaaccaatgacaaaaaccacatgattatctcagcagatacagaaaagtccttcaataaaattcaataccccttcatgctaaaaatccaataaactaggtattgatggaccatatctcaattagagctatttaagacaaacccacaggcaacatcgtactgaatggacaaaagctggaagcattccctttgaaaactggcacaagaaaaggatgccctctctcaccactcctattcagcatagtattggaagttctggtcagggcaatcaggcaaaagaaagaaataaagggtattcaattaggaagagaggaagtcaaattgtctctgtttgcagatgacatgattgtatatttagaaaaccccatagtctcagcccaaaatctccttaagctgataagcaacttgagtaaagtctcaggatacacaatcaattgcaaaaatcacaagtattcctatacaccaataatagacaaacaaccaagtcatgagtgaactcccattcacaatgactataaagagaataaaatactcaggaataaaacttagaagagattggaaggacctcttcaaggagaactataaaccactcctcaaggaaatgagaggacacaataaatggaaaaacattccatactcatggtatcacaaaaatggccatactgcccaaagtaatttataaattcaatgctatcccgatcaagctaccattgactttcttcatagaattagaaaaaacgactttaaatttcatatggaatcaaaaaagaccctgtatagccaagacagtcctaagcaaaaagaacaaagctggaggcatcatgctacccaacttcaaactttactacaaggttacagtaacaaaaacagcatggtactggtacaaacacagatatacatagaccaatggaacagaacagaggcctcagaaataacaccatacatctacaaccatctgatctttgacaaacctaacaaaatccaagcaattgggaaaactggctagccatatccagaaaacagtaactggaccccttacttacaccttatacaaaaattaactaaagatggattaaagacttaaacgtaagaactaaaaccataaaaatcctagacaaaaacctaggcaataccattcaggacataggcatgggcaaggacttcatgactagaacaccaaaggcaatggccaaaattgacaaacgggatctaattaaactaaaccgcttgtgcacagcaaaagaaactatcatcagagtgaacaggcaacctacagagtgggacaaagtttttgcaatctactcatctgacaaagggctaatatccagactctacaaggaacttaaacaagtttacaagaaaaaaaaaaaaacatcgaaaagtgggcaaaggatatgaacacacacttcgcaaaagaagacgtggccgttaaacatgaaaaaaagctcatcattactggtcactagagaaatgcaaatcaaaaccacagtgagataccatctcacaccagttagaatggcgatcattaaaaagtcaggaaacaacagatgctggagaggatttggagaaataggaatgcttttacactgttgatgggagtataaattagttcaaccattgtggaagatggtggcaattcctcaaggatctagaactagaaataccatttgacccaacaatcgcattactgggtatatacccaaaggattataagtcattcttccataaagacacatgcacttgtatgtttattgcagcactattcacaatagcaaggacttggaaccaacccagatgcccatcgatgatagactggataaagaaaatgtggcacatatacaccatggaataccatgcagccataaaaaaggatgagttcatgtcctttacagggacctggatgaagctggaaaccatcattctcagcaaactaacacaaacagaaaaccaaacaccatatgttctcattcataagtgagagttgaacaatgaggatgcatggacacagggaggggaacatcacacaccggggcctgtcgggctaggggagggataacattaggagaaatagctaatgtagatgatgggttgatgggtgcagcaaaccaccatggcacatgtaaaaaacctccactttctgcacatgtatcccagaattcaaagtataattttaaaaaatacagtgctggaagaagatgcctggtacctattaaggaactcactcatgatttcttgctgtggcctagagtggtggccactccttcaaactgagtttgccagaatggaattctggtgtagggagaaatttctttgcagaaaaatgttacgtagtttcctttgtttttcagtagttgtgcaaagaccaactactgccagtagtctgcaaaggacaacaaagagatatatggcataatttctgtaatgaagtaatatttttgtttaatgtacctttattaacagctttattgtagtataattgatatacaatagatttcacttatttaaagtgtacaatttgataagtcttggccatgtgtatccatctacctgtgaaaccatcagtagagttcacaatgaatatgtccctcaccctcacatgtttcctagtgcccctttgtaatctctctgtcttatctctctctccacccccacccccacattcccaggctttctggcactatagattatctgcattttctagaattttatataaatggcaacatatagtatatactcttttgtctagctgtttttactcagcacagttattttgagatctgtctatgtcgtgcatatcaattcgttcttttttattgccaagtagtagtccatttatgggtatatagtttaactattctgaattcaaaaaatctgaaatctggaatgcccccaaaacttgaaacattttgagcaccaacatcatgctcaaaggaaaggctcattggagcattttggattttggatttccagatcggggtgctcaactggtaagtataatgcaaatattccaaaatctgaaaaaatatcccaaatccaaaacacttctggttctacacattttgataagggatgttcaacctgtatcaggtttaatagccattcagccaatgatgaacatttggatttatccatttgttgtatgtttgtttatccattcagccactgatgaacatttggattgttttcagtttgggactaataaaagcttctatgaacattcatgtacaaatatttgtatggacatgtatgtccttttctcttaggtaaatacctaggaatggaatggctggattgtgtggtagggcaggaaactgccaaactgttttccaaatcggttataccatcttacattcctaccagcaatgtttaagactttgaactcctttacatccccaccaacatttgatgtggttagtcttttacattttagccattcaaataggtatatagcattgtctcaatgtggttttaatttccaattctctaccattgagtgtcttttcatttgtgtatttgccacagcatatcttctctggtgaagtatctttaaatctttgcacactttggagacaagcgttgtttgttttcctcattgttgaattatgaaaattgttagtatattctggataaaagtcctttgtgctttgcaaataatttctcccagtgtctcttaaagtttttaattttgatgtccagtttattaacattttcttttatagatcaggcttttggtatggtatctaagaaatctttgcctaacataagatcacaaagactttctcatatgctttttttctagaaattttatagttttgtgttttacatttaggcctatgatctacttcaacttttgtgtatgttgagaggtaaggatccaagtgctagatagatggataatgacaatagttcctgcaccatttcttgaaaagactaccctgcctccactgaattgcctttgtgatgcttgcttttttcaagcataaattttccatatttatatgggtctatttctttctttttttttttttttttttttgagatggagtctcgctctgtcacccaggctggagtgcagtggcgcgatcttggctcactgcaagctctgcctcccgggtttatgccattctcctgcctcagcctcccaagtagctggaactacaggcgcccgccaccttgcccagctaatgttttgtatttttagtagagatggggtttcaccatgttagccaggatggtcttgatctcctgaccacgtgatccaccagccttggcctcccaaagttacaggcatgagccactgcgcccggccctatatgggtctatttctgtactctctgttctgtttcagtaatctgtgtgactgttgcatcgcaagtatcacattattttgactattatagctttataacaacaggaatttttttatcttcacaaataaaacattaacaactacctatgcaatcttccaatactgagatattcaatagggaactgagagagagagagagaagggagaatttgggaaagagaatagggtggaaggtgggtctttgaattgttttgcttttaggaatagttaaaatattaagtagcctattacagtgtgaatagagcaagttttcagctaaactttctaacagaatctacatttgattcttctctctctgtagagaggcttacattcatttggaggggaactaatcccgtgacttctaggttatctcttagtttcttctctggaatgacattattggcagacactaaaggacttaagggagagcggcatttgtctagaatataaaagccaatttgtaatttccatattagtagtggtggatggagaattttcacaggcaaatcaaacgatcacataatccccaaaccccttttcagctgtagttatttacttctttatccatttattctaactttgcaggctacctgagaagttgtatagattcttccagagtgaacatgtcacttaaatatggattagaacatggcttctgctgtgattaccttagggagatgggacctattggtacattacaaagtgtctggaacagttaacaagaagaagcttatttgaggtggctgctttccattttactaaagcaaaaggcctttagaaagccaacaactttactcagattaaagatgggattaatttctccttatgcagctaaatacataagcagtgcatgtaaatatttaataaatataaaagagctcttataaacacaagtcaataaacaacttcaataaagtacaggaaaacaatatgcattttgcttggtatagtgttttctttactcaggttaacaaacaatgatctcatcattagcagcaagatagtggagagaccatcaaagcaaactacagcagagtccagattgattcgtgccaaacaaatgtttgtagctaacagctgtattatcactcattctaatttacgcagctggggttcttttatttcctaagtgagataaatgtcatgttgcatgatacaagcaccatctctactgcttgagtcatgaatcaggtcagctctctcctagttagcttcacccctcattttaggttaggggaggtggcttgctacagttttagctataaacagctaataggcctttttctaaggttgtgtgagtccattcgtgaatcattcagtattttatttaaaaataccagtttgaatgtcatgaaaatattgaaaaaaccagtttcatgtggaaaaacctttggttgtgtaggttttaaactattagcataaaacttctctttttaaaaaattcttaaaacttgaagactgaagaataagtatggtatagtctctgcctgctggatgagattccatgatttattctctaactatgctaagtcaaagattctgcagttagctttctccccaaaactcaggctgagtttgagcaggtcctaaggtgttgatccctttagctcacctagttaatgggacatagagtacttttggcttgactactccatgctttttcctatcaaagcagaccaagacaatcaaaaccttgatttttaaagcttacctgaaatagagtcttatgtaacaaaaggatggctaagtgtacaaggcagttgaacatgttagtggtagatgatgcatttaactgtcaaaatgctactcacagcaaaggggaaccaattcccaggagaaggtctggagaagaggagggagaagagcctgaggcttggtgtgcacattctgagaccagtcctggctctgccactcagtgggtgcctgtttgcaagtcatttcttgacctctgtgagtcttgtcttgtctttttttccaattataaaatagaataataattcctgcctcccagttttgtcatgaagattaaataaaataatgtttgtgaaaacaagtagacagaataggtgctcaatcaacaataacattagctggacacgatggctcacgcccataattctagcactttgggagatcaagaccagaagatcgtgtgagcccaggagttcaaaaccagcctgggcaagatggcaagccccagtctttgcaaaaaaaaataaaaaataaattagccaggcttggtagtgtgcacctgtagccccagttattcaaggggctgaatggcgggattgcttgggccaaggagttgaaggatgcagtgagccgtgatcacaccactgctctcaagcaattttcgtattctggcttattgacttaacaaattattgaaagtttgtctgggccctggtggctcaggcctgtcatcccagtgctttcaaggcctaggcaggaggaccccttgaggccaagagtttgagaccacctggtcaacatagtgagaccctgtctgtaccaatttttttttttaattagccaggcatgatggcaagtgcctgtagtcccagctactcaggctgagttgggaggattgcttgaactcagaatttcaaggatgcagtgagccataatcatactactacagttcaaccttggcaagagagtgagaccctgtcttaaaatctgtgtacatatgcatatttttttaaaagtcagtcattgtagtcggggagacagctattaaacaagcacaatgtgagagttacgtacatagcactgtgagatcagagaaggaacaccaaaccctgtagggagggtagggaaggaaagctaccttctcagaggaggtgaaagagttatctctgtaaaaatgagtttatcaagtaagcaaggggtgaaaaggcactgcaggtagatggagcagcttatgcaaagacacacaggcatgttccagaaagggcaagtggttttgtgtgcctagagtcgtgggtgagtggtggtgggaatggtgggacagaaggctggaaacatagtggttatactggccttcataatctgaatttcacagataaaggtttaaactgctgttaccacttaaaggaactgcttagatgccttggtcctgtttgtttctggtgcaaatctggacagattaatttggcctgttatttctgggtacttcagaaagacaaacacccaatccccatatttttggcatttctattcccaacacagttggaaccaggaagcataacaatgaaaattaagaaaggagaagagggaagaagcagagagtaaatctgtttgggatttatgaaaagatattacaagacacaggcatctttaactagtttactgggatctctagtagagatttttccatttttaaaaaggtgttatatcgctgagaaaaatctaccttgatatgtgtaataaaatagctctgagtaggaactcacctgagtaattaataaaaaaaaattttacccaactttagaaactgtgttcagggagcaactgccctgaataaagagggcatgaaaagccttttgtgttcctttttgtcctgtataacaaattatttttcttgcaaagccccaaattgctttcccctacattgccgcattgctgtgaacatgattccagtacactgtggctcttccagggatactcctgatatcaatcttgaggcctattcaaacgaggatgggagtcagagttgaactgtgccagcattcctgctgagaattagcccagtttcattatgtgtggaggagcccccagttcactgcccttgcatgtttggggtacacagagctgagaggctctgcagggagtgcaaagttaaggaactgcatgataggaacactatcacttactctttcataaggagctctgggcagggaaactaaaaaaagatgaggtttttccatcattcagtgcagctgtggtgttctacttgtaacaagctacttctgcttcataaggcaagaaaaacacaagaattgtgaacagactctcagaatgagcagggtccccaggagtcctgtctgtcttttttaactccttcaattaactggagtactaagggagagatttgttgcttggcctgtgccttcattctacagatgcagaagctgagacccaggaggagaagtggctttcccaaattgaagattcattagaagccagagtttgtagtaccaggtcttctgactcctgtgggccaaactgtcgtccataagcctaaatatggttataattagccaggttgtcagcaatggggcaggaggtatcacacgagtacgttgtaaaatcttttctgcttggaagaaaaggtgatggcgaactaaaaatttgatctctgtgcctttatcctatttaatctatattacatcatatacaggatttaatttctcaaactgtatgtttacctgttttatcttacaaattaccaatttcatcagaataggacttggtatcatcaagtacagctctattaacttgacttttaaccacttggaaaacgtgtgcacccttgcagcctcctttatcttgccgtgcactcccaccttctggtcatgtcaggagggacagtatccctgaggaaccacacttaaacttttccattttagaaagattggtcaatcctaggcctttgttgtatgcgtaattcgttcattcttatactttctaatcccacaggctttgacttcggaaacctgtgggttataacaaagtactgaggaactgtaatttaatctgttcagatctaatattaaatgagacccagatttttttttctagtggactgcaaagccacatttattgaacatctactaggtttacatgggagtccttttagctgtgaattccttattggtaagggactatgcccaacagtgtacctggcacatagtaggagaactatgaatatgtgttgaatgaaggacattggtgaaaaccagggctgtttaggagtgtcctgtcctgaggccactccagatggaagtggttctcccatagcctaacacatcccgttctttcttgaactataactcgactttcttccaaagatgaaggggaaaggtatcattcatctgagatttgccttgtggtgtttaccgagttagtgggtgcagcgcacaaatttgttttctaaggaaaggctggtaaagcattgatgcaaggaaaattattcttaggtattcttctctgatgatcatagactgaaacttttacttttgtatagttaccatagccatgaaaataatcactggccgacatttctagtggcaaaaaaatatcaacctctagaatggtctgatgaatatcagggagtagggctaacagaaatgtaatgccagctgggccagcagtgtctgccaaccccaaatatttactcagcatcttactatgtgtaaaactcatgatttttcctggcttttgcttgtttcttgaatataatcctgaaggcagaatctaagttttgtaactgatgatttatgaacattatttttgtctagaagaggtgatattcctacctactttgaaatcagcttggagtgcagggataagattttgatggtatgtggcacacattagtgctcagtaaatgtagaaaagagaacagaaaaatgacagaatgctgggaggaaggaagggagaaggagagggagtaatcccaggcctgggctctggcatcagcctgcagatagtccaacaggttctgtcatgaaccagctggggagcctggtgacattcactaacttctaactcatttagctcatctctaaaatgagataaaacctactgtgtagggttttttgagaggcttaaatgacataatgcttgtaagtatctaacatagactactcaataaatactggtttaatttaatgaataatatgtttgtgaattccagtaattgtcttgttgagaaagcagttacctgtttatcttccttgactttaaaatgagtccacatcagttaatttggattcccccagagtggagcgagcaagcacaatgacattctcagaagagcagacagtcacagatgacagcatcctcagggaacacccctccctgagtgctggcagtaagtcagaggattgctgtttccccagttgcccttcggtgtgagttcccccttaccagtcataattttcagcattcccagaagagagggccagattctccttccctttgtgtttgcctgttttcttctcagaggaccatgtctgtgtgagaacagggcctttactgagaccaggtcttcctgaggcctttgcgtggaagtggaagagacacaaaatggcaagggcgggggaagggcagtctggcaggttggccacagctcacccatcaaacttcagggccaggtgttagcattttccaacaccttggtaagtcatgttttcagcaaatcaagaaactctagttctgcatctttgagagacatcactttttccccctaaggttagcttttctcaggatggggatacattttcaaaatcttttttaggaggaggcagagttacagttaatgagtgatattggagactgaggggaagttggagtttccccggtgtttttctgaaggagttaacagcacaggcagtttgggagatctacgggagacctgctttggaaggtccagctgtctcctttacatcacccccatttctgtccattgaacgtggaagaaaagggaggccccagcttctcacacttgctcatggttagcatgtctgcacacttactgtgtgccaggctgggttctaagtgtcatatatggtacaccacttaatcctcaaaatataattctgaagtacatagtatttttatccccccctacagaggaggatccaaggctcagatagtaaataaatttcctaggctcaaacagttacgaagtgacagaactggttaaaaaaaaaaaaaaaaaatccaggcagtctggctccagagccttttctcctagctggggttctccgctgcctgcgaagtcgttagtcccactggaggatctcaacaagggactgcaggagttgaaagtgaatgtagcgtttctcttcccccgcttttaaaatatttaattttcaggaaaatttcaggaacaaataacattttttcatctcaacaagaccaaattgcctctatggactatatggcggctctgctctgcattttccataaagtgatatgtgctctccagtggagtcgcatcctgttgtaggttaggttcccagggagcattcacggagttggagtttagcttgcaggattttactagggatccctgctgaaggggagtggccctggggaagtggaactgcaacacaggcctgacacagcctctgccagtcacttgggtcatcatggagtatataccgtccctcagagcccagtcctgtgctgggctgaaagggtaggacctttatacaaaccctgccaccaccagtgggtggatatgggccacttggaagagggcttctccttgggcaagggagctcttttcagctgaggtggaccctgaaggaggtgacagctgcaggctgtctcccaacagcattccccatcactgaggtagagttctgccttgagcaggggctctaagtggtggatctttgcttccattatgacactttcattttcattgccaatgtgagtctactcattggcaagtgctttctcctaactcagcctcttgtttacttggattcaagataaacggcatttacaagattgcacaaaaagagagattctcaactgtctggtatccttttactgtagctctaggcagaggcaaaggtgtaatattgatagtctctttggagcatgtaataaaaagcatgcctggcattttaggagatacatgaacaatttgttttatcctcatgatatctttcaagtggcaccagttggcttttttctggagccggagtccaaagctaaaggccacaatgcagtgattgaaatctccagttacatttttcttgccagttgtctttagagaaatctttcagtgattaagattccagatttaactcccttttccttagtccttccatcacgaaactaaagctgtcttccagttcactccagcatggacattaaactgtaccccactaacttacatcttgtaacccaagctgatgacaagagctgggttggcttgccttttagggtttgttactgttgcatcccattgatgccctgagctggcattggccggtgactgtctcacctgcaggatttgcaaaacctgtctccatttcccttctttcaggttggaaagcttatccaagaagcagctggaagaagtaatttgaagagagtaactctggaacttggaggcaaaagtcctaatattatttttgctgatgctgactgtaagtcaactacaggtcccatacatgaaccaccacacaccctttggtgctctcttttatatctccacttttgatgggacactagcaaaagatatttgaagctaagggcaatcaaaaagatctcctctaaggagaaaatggtttaataatggggaaagagcacttttcagttgacgactgaaccagttgttttctagacactaatgagccattttgaatctgtgatgttgtagaatagggggatgagatgaaggcttggtcagtggcatatggttcaacagcagtggtctcagctgctgagcacctgaaggatagtctctctgcctagattcaataaatctgtaacttttcaactgtgcctggtggctggtagaccattttaaataaatccgacttgaccagccctgccagcattttccaaacccacagccccttctctgtttagtcaattccagcccctttctgttgctcgcatgactttcagttaggatgacagcacacgtgggtcagttcggtatgagtagtcctaaagctgggatgattccacttgccagtaggaccttacagaggcttagagaagtaactgagaaaccccatgtctctaggaaggatgccacctaggccattctgcacaggtgtgacgtttctgtttgaaaagctctccaggtaaggaaatcccaccatctcattcagtgattcttttttttttttccctccacttgttgccaggcagagctgctttcccagtctcaccaccagagagatcagaaaaccaaaagcagattgcttgaatttcagcaccagcttggaatttgcagagttcagctttagctttatattagttgtcaagaaaatcagaatccttatgcctgttcctcttgaggagtaggaacttcatctccctaacattgactgattcatttattcagtcagtcggtcatttagcaactaatgcacgtcagattaagctgttttgaagtgtaagatataagggatgaatatggaagagttatcataggattttacacaagtccatgtcaatctagaggaaatttagtgtcttcaaagaagacccattggtgttacggtttaatcccccaagtaccaaacatacagccccaaggccctgtagatttaggagttgtaaattggccaaatacaaaatatagacatgtttacctgtctaaacattacactatgttcaaaacaagaactgcacattaaaatattgatttctgtgaaaattgagaggatctggcaacctggggctcatatttatgcatggcaatgattaaatgtagtggctttccttcttagcccctccattacattgctttaccacctggcagactcatacctgtaccttatctcccaagccctgtggtatataggggtttgagactcctgttatacacgaggttcagtacctctgtttgcagaataagaaagagacccaaagaagtgaagttgttcaagttcacatagcatgtcagggtgtagttagaactagttgcattcccaatccagggctattcatggttatgtcatgcagtgagcacactatacctagggctttggagaggggagggaggcggcttcatagacaggcccctccccaggcaaagcggtgagaacatggctgtttcctcttgtagtggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcgtagtggggagtccctttgaccccaccactgagcagggtccccaggtagaaaaatcataaccattccctttgtttacttaatccttgactggcacagaactgtgtacactgtagtaggtcccagcaaagcgacatcttccttttcggctgactcctttattctccaccatgtcttcgtggctggaaatggagccagagagggattgcttatttcttatgcttctctgtccctttctaagttttatctctgaaaaactatgggattaccattactttaagaatattctggccgggcgcagtggctcacgcctgtaatctcagcttttagggaggccgaggcgggcggatcatgaggtcaggagatcgagaccatcctggctaatatggtgaaaccctgtctctactaaaaatacaaaaaaaaaattagccgggcgaggtggcgggtacctgtaatcccagctactcgggaggctgaggtaggagaatggcgtgaacccgggagatggagcttacagactgtgccactgcactccaccagcctgggcgaaagagcaagactccgtctcaaaaaaaaaaaaaaaagaatattctgacctttgggactaagctggagtctctcagttctaaagaaagccatgagtatgacaagatgggtctggacactagaacccagtcccagtccttccaatcactgaactttaggacatccctacagatgccacagtcaaggagggtagatatctttctttcctagagccatctatccttttacgagctgccaaggagtctctccagcagcctgaaccagtctggacagatcccttgtagcttgtgaaagtgtaggaagtgaagggctggctcacttcccttttgctgtatggttatttcttaatctgaaggcctcgtgtactttagtggggtggggagggccacaaagtctctcctgaacagcctcctctgcaggttcaccgtaatcatcgaggcatatttctaaagggaattctggttttaatctgtagacaggttctgagaattttcagaaggaacctggaccagctcttatatgggtcactaaagcatgggtttagggattattcaagagaagattgatgttctggctgagccattcaaacttgggtaaatgtaggtttttgtgttatttaccataataagcaaatgataactccgtcagttttttgggggaagactgaccttgtttttttttggactaggaagctcatccttcactctttactgttaatattttcctctaaagttcctctaaaagtgtaataggaattcctttaaaaacaaaccacaataagattgggtatgtagcactatctaaaaaggctgtgtgctaatttttgcctctttttactatcaatacaacttgctaagttactcatttaattataaaagtcaattttccctcatatgaacattgaatagtaaattagccagtgtctccatcattttgaaacatttttctaaatgttcagctggtacttctgattaggcaatatcatcagagcagtacatttattggaatcgtcgatatattaggattaaccatacaaaattgccagttttttgtaggtcaaaaattggtaagtaacagcagttttatatgatctgactgggtgtagttaaactttgaaaaaaaccctaaaatgaaagattctcaagaacatacttatttccattttcatagaaggttatatttggagtcattaagtcttgtctcccacagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggaggtatcaaatatgctgttcttacaaaagccacatctttcttgggatcatttctagagcatttctagtggatgatattagagttttagctctttatattttacatatattcattttgcaacagtaatgaacatggctatgaaaattccagtttcaagaagaaaaataaaccaaaagacaagcaagctaggtggaggccaggtgacatgctatgtgcttatgattattattagccaacagaacaatcagaatagcctgccattggcctcaacaatacactggcaatagttcggctctcctaaatgtgggtcactgggatgttaaccaggagagagaatccactgaagcatctttacatctgtgcaagagagggacaaggagcaaatcagcccacagtccagagcattccgttctggagcagtgtttgcaggatcacggaggatgccacttgctcttctgtacctaaagaagacacccctagtatacacagtggaatcaagtgatgctggagaggttggggaagttggggaggttaaacactaatgtcagactcttcttgcataatcttatcctaggaaaggttgggagattttacagttttgtactgctaaacttaaaggtcatttaagtaatcaaggcagagtaaacttgcattgaaatgtggaaagcaggtaaaggaatgacagagcaaccatgttgagtcatattatctttttgcagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggtaagatcagagtcagtcttgtaacaaattccactggtggtatagggaccagggtgaaataaacaagtatctccttggaaggatggggaataccaaaagcaaccaaagttcaccagaaaaggggtacactccttactgcttagatccagaaatcaaagtagattttaaattacaattttttcctctggaggaaaggaatttaaaaataaaacttctaaaagaaataccatgccagtcagattatgtgctcagacttcacacgaactcacagtgctatgttttcttctttcaggatcaattgttacaatgccttaaatgcccagagcccctttgggggattcaagatgtctggaaatgggagagaaatgtaagtcttaaagttgctgatgcctgcagagaaatagattgcaaatatcagcacagagcagtacttaaaaaatagtttaattatcttacactcatccatacattcaacaaacatttcgtggagcacatgctactataagctaagttctattacatgttatagagatgaataaaacacaattccatttcccaaagtgagaatggaaaaaattaatgtaccattaattccctgtagtaaaggctatgattagaagtatgttaaacattttgtcagtacagagaaaaatcaattaattttgactgctcgggtcctagaagacttcacaaaggaagtaaccgtttttcctggaagtaacatccaggaaaagaacccactttccctccttttgaaagaaactgatctgtatttgccaaatgctgtgactcacagaggaaacatgtttcatgcccgttccctcagccattactgaatgcctatttttttgagcaaatgcctagttcacaatctaacaaatattgagcataaatatgtacaaagcactgtgcttggtctatggaggaagatgcaggtccttaaggcatttaatatgttttggggtaaataaaactaataacattgaaagaatcagaggaatcgcagaaaagactgtaaaccaatggaggagctcagggatagggaagatcactgtgaactggaaaaatctgggaaacctttagatatgatctgctacagggatttgtgtcagcctttcaagaagaggaatgcttggatagagaagggggaatatattttcaagtttgtcgggcaaaacagggtagcagtgggggagagtgagtaaaggtattgcgggaaaaataacggtagtgtgtgtttgtgggagaaatgcagtgaaccaacaagactagagcagaggatttacatacttcagatagtttcactggtaatttcaagctcccaagcaaaactataaagtaggtatagcttggagattagagcagtttctagaatcacactgctcggatttgaatcctgccactattactacctgtgcaaccttggacaaattacttaatctaagcctcagttacctcatctccaagatgggaataattatactacctacctcagggttcttgtgaggattaagtgtaaggattaagtatgcaaacatccaacagaatatctggcaagccttcagaaaatgttagctgcaatcatcattattcatcaagcagattagtgttatatagatgattcctctttttcttaacctgtaactttggcggaagtttccccaaattccagctggtgtcaccaacttctgttctgacagccagaacctataaccaatctgggtcatatttgttcagttcttagtattccttcagcttttacagagtcttcatgcactccaggtatgtcttcatttgcttttgaccttcaccttctgcttccacttttcaagatgcattccgcttcttatttcatttccttcctctatgtctgtgctctcccagtctctgaaatgctggggtcagtcactggctctgggaatgctgcttgcattgattgttttgttacagatcattaacagggtgaatcatgagcataaaatatactttcaataaatgatcgctggttgatggaccctaatcccaggctaatccatggtccctcattgtgggcacacttgttacattagctgagtctagtctattcccatcagaaatgttctccttgcccagaaaggtggtccaggagacagtttggctctatctgaacctcatataacagtgctcaagagaccgaagaaccatttctctctacttgtcttccaggccctatggtgattggaccttctcagtgcagttaaaaaataattaggaaatgctgttctttgatgagacccactgcatcttgtctagattgcatgtttgtttgtttgtttgtctctacttacccccaaaacatgttttctctttcttaaatgaccctgagtgacagaaaatgcttcaaataaaagaagctgctctgtcttggtccccaactcttccacctcatttgatacagcctcagaaactccacttaatcctccgtctacacagaattatttatctcatggcctgcaaactccatgcagctttggtccctgacacctccctgtctatccctaagaggagcagagacgtgaagtggcacttccagaaacatctggaaactcccaggagggctgacctagcccacgaggtctccccacagagagctgtggggagggctgccctcttaattcccaggctcagagacgagcttttctcaggtcctcctgcccacctatttctgcctgtttcacttttcctgtcctttttcttacttccttatcaaactcccctgagatgaggggtggcaaagcacaagccataaaatgtcacaaactgaggagatggaaagaattctgtgaacctcagcattttaaaaactcaggacactggctttgaaaatgagaagcattgttagatactctaaatcagagcttgtcaaatttatgtgtgtgtgtgcgtgcgtgtacacgcatgcatacagagaagtcacctccagtctgggtgatggttttgttaagcatgcgtatctagggacccactctcagagattctgagttagttgatctgcgataggacccaggaactgcgtttttaacaagcttccagagtgactccagtatacatcactgcccaggacccacagagaagcacctccgttccagcagggttttacattgcatcacacacccaaacactgggatccaccagtcacccttgaaagcaacctgccttccggtgacccgctcccacccaccctctcagtcctgaccacctgcaagctcctctgatgctgatggtctggagactttactccgctctgaaaaatgctgctgcaagtcaagtaaaagagcaggaaaatatataccctaaacagaaactcttacttgttttatgagcaagtctgagtgagtcctaaaatggctggcgaagagctaccaatactgactgacaggttaccttaaagcctctaggtgtgccaagtttgatttatcttagggactagaacctagtcttctaaatgtgattttgccttgctgtttcgtcctgatgtgaaggtaaccacacagagagattgggctgcatcagtaatgatatgcatacctttcgtgcatcagtgagcttcttccctgttaactgtatgtgccacaaaatttagctggagtaaataaatatgcgacagaaatcctggaacaagatggtgaaattgcttaagaatcgagacttcagggctcaatgacctctgagcatgtttcccaaagtgtgacccacatgaccatctgtctctcagtctcctggtccctccgtagagcttctgaaactgaatctttgtggggtgggggtagcgttcaagaatcaaaagttgaaccaagctctttgggtgatacttatgtatactgaggttcaggaactgctggagagatgactgggcaccaagaggatgacagtgactcagctggcatcccttagctggttcatggcagagctgagtgggcactcctgtctctgaccccagcttcagtgctctttatctcctccatgcctcctcagtcgtgctgctctaagactgcttactggctttccttcatgtcctgggcacagagcagttcttttggtagcagatttgagtccacttcccccgtgcacagatcactgctcaggacccagagaggagcagctctgctccagcagggttttccattgcatcacacacccaaacggtaggatccaacagtcacacttgaaagcaaccataattgtgaggtttctgatgctgtagacttccttacatttctcacaacctagttagagagtcacatgggggtgaagtgtggctcgcgacctgccccaacaagtgcgtgcagaagccaggaaacaaaggagtaaattcacttcaaatgggatgcacatggtgtccgtgatgaagagacacattcagaattgcccaaggacaggaaaatgaccagagagagccagagctgagctggtaataaagagactccgagactgagtggagttaatgagggaagcatgcaacgagtggggcaatttcagttggtttctctcattgctttaagcgaaatgaactatacggacaggagaacagcctgcttgccccagtctctccttggccgccctctgttgtccctgtcaactcaggtgcccacggtgctcagaggaggtgctggcaaagcccctggagccttatgtaggccatgggggctcctaaaaggaacctgaatgaatcatttacagcaggtctctcttgtaaagcccagccacagtaactcgtacactgactgtttcaaaagacagcctttcttaatcatttaattgtttcatattcaaatatatctcctaattgtttttattttttcctgatctagaagatatgacaacagggtagaacttgggaagagggaataggaagctcgcccttcctccttccctcctcccctctctactttccttccttccttggtcatcaggtaccttctttgtgcctgctgttgtaggctataccctatgtttggtggaaggcaaaaagaaaaatcagtaggatacaactcagtagggaagacagagatattcaagccccttgtcctcccagtgtgataagtgtggtggttgaggtgtgaacaaggggctctgtgaacagagaggacgaaagaggagctcctcctgaggctgttgggaaaagcatcactgaagagtgactttcagaagaagagaagaaaaagaggagaacatgcgtgattttataatgaaatagattagataaggggaaaaaaggcatttaaacaaggcaaaaagaacaggagaatagagaagagatgtggaggagaaggagcactgtagtaaacacgcagaaggacaggaacacttagacatgcaacccactcccaccctccgtcttgggggaggaaagcacactactgtcccaaagaactaatactgaaccagtgctgccttgtggagagaggcatggccaaggcgttcagagacctgggcctggtcccaccgctgcccacagcactcagcctctgagcacagcctggggtcatctgtgtgccctctggccaaggctgatggtagttctctgagtaattgagagtcattgcctgtctgtgcagtattgtgaaaacaagtcaccttttaactttaaaactactttaaaaaactttaaagttttaaaaaaacttctttaaaaactactcatgagatgacagtttctctgaccctcagaggaaggctgggctgcgcatacgtgaggaatttttacatgaacatcccaggacttgctgttcgcaggtgataaactgcacctccccaggactcccgctgcactcacatgcagctccctggacttctggtatctgacccggcccatttctgtgtttcaggggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggttgtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 36894 - DNA, 4478 bp, Homo sapiens
cagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcatctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcaggtaagaggtatttttaaatccagctttaagtatcttgtccatgtaatccagacagatgaatcttaaattaagcacaatgtggctgttcactatgcttacccatgttactttcttccttcaaaaataacccagtctcatcaaagataaacatctgtgaaactatggtcatggcaatcttcatccagcaagtgtgctacttgtcttaagaggatgggagatttactaagcacttttgaggttttaatgagcatacaatgagtccacagttaaaatatgctaggctatttacaaatgtagaaactgaaaaaaaaaatcatgatatgaatcagaacaaaatgttattcagactgataacaagccatattcagtaccaacatggcaagaaaaataaattttccagtatgaaaatgggacactgcttgcctctaaggaatttctgaattgtacctattgtgtaccagttcagagtgtatttatttattagtatttatcatgagttaaacaaatgcaggtgtgagtcagccaaagcatggctgaaatacatggaaatcacatagtctaaaagaggagggcacacttacaggaatacatctatataattccagttagttttcagaaaggaataattcgtgtacagaaatacaagactggagaaattccaagagaacaaataattcaaagttaagtatatgggtaagcctgcaatatttcatatttaaaataaaaaattttcccaagattttgtaagagaacaacataaaagtgcagagtgcatctatgtcactacaaaagccatatctgcatctgacctcttctcaaataactgtgcctctccctccagattctcaacctaacaactgataatgccaacatcctgcttcagatcgacaatgccaggctggcagctgatgacttcaggctgaagtaagttaagtgatcgttgtataatactatcacaacgaatacatcagtggtttttaacaatgacttgggatgccctcaataacatttacatttttctgaattcacccaaagttaaatagtattggagttatctgagaaattttccatgtcagtgttacctttttggcaatattaaaggaagaaaatgcattttaaagtaactgctaaggttttttccattaaaccactattacttctaagagaactgtacatgacaaatattgccattacatgagatcaactatgtagctgctttttaaatagtctctgcccagatacatctcccctatataagttataaccagtattgatatcatgcttgtttcaggtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggtgacacaaaagttatacttttcccagccaaaagagagttcattatggtcctcgtgtagccaataaatctttctgttcctcaaacaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaaggtaaagtaatcttccttatagtgaaactcatggaggttttatcatttcagaatttcctcacccttttccttgtttttaatactctagagcaaggaactgactacagaaattgataataacattgaacagatatccagctataaatctgagattactgaattgagacgtaatgtacaagctctggagatagaactacagtcccaactggccttggtatgttaactctcatgaaatgacttcaactttatcatacaaagtttcatgctcacctaagaatatgcaatgcaacaaaaaaatgcagagttggaggtaagaaagagaaaacaaagtgaagctcatgttaatggaggaaaagtactactagtgttgatctaaaagtgctgaaactgaaatggtgccattaaacatacaacaaattctgttcattttcttattcttctatataatgccttactaaataatcaaataagcgtcaccatactcaactgaacaaggaagtcactaagccacaaaaaaatccgtttcagaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaaggtaaattttaaaatgaaaagttatcccagtttcttttattcaatattccagatagcaaggcttatctaaaccccaagaagatgccagagaatgagaggaagggaggagagagggtagagtacagaaaaaggagtacgcaaccgcaatctcactttctcatgaatttggcccaaaatgattcttaagagttctgtgaacttaacattgttttcaaaggatgggttttaaaatatatacctggcagggttttattttttcaacacgttttgcttattttctaaattaacggcaactggaaagctacccaccgttttccaacgttagagataaccgaatgtgacctcaccccgtttagttccggaggcggcggacgcggcggcggaagtttcggcggcggctacggcggcggaagctccggcggcggaagctccggcggcggccacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaaggtcagcagaaactagctggggtaatcagaattagttttaacttcctgtgatggtttttttgcgctttaagctctagagttgttttaaaaaattaaaaatcttagagacggttccgtttgcatttgttcacaaactactcttaacaccagccgtgaaaaatggcatgatcaaaatgtcataccttaagcatttttttgggcttaacaatgtaaagttgaaatttccttctttttacaatatttgcttgttaattactaaggatccctacagactgtttaaaattttttttccatcattcacacagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaact

SEQ ID NO: 36895 - DNA, 5726 bp, Homo sapiens
caaaagcaacccttcttgctccaggcatgtgcaggaggttttttggtttcagcattttgttgcatgctgactatgtcctttaccttctcttaaattatgtatcaattcatgctggtttattcacttcctgatgtctatatgaagaggctgtctgccaacatctttcatcactctgcctgcaactatgaaaaatttagttctaaaaaatgcaaccttgctaaattgagtactaataggattggttcaattatgttctatgtctgttccatattgacattgtgtgcatctttgccatgcaggctttttaggaattatcgcatctctaacttcccacgagtgtttatgaaaatgtttagatttaaagaactttattgctttagacagaataaggcatgcagttctaacagaaagatccatgaattccagaaatatcactgaaaattattgacatttaagattattttctgtttgttactatggttcacaattcaagaataactctggccaggtgcagtagctcacaccctgtaatcccagcactttgggaggctgaggtaggcagatcacttgagctcaagagttcaagaccagcctgggaaacatggcaaactcccaccattacaaaaaaatacaaaaattagttggtcatggtggtgttcacctatagtcccagtgacttgggaggctgggatgggaggatctcttgagcccaggagatgcaggcttgcagtgagccatgatcatgccactgtactgcagactgggtgaaacagcaagatcttgtctgaaaagaaaaaaaaaagtaaaagaaaaagaaaagaaaataactcccattgctaaagacatatatgcttatcaggttaagataaagtgaattttgttcttcccaatgacatttcaggatatttgttcacaggaaagaacatgttgggaattggtactggctagaaatttctgttgagtatttattaccccatggtaataatggtaaaccacagtttagaaagattttttttttgacagccacagcatgttccgaagagatgattggaagatggaagtggagggttaaataatgaaatgcagctaacatttcggaaagtttctaaaagttgtacaacatgccctacagctactctttaaatctccaaatcaaatgaggtgagttcatgtgaagtgcattttacagatgaagacatcaagggtcatcagggttaagtgatattctaaagtcacagatgaaactttggagctaagtagaggacactgccacattcaattaaaaattataaattgcaatgtttattcaaaattagttgaaacttagacacatgaaaagtcccaagaaactctggtccaattacaattattttttctaatagaagatctggagaggcctcagaaaaggacccatcttcatcttgccttcagaaaatgcatttaacatagtagacagggaggagaatcaagttagaatgaagaaagttgtggagggttctcccagaaacatcctgggtttcttgagtgtaccacttggaaaaccagtgagaaattatcatgtagttgtaacttcaggcttaatgtttcttcttttttaactctatgtggaggtaaaagaacataagctatgtgtatatgactgtaataagaaaagtacaacaaaccaggagcttgaaacaacagaaataaattttctcccagtcctgaagaccagaagtctgagatcaaggtgactcagagacatccattctctgaagacactaggggaatatccttcacccctctccctgctcctagtagctccaggagtccctgcgcttgtggacacaccactccattctctgtctccatctcacatggccttctcgtctgtgtgtgtctcctctgctgtctcttataaggacatcagtcactggagttagggtctacattaattcaggataatcttattgcaagattatttatataattatatctgcaaacacccttattctaaatcaaattttatttacaggttgccagtgttaggacacaggcatactttttgggagctagcattcaatctgctgcaatgcacagcagaatgcagaatgataaatgaatagctgtgtactcatgactaacttaaggcctagcctgtcacttgcctctgaggtcttttatatccaatctcagatctcacatataaaagctaagatcctgtttccagcatctgtccagaacccaccttgttaggtctttgaatgataccactgggcatcatgagttgtgaataagtccattgaaatttcattattttcaggatttccccttgtattagtctattctcttgctgctgtaaggacatactaggtaatttttaaagaaaaagaggtggctgggtgtggtggctcacacctgtaatcccaggactttgggaggttgaggcgggtggatcatgaggtcaggagatcgagaccatcctggctaacatggtgaaaccccatctctaccaaaaatacaacaaattagctgggcgcagtggtaggcacctgtagtcctggctacttgggaggctgaggcaggagaatggtgtgaaccagggaggtggagctttcagtgagccgagatcacgcaactgccctccagcctgggtgacagagctagactctgtctcaaaaaacaaaaaacaaaaaaataaatacaagtttaatggactcacagtttcacatggctagggacaccttacaatcatggcaggaggcaaagaaggaccaaaggcacgttttacatggtggcaggcaagacagaaagagagccaaaagaaaggggaaccccttatcaaaccatcagatattttgtgacttattcactaccacaagaatgggaaatctcccccatgatttagttatatactactgggtccctcctacaacaggtagggattatggcagctacaattcaaaatgagttttggctggggacatagtcaaatcgtatcccccattcattttgaaacacaatgtttcacatctcaatgtatcctcccacaagaacaaagtatgaaaaaggaacatttactttaaaaaaatggagctgcaaggttgtggttttggggaagttacagttttgcaaggaagctgcaagacggtaagactttcgcagtaaattttacgaaaacgtgaatgtgtcagttcaggtaatccagcaagggcaatgggagatagaaaagaagacataggaattggctatgtgatcatggagctgatgaggcattcctgaaatctataaggcaagaaacgctagctggaattctcagaagtgagtggaagctcctgtccatgagcagaatcttctccagccagggaagctgcacctctattcttaatgccttttgctaacagagtcagacccactaagatcacatagaataatctccattactttacatcaacaaacaaggggcttcatcacatctagcaaatgacttcatgtcaacctctaaatttatatttaattataaggctagacccagtagcctagcctcatgggcacataaagctgaccatcacagtgatgataaggaagatatctattctttaactgaaaatcctatttgagtgaaataggagtcaatatcaccagcacctctaggaaatacaaagaagttaatgtgtggaggaagtttgaagtcaaacagaggaacaggagacagattatttgcacctatgacagggttatcattagcaaattcctctggagcatatatggaaatgcccaacacatacccttctcttatgacttgcaggaggcaatgggataggttcagtttagcaggaaagggtgtctgcctcatttatgtctcagagtgctgagggtgcttgaacaaaatgccatagactgggcttcttccaaaagaggtttagctgggcatagtggcttatgcttataaatcgcagcactttgggaggctaaggcaggattgcttgaggctaggcatacaggacaagcctgggtaacatagaaagaccccatttctataaattttttaaaaattagctgggcatagtcacacatacctgtagttctagctacttgggaggctaaagtgagaggatggcttgggcccagagttggagtttgcagtgagccaaggtcatgcatgccactgcactctagcctgggcagcagagcaagaccttatctctaaaaagaaaggggtgggggagagagagagagttatttttgttagttttggtggatactatcaagtcaaagatcaaggttctgatagatttcgtccctggtaggggctgtcttcccaggtttcagatagtcatcttcttgttttgtcatcacatagtggagagggaaagggagagagagctctggtctcttctgctgtttataaggacactggtcccatcatgggaactctatctttatagtctcatctaaatttaatcactgaccaaaagccccatctgtaaataccatcaccttggcagttagctcttcaccatgaatttttaggagacactaacattcagtcaatagcattctgcaattttgcatttccttcatctctgagaaacacggccctgttttcaagtgcagttcttaagtctccatgactgacatctgaccctctcctctagccttacccagctgactaagagtggaacaacttgggtgcatcaaatgactttttccagtggtggagggaggcagaactcattgctccaggagctgtggaggtgcacattctgtcacattttctagaaaaaggatgaaaaatagtaaagaatcaggaagtcataggcatgaggctgagaatcattctttgatctcctgccatgtcttgattctagcactttctgaaatccagcagttatctagattttacgtgtttgtttgtttgtttatttttgagatggagtttcactcttgttgcccagactgcagtgcaatggcacaatcacgactcaccacaaccttctcctcctgggttcaagtgcttatcctgcctcagccttctgagtagctgggattacaggcatgcaccacctcactcagctaattttgttgttgttgttgttgttgtatttttagtagagacaggttttctccgtgacggttaggctggtctcaaactcccgacctcaggtgatctgcccacctgggcctcctgaagtgctgggattacaggcataatcctgagccaccacatctggcctatctatacgtttaaaccaatatctatgtttgttttgatgagtttaaaatacttgtctgcttatgaccaattataggcagaattcttgttccttagccaaattcatatgtggaaatctaactccaaatgtgtcctctgaaatgtatatgttgaaatactaaacctcaatgcaattgtagtttcaggtggagcctctgggaggtgatgaggtcatgagagtggagcctcatgaatgggatgagcactcctacaaaaaggattccagagagctcgcttgctccttccacagtgtgaggacacagagggaaggctctgtctatgaatgagaaagtgggtccccaccagacattgaatctgccgcatcttgatactggacttccagtctccagaactgtgggcaataaatgtctgttgtttattacctgtccagtatctttggtattttgctatagcaacccaaatggactaagaaaacaccagaggccatacctaataaaaatattgacatcac

SEQ ID NO: 36896 - DNA, 66213 bp, Homo sapiens
ggggcgagagggggcggagcgtggaggcggcagctggaaccgcgcagcgcacgggaacgcgtcccgctgcttgggtcaggttcgccggtcgcgggagccccgccgtgcagtcggaggtgagtaccgacgcggcccgacccacgtccccaggcgggagcgccgtccaccctgtatccctcgagagtcggtgcgggcctttaccgaggtgcccgaggcagtggcggcacgggggacacggaggcgagcttggggaggctgagaggagaatcggggacgtgtttctggcgactgacgtctccaccctgtccccagtctatgtcatgccggggagagaaaccagggattggaagtggctttcctagacccttcttagccttggctgtgcgtgctgtcctgaaagtccttgcctagggtgtgcggccagtcctgggagtcctaaccccgagggtgtgaggcccgcactgggagtcctcgcccaggcccggctggctggatagggaaacccttgctaaagttgtgcgggcagatccgggaatccactccaaggggtaaagggaaaatgggatgagggggaagagacccttcgtgggaggcttgaacacagagcccaccatgatagattcagagatctagaaaggagcttgggctgcagttatgaccaagtcatttttttctagattcagctagcacatcataatggcatcttccttcttgcaacacatgtaactctcttccctgggggacaacctctaggacagaagtccccaaacttttctggtactcagtactcctttacactcttaaaaattagtatcttaaggagcttttatgtgtgttatatctatccatatttataatatgtaagtaagactgagaaatttgtactataataattcatttaaaaagaatagtgaactaattatatcttaacattgcctatttttatgaaaaagaactatatttcccaaaacagaaaatgattgagaagagtggcattgttttacatttttgcaaatctctttgatgtcaagcgtaattgaagacagctggattctgatagctgcttctgcagtctgttgcaatatcacatatcatgtagcctcttgagacctccactgtatactcctgaaaatgtgtgaatgaaaaaaagcaagtaacattttattactaggaaaatggttttgactttggagatccctaggagttctctgcaccacactttgaggatgctggtgtaggaaatgcttcagaggcttcattcattgggcctgcttcttgtttgtgatccttcctctgattgggaacacacaccacctcatgccatggacagtattaacctctggtatctggaaccaagtttgatctcactttggaaaccatgtactaggtccccacgtgaggctgtgatgaaccttgccagcctcctgaaaagtcagcaaggcttcgcacatgcctttggttgtctctgtgcttgcagagctgacctgtctgtgcatcaggattacaacagtgatgtggcaaacaggacctgtaggctcacaaaagtgccagtggggagaccatgccaagtgtgtaggggttcctgtgagagttaccaagtagtcaggaagttatttccaaaagaacaaggaggcatgcttttgccttcccttgcacgtgttcatttctgtttgcagttgcatggttattagccttgagtttattggaataatgatttccagtcttgacgttctttcactttccactttcagagggtgtcactctgagtggtgcttcctcagcccctgtcaaaaagcagtttccaccatcctggagtgtggtaggtgaggtccttcacgggactctttccttagcttcgtgccttgtcagaacaagttcaagacagatgttatgtgtatatatttgggaggaagaaattttctaactccatcctcccttttgttccttcatccatagagcctcttgtgctctgatggatcagtttaaatgctacagccgatacttgagaaatgttgcatgcacatgagcgtgttgtgtgtgttgcacagtccacaggtgaggaggaggagaagtccacaggagaaggaaatgggatctaaactctgagcacctgctgtgttctttgtattaaaaaattccactttgatggtggggtctcattccttcattctttcagtagatttttattggccacctatttctcatgtgtccagttatgtgcgggatgccaggaaagtagtgagcacaaaagatgcagtccctgtctttctggcaattatggtctgatagctttgataactgctggttaattgagatagtctattatatagtcagagtgtgtacatgaaagctggtcctgtgtgaagagcagtaccccctacctaaagtgtgcttcaaaggcatgtgctgaagaaaccagtcccacactgtgaagatgatgataaaaaccaacgtgtatcaccacgtgcctggcaaagaacttcctttgccttctttcccccactcttccttctacataggaagtaatttcctgtgaggcagccagattcacagggaaattacctccaacctggtgccagtcactgggccagcctcgggttaagacactttctctgggtctcagtgtctttgactttaaaatgaggagttaggccattgatagtaagtgtcccaaggagccagtggtttcagagctggtttatactagcatttgtgcatatctcttcctaactccgtgttcagtggcaacacattttttagattgaaataagccatggtgggaataataacaccatggaaattggcaaatgctacatcagagcttttttttcctcttggagttcaagttgttaaacctttgccagctgacactgctattgtctgagccaaggtgcttttggtttgtttttttagtagaaaacagactctttagcctagacaaagatcctagatatagggtgtatgattcaagtcctctaaaatttttgataaggaaaaaaatctgttttcatcatattctaaaatatagatcagcaaactttttgtgtaaagggacaggtagtgaaatattttaggctttttgggttatggttatacagtttctattgcagctactcagctctggtgttgaagcacgaaagcggcaatagacaacatgcaaacaaacaagcatggctgtgttccagtcaaacttgatttacaaaaacaagggccagccatagtttgcagactcctgacctagactatcagaacaagaaccatgtttcaaagagagagttttatggaaaaggagattcttcaggactttatgcgtgaataccagaaacttgagtctccaagatggacgtagcgggcagtagtaactgtagaggatttggaatcaatcatggaagactccatagtaggttgtttaaaggaaggccaagtgtgttgaagttttgaggacagagccacatatgggtcttattcccaactccctccctggagccatctcagatgttatgctagaatggatgtacctgcagtctaacccgttgtgtgaattttgcatattattatgcaaaaactagtagtgtctctaagagctgtcttgattccaggggcagagacaaaggaaatgttaaaaaggatggaaaggcccaggcaccgtggcttacgcctgtaatcccagcactttgagagtccagatcgcttgagcccaggagttcaagaccaacctgggcaacatgacaaaaccccatctctaccaaaaatacagaaaaaaattaaagccaggtgtgatggcacatatctgtagtcccagctacttgggaggcagaggcaggaagatcacctgggaagtccaggctgcagtgagccatgattgcatcacggcactccagcctgggcaatagagtaagaccctgtctcaaaaaaaaaaaatcctcgttatatatgtatatgatacattgtagagtacactgtgtgtgtatacctgtgtgtatgcatatttgtacatctatgtgtacataagttgtgtgcatgtgtcattacatattccattccatgtatttaaagtagcatcatgaatgtttagaagatagaccagtagccagttctgggcagtggaatgaggtagaaggaagccagagaacttttgttacttttcataataacagatgtgtgcctatcttataagggaggatagcctgtagcattcatatattgcttttacaacatagtaaacctaaaatcccaacaacgtatactttcggaaggaaaatagagttatttctctgataggaatgttgccaccatcctcctcccccaattaaaaaaaactgctttgtcatatcacagctctgaacttgtatatataatattagtataaaaataagagagagactctcaagtcaaaacattttatttaacagtattaatgtttgactcttgtccagggttagtaatactagttcaaagtgttccttagcaagctattgtgcagcctttacactggtgttacaaaatagtgttgtatagtttttaaactaaaaaaagcatgttacacagcagtatttccctgtgattctgtatttctgaggagagaaagcatgtgcatatatgtacgagtgtgcccctgcatgtacaaaggcagcggatatgccaaaacattgagtgcttttctctaggtgatacagcacacttgctttttagattttcttcattttagcttatcggggttttcaagcatgaataaatattacatttgacattaccaaaatcaacccctacagtatgtttacacctggtatgttgaggacagttcttccatctttcttaggctgtcttaccaccagcttacctggtggcagactccagctactgtctcccagtgagaaatgtgaggagtgtgaggcatggcgaaccgaaaaacaggcacacttaccatgtagtcacattgtgctgtgtctgcttcccctgtagagtctgtctgaccttggcctcgccctctcacttcagttgactggcaccatcagctgaccgtctccctagatcgactggccttcatttctttttttttttttttccttttctctatttttaatggaaaatctcagacatacaaagtggggaggagagtataaaccctcagcctcaacgactgtgaacagtgataattggccaattttgtttcctctatacttttttttttttttttgagacagcgtctcactctgtcacacaggctagagtgcagtggtgcaacctcagctcactccaacctccacctcccgggttcaagcaattcttctgtctcagcctcagaatagctggaattacaggcgtgcgccaccacgcccagccgatttttgtattttcagtagagatggggtttcaccatgttggccaggttggtctcgaattccttacttcaggtgatccgcctgcctcagcctcctgaagtgctgggattacaggcatgagccactgcgcctggctcttcccttatacttttcttcaacatcacctctttttctttctggcaagagttggcatcttcatttgcagctgtataaattaacgagaatcacttattaggtcttttaggaataagcatgtattgactgctgtagcaaaaatcttaaaactgttctgccctaatgtcagccatactgaactgctgaggagcccctgaacacttgctgcgctatcctgtttctctactttggtatttgctctttactctgcctgtgcatctgaattcatcttccacttcgtagttctctgtaaagcctttcttgaatcccacttgtagctgtctctttcctttgacttttcttataaccctcatcctattgtatttgtgtgcttatcttagtctccttgtcagattgcagtcttcaaataagagaaggaatgtgtgcctatcttcttttcctctatggtatttagcaatgcgtaatacaaagaagatactcaagaaatacatgctaaaataatttgaattgattaagttcactggagaaaaattttgagtataaaagaaatccatcacattaaaagaaaaattttcaaatatgacctaggaccaagaacattttctttcatctgtttggattttaaaagattttaaagaatcatggtgaaaagagtcttaaatttgagccatgaaaagagtcttaaattcgagccaatataaaaacgtagctttctaaaaagaaaatgtttttaatgatcttttgtcattttttcacaaatatatctggagcctgtgggtcttctctaatcatacaatgcatcccctcacctccccccaccaggcgaaagacctgaaaaaatacaactgaataatattgggtcacttgtattggataagagtgattcttgactatattttaaatacttgttttagaatgtatatttaaatcttcagtaaaagaaacaggctacatttagagcttaccataggtaagtcaatagcaatctcatgaattatggtagctcacggggatatagttcccagaatatgcagtgctttcgtgtgttacctcatttaattatcctagcagcccttgtcatctgggcagagcagtgcagacagacattgttacctaaaatctgcaaagaagtaaactaaggtttaagaatatagaagaaatcttgtcctcagcagcaagtggcagagactgactttaagaatcaattggaaaccaagagtctttgggattagatgttgcaaatatgtgaagacgcaaaagcatctaagcatgtctttgggagacggaacaggttcttgtgccccttaatgccatagacctattgaaacaatatcacactctctgagccagttgttcctcagattcctcatgttctgctgttatctttggtgtcaaaaattaatccaccttagatgaattagtaaggctgtttgtacatgagtgctggtgtggttctctctcatcctcttgtcttgatctaaggagaaccctgggcaagcccatctttggatagtgtaacttgtctgggccactgctcgcaaaacagacatgtatggaacacttaattattcaacatccttgtcatcctttctataactgctattgtggaattacatggcaagttgcaagttgtggcatagttcatgaagaagaggtgtcagtctaggaaagtatcctcctacatgattaccaggtttgaatttttggttcagaacagataagataaataagccattgccaagaatctgcgatgtacaagagctatgatgggtggacatttgaaaggtacaattttgtattaacggcagaatcaaaagtagcctcaggattggttttaaggatgttatgtttcataaacccttattttcttagataagaaatcagtctaagtgctaataatgcctatattatttacatcaacccattctttaaaagttaccatacaaattttgccaaaatcaaggatgttttagggaacatgaggtttaccatctcgtccccatatatgtgctttagagcttggagattgttttaaaatgagatttattttttttaaatgcatttggttttttggatcttaatatgttaaatgactgtaaaatgatatcacttgtgcagcctgttgggaggagcatggtgcaagagagttggttctgacatcaggagcctgagtttgacttccagtttggtcacttaccagccatgagaccatggcaagatacttagcccgtcagatcctgtcttctctcatgtgaaatgggatggtgatgcccttgtcacaaagttgccaagggtctgcattagaggaattggattagatgcctggcaccccacaggcactcagcacatgtctccaggctgctgagcttctgggtgacctggcactcatgggataatgcctgaacattgctgctgttcttcccagcttctgtcccagtccaacctgctaagctccaggcccatatatgcccctgcccgcaggagatcttatcccagatccaccgtgtctaaaaccaacatctcagttcccatcttgttcattggctctgccagtttgcccaaatgagaaacacagaagctattcgagacctatcttttttccttacctaccccagcccatcctgctttcataactgttgcgggaggtcagggaccccgaacggagggaccggctgaagccatggcagaagaacataaattgtgaagatttcatggacatttattagttccccaaattaatacttttataatttcttatgcctgtctctactgcaatctctgaacataaattgtgaagatttcagggacacttatcacttccccaatgaatacccttgtgatttcctatgcctgtctttactttaatctcttaatcccatcatcttcataagctgaggaggatgtatgtcacctcaggaccctgtgatgattgtgttaactgcacaaattgtttgtagagcatgtgtgtttgaacaatatgaaatctgggctgcttgaaaaaagaacaggataacagcaatgttcaaggaacaagagagataaccttaaactctgactgccggtgagccgggggggaaacagagccatatgtctcttctttctaaagcaaatgggagaaatatcgctgaattgtttttctcagcaaggaacatccctgagaaagagaatgcgtccctgagggtaggcctctaaaatggctgctttgggggtggctgtcttttacggtcactgctgtagggaagaaataagccccagtctcctgtagcgctcccaggcttattaggacgaggaaattccctcctaataaattttggtcagaccggttgtctgctttcaaaccctgtctcctgataagatgttatcagtgacaatgcatgcccgaaacttcattagcaattttaattttgcctcagtcttatggtcctgtgatcttgccctgcctccatttaccttgtgatatcttactaccttgtgaagcatgtgatgtctgtgacccacaccctattcatacactccctccccttttgaaaatcactgataaaaacttgctggttttactgctcagggggcatcacagaacctgccgacatgtgatgtctccagctttaaaatttctcttttgtactctttccctttatttctcagaccggccgacacttagggaaaatagaaaagaacctacgtgaaatatcaggggtgaatttcacccaatacataactctgcctggatttgttccctcctgtacctcctcattgccttgtcttattgactgtaataacaccgtaacctgcctcccagacaccagtctggcagcctttccctgagttagtctatacccctaccggaatgatctctgaaaatcaaatctcatcttaaagattgcagctcagaatcctttaatggtgcctccttacctttggtaaaaattcaaactttgcagcaacctggaccttgctccatcccttgtttcttagctctccccaacatgtaccctgtactttatccacgtgcaacactttatgattcccacaatgtcacacttttgtgcctttaatgtattgtttcatctgccagcttattctttcagtgactctgtacctctgtgtaattctggaaggcttgtgcatggtgtcacctgtccctagagtcctttctctccccctctgatgctctgatgctggattaggtgcttttccctggtggttctttatcagccttcatccaccacacctgtagcatgggctgcatgatgttctgatttctcctacacagtctccattctcagtctgagcatctgaaggaggatggggactttatcccttcatcccaggtctgtaaatgtcgtgtgtatgaatgaatccacaccagtcccttcccatagacaacatagaaaggcccaggtcccagaagtatcaaggtctaatgctgctttagtatttgtcactccttcaacccagtgaaatagagcagctgtgccattgtgggagtcactgggatggaaccagctgcttcagagctgggctctggagtctgatggacttgggtttgcgttccagttccctctctcagcacgcctgcatctggcttcagatttgtagcttctaacatccttctatcctgctgcggggaaggaatgtgctgatcagaaataggagcatcaggtcctcctgacagttgcctttcttaggtaaaatcagtaaatatatgggtttgcatattgagctctgagaattttattagcatgagtcataatccccgagttcagtcagccctgatgagaccaggttggtgaggtggctgggtatagttggcctcagacacttggcgaattcacagaggtaaagatggcccagaagacctctgacagccagacacccaatctcttgtggtgatggcctttctttctaattcctaattcctaaagtttgagttagaaaagttcattgccacaatctgcgaaatgagttcaggagcctgaggaaatcatgctgctttcttaaagattggatctcaactggacctgctttgtaatacttttttttgaaagtacagctgtcttcacccactacttctcctcctcttaaaacataaatgcaggctgggtgtggtggctcacacctataaccccagcaatttgggaggccgagatgggcggatcacttgaggtcagaagtttgagaccagcctggccaacatggggaaaccccgtctctactaaaaatacaaaaattagccaggcgtggtggtgggcacctgtaatcccagcgactccagaggctgaggccagagaatcacttgaacctggggggcagaggttgcagtgagccgagattacgccactgcattccagcctgggtgacagagtgagaccctgtctcaaaaaacaaaccaaaaaaccaaaaaacttagatgcagtagggcttagttgaggtatctgcaggtgtcatgtactacaccacactggtgaccatagggagctgcagggtagggggcccacattctgagaaggggctgaggaagacctcaaggaggagaggatgaggtcaggctcagggccgggtcagatgccgggttctcaggacaatgcccccacttcttcctttactttcttgccaaatgtttcatgacccttggtgactttctttctcagcctgtctctggaatttataaatgtcgaagttcaccaagactttttacgaaactctggttatattggcccacagtgacactaaaaagtaaaagtgaatatttctgtgagtttgtgctgctgcaactaatttaaaacgagcttagaggatgtgttaagtctttctctttgagacttgcatgtgatgttctgccccctcttggccagtgagcccagaactaggggagccctcaagaggcaggggctgcctggtcaggcattgctatagcgtggccctggttccccaagtcctgttgtttttggcagtggctgtacacatctgccgagtgagtcatgatcatttttgtgatacatcctgagaatttccagtgttacttaataatgaaattcagggaaatagggttagacttcaggaagtaagtacttttcaagtacaatctaatattttcatatatgagttaatttcttatcaaactgtaaccaatttttgatgttggaagtctacagtctaaaccagatgacagttaaggctttgtagtttgtctttatcaaagtccctactgtggccactttatcactgtctttatcaaagtcctcacagtagggactttgataaactacaaacacctagctgtacacctggcttaaagtgtagatttacaacatcaaaattggctaaagagcctcatgtggtctggccgctactacctcttgccttttctgtcttcccctttttttgccttcacacaccttggtctccttggccttccttagacccaccaggcatgccaccacctcagggcctttgcacgtgaggttacccctccctggattgcacagtggctgaacatcagtgaggccttctttgatcactgacactccccacagcccctgtactttctactgcttttgccctgctttatcaatagaatgggtcaccatctgatactctgtttgtatatttatttatttgtttagtctgtctccttccattaaaatggaagtactatgagggcagggactctgtctctgttgttccctgatgtatcaccaggacctaaaacagttcctggcatgtaatagacagttaacataaatgtgaatgaatgaatcattgaattttttccacttagaaaggactttttagatcgttaaccaaccttatttatagattgggaaactgaggcacagaaaagttatatggctaattcaaaataaaaccatcatttaagcttttttttttaaaatcttgacatatatatagcacattctggtcagttatccaggatgagaaaagactgagtgaaaatagaccactaacttaaaatttgagcaagaagagacaagctgctgtgagatgggaaagctttctgatatagaggcagagttttgttcctttctgtagcatatggtgcaccttgcacatacttagtgctcaagaaaaacatgttgacgtaatgtggttatattgttaaatccattctttctgcaccactcttttccccccagtttctctccaaaaaatagataattgctcatgtgacttctccttcaaagttcttctagttacaagtatcatatttaataggtttttgttttatgaacagctaaaagaattgaagagatgacctggtttcttggaaaattcagagatatttaatgcagtttcccagatgcatccccatcaaataaaacaaagaattaatgtttctagctctcttatgaaagaacccagttgacaagccttggtgatattgctggccatgatgattctgacctcaatgttgtttatgttcacatagacatccttggaattttacttttgacaaaaatattgtttataagtagcatgatgtttagatacacaaaagttagtttgggagtagggccaattaatttctctttaaacagaaatgaaatatagctaacctttttaatgagctgcagtgaacctcagagatgcagtgatagtactttgactttagagttggaagccatggcagttcaagacaagtatatttcagaaggtgtaggaagagaggaaaacagaagggcaaaccacataaaatacaggagaaatctttttctcttgtttgcatagactttttaaatccactcttaggtgtctttagatagcccaaaaaaaggattgggggatgtgctgccagtactttagaccatagagagatgattctcagttgatcatctgaaggctctttcaagctctacaagctcccctggaaactgatatgtacccccaaaacaaacaaacaaaaaacaaattctcatcctgtccagcccactactgatagttctgctgcctgggtttattcctctcctgtgctcctcctcctgctgtgtggaaatcctgtgattgcttgtagggtccattaatactatgcctctgtctgtatcataaggtaattaattataatatttcactatcataggaaaattaaactttgataacacaagtagcaaattcatagatgtatatattccaaagatgagatggagaccctaaaaggtgaatcttattttttctgatccttggcatttagcttaaagtaagtcgactgttccaaacatctctacaaatctagctatgagagataaacatcatcacatggcactcctcttgaatgctactgttgaatcactccctgtcagctgggtgggtgtatgggctgacgtggttttctagcaagagtgatggtttagcatccatccatatgctatgtgcagtctccctcacaaaacctgtttacaaggattgcacccagggttcggaatttctttttttttttcttttttctttttctttctttctttgtttttttttgtttgtttgttttgttttgttttttgagacagagtcttgctctgttacccagactggaatgcagtggcacaatcacagctcactgtagcctcaatcttccaggctccagcgatcctcccacctcagcctctcgagtagctgggactacaggtgtgggacaccatgactggctaattttttcacttttttgtagagacatggtctcgctatgttgcccaggctggtctcaaactcctgggctcaagcagtccacccacgttggcctcccaaattgctgggattacaggcatgagccactgcatcaacccaggttgatatttctaaatgctgaaagaaaatagctgccaacctaatatttaaattttaatgtagagctactcataagcaaagtgtactggcccaaataggattttgtccatgatttaagataatcatcccctttccttgctataattcactaggctcacagtgcacccaagcatggggtcaaattgtcgacagattttagggctgtctgtcattcacgtaaagggaaatgttgtagaccatatctcaagaccaagtagaggccaaaggcagtttcagtctctccagagttacagagctgaggcatccacattaatagctcagttaagtccccttggagatgaaaacatttgatcagcagaggtcatcttagtgttactcagtttgacctgtctggcagacaggcagtttacaaaagaagaagtttagatgcctaacagacagatggaaagttactcaatttaactagctattaaagaagtaccaagattggctttttaatgtctcaacttggcaaaaggtaaatatgaattctattgcctggtttgagtacctccactcactgcctcagagaagggtcgtaaaattggtacagccttttccaggcatcctggtgatatgcaaatcctttcactcggctcttttctaggaactgaaagctagaaatttatttgaaagaaatgatttaaggacctactaacgatgtgagtatacaaggcatcattgtttgaatgctagtacttggaaacaacctaagtattttaataatagggaaattgttatatatctgaaggatagatttttatggtatagtttaaagtgctgtaaaatatcacacgattgtcctattaagatatttgaggtttattgttgagtgaaaaaaagcaattagcaaaacaatgtgaggtctagtgattttttttttttgaaaaattcaaatgcgtttaaaagtcatggtaaatgaaactgtaaatcatggtattacaaaggattttattttgttctttttgctcacctgcattttctgttgttgctacagtgagcatctatttcttttatttttttctttttctgttttttttttttttttttttttgcgatggagtctcgctgtgtcacccaggctggagtgcaatggcacgatcttggttcactgcaccctccgcctgctgggttcaaataattctccttcctcagcctcctgagtagctgggactccaggtgtgtgccaccatgcccggctaatttttgtacttttagtagagatagggtttcaccaccttggccaggctggtctcaaactcctgacctgaggtgatccgcccatctcgacctcctaaagtgctgggattacaggtgtaagccactgcgcctggctgtatctattccttagtgtaatattttttaaagttaccaccacccaagaagatgtggttcagtaacaaatttggtatcctgctgagattggaaagggagctggggatggggtgggaagggagggccccccttggattagtgtgtttgacttgaatgaggtgtggcactgttcatctaaggctaaatttgagccattcagggattctcttcacagctctttctctctgttggtgaatatcaaaggacatattgaggggagcaaagtggactttatctggagttatagtcacaaatttaaatacatcttcaccagtcattattaaagaaagatctgcatttgtagttccaggaactttacggaccattctatctttctttcaaagggtattgctgaagatgtcaagttctcattttatagagatgctaatgtaggtatttatgtacaaagtttaaatgaccgctccagtgttttaagaagtaagtagtaaatgaatgcatgcttatcaaaaatagaatttgaataatacaggagtatgaaacatagaaagctaaagtctcccctttatacaatgtgttattctatttgtaatccatgttaactttatgtctttcttttttgtgcatttgcatatgcaatggtgtgtgtgtatgaatgaatatacactaatggtcttgaagttttttttttttttcacttaaatcagatcctagtatatacatatatatattattttgcaactttaaaattctcatatcatttaatgtgagcctttactaacattttgtatcttgaatctgagtaagggattgtatacgcaatattatatcaggaaaattgatttgcccttactgtggcttttggaaaaaagtggcacccagggcagatcatcagaaacctaaatttaagttgtttttccaaagtttagctgtcagttctctggaattctgaaacacatggaagttttagtaagtgattatagaactaacatcacagaagcaccaaaagactgtgatacacctaggtagtacttttttcaactctacctgtgaaagattttaagggttttttttttccccctgagggaaatttgcatttcactggagggcaaatcagctgtatttttttttttttctggttatcccactaatgagtcctgtgaccctaggcagtcagttgcttttcagggcctctctgtcttcctctggggaatgctacatgattgctaaggttctttactaaaaactcaacattctatgtctcattacctccttagcacctaaggtcaaggtgtccctagggaatggtgacaggttggtgccatgccttagtgccatgctatgtatgcacaaaaggtgctactccaaggcacctgcaagtgtcctcaattgagccaaaggtcagttggtagcaagactgtggttggggaaaaaccctagctcttcactcctcccacccttttactgggagcatggctcatttgttaaatgtcttaccctagttctgcctgcctttgcataatatttgttattttttagtgacctactttaaaaatctggtgttcagactgtccatgcccacccccgttcttgcatgcagagtgtacctgtgctaatcataaccctgtacaagtcacccagctagtatttcaggatgggttagctttgaaagacactgtttctctaccaaataattatcttgactttcagaatgtgaactacatgtaatgaagggtttcagatacagtagctccgtttttattccttttgtttaagaactgttcatctgtcttccttgattcagtggccagggacaagtgttcagctgtcttcatcattctgacaagcgtcccggagggacaagttctgaataattgctcccaccttgtaccttaaaagataccatttcccattccttccttcttttttttttcttttttcttctcctcttttctcttcttgccaccatgtagtatcatctcattctatagaacaaagaaagcagcaaccccaaatagtgtgatatatgctaactcttccctctttcaaaaaagaaaaacaccatatatatttagatactctgccatctccaaaatgtccacattcattgtcttcgtttgttcattcctatcttttattgttgaatgaagatcagataaaacagaaaagagccaagaacaaagtagcaggaggagagagtgggagataagaaaggaattgaaacagtgggacctgtgctttatgtggatgtgggacatagggagggcttcctggccaatggtggggttcctagatgaaaccccagatcttggaggtatttttagagcctgaaggaccagtgataatactcaaggattagggatgggatgagtgtctggccagggaaaggtaggcttaggaggtatgatgcctggattcttctctatatctggacccattacccagccaaagatctttcttctcacacctctttgaaacatgattgtttttggctttgtcttggagttactaaaccaggagatttgagacaagaatgatagtatgggtggaaccttgaagtggctccaaattccggagtcctctaggcttatatggagggcctgttttccaaacaaagctagtctttggttgctgaaatgcagctgctattactttctactgacctgtggctcagcacaaagtggcaggagacaggtgacagtgcctggctcagacctggtcttggggccccctggaaagaagtaaaggcaactccagcattcaaagttgagtctcttgtgagaggatttcccatgactttcccagctttaggggctagtgggtgacctccaacagcagcatcgtcagaacagggtggctgcacctagagaggtggtgttgggtggcagaaagagccagggtttgaaacctagctctgcctcttactggatgtatgccgttacgcaaggtttttcatccctctgagctgcggtatgcttatctgtacaatggaaataatgatagatttcatttacggagatgttgccaggtaaagaagatggtgtaaagcacttggcatgtgctggtataactaactggttcttctcttcccttctgcagatagaatttacttccttcatatagtgaaactagacagttatctagcttccaaggaaaaagggaggcaaatggtagtgcactttaaaacaagccattttctccaagagccaccatattggtcactatatccatcccaaaaataccaactgactttgtagggtggtgggagtagcaggaatcatgtgaggcttcttgtgttatgccccagacatttgtagctacagggaagtaaattgacacatttggtccccactgcataatggcagataataagtacaagttaacaactggtttaatccaaaaattttgggagacttggggcatctggctcctttaggattcgacacagagataaggatgattcagacacttaaggccattgaaagaggtgaatgacccatcttgctcagtcccgtgagcgtttcccaccacttcccctgcctgcagagactctggcctctgttgagatagtcttctgtttttccaggcaggcaaaacagcagttttattgttgcagttgctactgtttgagggtgaaaaaggtaagtctggggagtatagcatgggtgacaaatgaaagggagagtagcactgttgcctttttaaatatattcagaatttcagccagtggaattattagtttcattttctgagcccacagatttgtaaacttctccttctgcagataagctagcaggtttcttatttatagggctttcccctctcctgattggctgctcattgagttagaattagtcacaaatctcttgaatttgtgtggcactttatcctatatgcactctcacctcaaaaactaaagccaccatcttccctccaaaagcagtcctaatagccttcaattctccatgcctggagttaaaccttatttcttctccccatagatttccccccattcacccagcagccattttctctaaattttgcctcttcagcttttaatccctccgccccttttttccatttcagtttctgccatgcacttgcccgcctggttacctgccacctctggtcgaatagggcccacaggtgtgtttggttttgccatcatgccacagatccacacagtttagaaaaaattagttgccaacttttataagccaagaattcatataaaaatctagattaccagtctcacttggaaaattagatgatctctcaacactgggcaagcattccttcatgccctctcggctggagccaggtggcctctgcccccttagatgggcacagatcacccaggctctttagtccctgtacagcctgcctcacatacacaggtctcttcctgagccctggaggcattttgattgtgactcccattttagaatgtgccctccctttttccatatcttctgtgctgcctctctgcttcctgaattaagttttaagtgcctcacctggtggcactccacagtgcccaccaatgattctcaagctgaacgtgtgtcagaatcacctagaagcttgaacaggttcaatgggtggggaggggatactcaggaatctatatttttaacaagaaagaaccctggataattctaatgcagatggcctagggtatatacctttataaacacagttacggtgtattccagtagcctttgctgcccattctttagtttcagtttcagaactcccagagaaggaagttgattgggccagattgggtcagacacctttcctctctcccaacaaatggcagctgctgcatacagcatgtgagacgtagttcccaggaaagaggcgctgggcaaacagcctggctgtctcctcttcagtgtcttgcgcccgttaccggtacctgtggcgtgtcctgtcgcctcctgcactagcaatccaggaagacacaggctgcttctcaatcaactgcttctccccaaaactacctcgtacctaccagactttggacagaggagttgtgcaaatgtctatttcttttaaatttttaactattttttttaaagttcagtgtgtacatagttaaaaatgcaaacaatactaaaagaaacatagtaaaaactaagccttcctcccagtcctgatttctaggtcccagacctcttaaaaaaagaatttaaatgttctcttttcttttcaggaacacgtggccatcagtaatcatgagcaacccattcgcacaccttgctgagccattggatcctgtacaaccaggaaagaaattcttcaatttgaataaattggaggattcaagatatggtaggtacatggctgtgatagcaattggaatctcatttgcacaatgattaggctatgtaattaattacacttgaggagagtttgaagagggagtagcagagaatgggtgaatgttcttggattaagtgcacaagcactcacatgcctttcctacattagtcatttttaagtaggtgataatgattacatacatttgacatttatataacactttatagagtatacatttgtatcgtatcatttaatctgaataacaaccctatggggtcatgtttataaaatataagaggtcctgaggaagctaaggcccaagagtcaatgacacatgctcagatcacaagtatgtgggttgtagacaagcaggacaagaacacagtcttttttattccaaattccgtcctttttctgcctttgcactgtcttttccagataaatttccagatagtattgcttagtaattttcacatatcaaaatggaatttttataaataaacaaaatcatttttcttatgaattaatattgttttattttaggaactccagttaccactggccatgctgcatagtgtttagggttttgtttcctttgaaagatgtacgtgcatatactttggtcttaattacaataattgtaaaggggttattttctcatttcttgagcattagtttcataaggactattactctgtgtgtatatatacatgtataaatatgttacttgtcaacatttaacataggctgcgtgtgttggctcatgcctgtaatccctgcacttcgggaggccaaagcaggcaattgattgagtccaggagtttaagactagcctgggcaacatagcaaaaccctgtctctacaaaaaatagaaaaaaattagctgggtgtggtgatgcttacctatagtccctggtatttaggaggctgaggtgggagaatcacttgagccagggagtttaaggctgcaatgaactgtgatcacaccactacactccagtctgggtaacagagtgagaccctgtctcgaaaacaaacaaaacacataatacaataaaaatctagactgatggtgagatgtgatgacttaagggaaactgtctgttgttggaatccaggacaagacaaccatttaataccaaagaataatattttattttggccttgtgtgtagtgttttctaccactgaatatctctttcttttttgaaacagagtcttgctctgtcgccaggctggagtgcagtggcatggatcttggctcactgcaacctctgcctcctaggttcaagcaattctcttgcctcagcctccccagtagctgggactacaggcacacgccacaatgcccagctaagttttttatttttagtagagatggagtttcaccatgttggtcaggatggtctcgatctcttgacctcatgatccgcccgcctcagcctcccaaagtgctgggattacaggcatgagccactgtgcccagccctgaatatctcttaaacccattaaatatccatgtattttaaactgttggtcactttaccctctttccttgtggaagaatagtctgatgcctcatatcaactttatatagagattggccttaaagagcgctcttaagttgtctcacaggttttgtttattttgtcatccttaactcttagggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgtgagcctaatgtcacttcactctcctttgcctccctcattagcctttcaagaaagttttcttttaaacaaatgaaaacactctgcaatgactatatactttattaatttatgactatataatattatatacccatatccagacacttttgaaagctaagggtgtcattgcccccagcagcaagaggaaaccaggattgtgtccagcaaactgaaacacgccactttttctaataggaagggtcattatccttgctcttaaagatcctagtcctgagtatcttagggaaaggtcaaagaaatagcatggaatagagccatcttggaatcttttctttcccacattgtattgcccaggaaaccaggtgtgtcaaacacttgtacttgaaacactgatgtgctgtctgcagaggggagatgatgtagctcacatcacaagtcttgaccataactgttaagcctcagttctcatcttgctatttttagatatccttgctccccattgcagcatctttgttgagatactatatttccatttttaattgatgttattttattccttctagagacccagtttcatttttctagaggaagatcaccaaaatgttatacttttaagcgaaaaagagagattcatttaacatgaatttgattcacagccaacttttctgaattatatccattccttgaaatctggtcaaaactgaaaaggtgtgatctgaaagtcttctccaggtctttgtcaagccaccatgtgaatgggaagcactcacagcagtaagagttccagagttgttaagtgccagctttcccatcattgctgtatttagaacatagccgttattaaatttaatacggtgataacattgtacatagagataccacccagtcatggtacttactacctatgtgatttctgcctgaggaaatacgcttagaaactttcacttttctaagtctcacccattgttagctcctctgatgaggtagggccttgtcaatattatcaatggaggcaaaagctgaaaaatccagttacacacatttaaggcttattttctgcattattctctttcttctcttaggggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaaggtgagagattaaaacgaatacctgagtgttctgctttgtgcaaaatctttgaacacgaatctttttaaaatgtgtatatgtagttaaagaagaaaatctttcaaagatatcttctgaaaaacttaaacttcatatacatttcgcagtaaagatgttttagggggaagagtgggtggatttttcttttaatctttttttatttgtttttacttcttgggtgggagcagcctgcatttgaatctgacttgaagtctaggtgaaaacacacacacatgaagttctgccatgagagcttgtcaacacaagtatatgtcagtgcaagtatatgtttgagctttttcatccactggaagcttactcctttttttgatcccaagtaactgttgcatatctagcgatctctgcctcttcacgtgggtttccataatgcctatccctttctttccctgtgtttcttcttttgtttgggacatcctctcctctgttcctgccaaatcttacctgtccttcaaggccagcttaaatcttattctgttaggaatcctttactttccagcctacgaagctccctgttcttcagtttgccagatgatttagtgtcctgagtgggcctgtagcccttgaagggaagttgtcacttgagttgacttggtaagtagactctcagctccctgaatgcaagagctgagcagataaataggcatttaatatcctaaattgagtgaccttgaaattattcttcgattaagtgagaatcttggtaagcctgaatatagacacctaatggtctatgacacctttaggtggggaaaaactaaacaactctgaggataggttttttgttgctgtttttgtttttttaaatccatccccacatccttagcatccaaaggtgtgcatattaaaatgtcttcgttggccacgtgcagtggctcatgcctgtaatcccagcactttggaaggctgaggcaggaggatcgcttgagcccaggagtttgataccagcctgggcaacacaggaagaccatatctctacaaataactttttaaaaattagccatgtgtggtggtgtgtgcctgtggtcccagctacttaggaggctgaggcaggaggatcacctgagcccagaaggttaggccatgcataccagttgggtgacagagcgagaccttgtctttaaaaaaaaaaaaatcttaataaaatgtgttacaaagaagagaactgaacatgtgaatatgcagttgtgaactagcaacttaggcctgacctcttaacaaactttgaaagtgaatacttcttaatcaaaatatgtgtaccatttgtaatcctagcccattgaagagatgactaagttttgtgaggttaggagccaagtagtaatggtcaattttcctgactcagtttattttaatgagcttttatccctaaatctcactctctaaaagcctttggtttacgttggaagtattgggagtgagtctttgggttaaaatggcatcaggatattaaacattgttataaagccccagtcttttgtaagatacacaaaaaggcatagaaaatagtagaatctaagagaagcacttagtgatttgataaggcctataagagtagagtacctgatggccgggcgtggtggctcacgcctgtaatcccagcactttgggaggctgaggtgggcggatcacaaggtcaggagatcaagaccatcctggcaaacatgttgaaaccccatctctactaaaaatacaaaaaaaaatagctgggtgtggtggtgggcacctgtagtcccagctacttgggaggctaaggcaggagaatggcgtgaactggggaggcagagcttgccatgagcagagatagtgccactgcactccagcctgggcgacagagcaagactccgtctcaaaaaaaaaagagtacctgatgaagttaaacttgaaaaaaaaagaatctagtcatctttgccctttggctcaaaatggtaatcaacagatgggaatgaagtcagaagaaactctaccatttgtccttttctccaaaaggcagaatttgtaccagccaaaaccgtgaagatttcaatgtagagatgggtgtaaaaaaaatcagctattgctgtataacagtcccagaatctcaacagcagtcaacagtaagaatttatttcttacacatcttctagttgtttgggaggtcagctgacctaggtgagcacagtcaggaagctctgctttgcactgcagtagccaggttgggagcttacactgaaccatacatctgcagggcagccgggacaactctgttccatgtgtgtttcttttggggtccaagctaaaggagaaagcagctgtcttgtgaccacagagactcaagggggcaagtgaaaacacacagtatctctaaggcctagctaaggaccagcacagcatcacttctgttcacggtgccattgatcaaagcaaatcacatggttgagcccaaagctggaatggggaaatacagtccacccgtcttcggtggaagtaacttcaagattacaccacaagggttttgatacagggagggcaatcaggtatttttaagaggctattatcttaacctagaagtatgactacctaaagttgtcaaaacaactatcagtgggagaaataacttttccatatacagtgctggaaattgattagtggagggagcagttcttatgaatgtttaaaagttttagaaggaaatgtatgcgtgtcagatgtcttgatgagactaaatttagaagcaacgaatgaaacacggaaaaaaggtatagatttagttactgcaaagttaagagaaaataacttgaaaaatatggcaaagtgttaatatacttaatatatggagtgtctataatccatttagaaaaataataggtccctgaagataaatgggcaaaggaaagtggacatttcataataaaaggaaatgcaaatggtagtaaacagtatataaaggtttttcaatctcacaaggaataaaaaagtaaatatttgagatgtcattttcttatcaatatagttgagattagaaaatattaattatgaaggtgttataagggagacacttttatacactgctgatagcactataaattagaaatgaggattaaagcaatatgtgttaagaccttagaaatttctatatcctttgtcctggaattcctacttccaagcataccctttatatcatttatttatttatttatttattttttgagacaggttctcactctgttccctagaccggggtggcgtgatcacagtccactgcagccttgacctcctgggcttaagcaatcctcccacctcagccttccgagtagctgtgatcacaggcatgcaccattacatctagctaatctggatagctgacttcagaaaaagcttaatggccaataatgtttattaaagtattatttataaatgaagcctagaaacattctaaatgtccaacaaaaaatgctttattaaattacggtatacccctgaagtgaatcattaggtaacctttagagtttaatttatgaagtctttaataacacttggaacatgatcacattgtagctcaacgagcgagatgctacattgcatatgtagagtgacataagctacatggaaaatgatgcaggaattaaaagattggaaagggtgccaagttgctaagcagttatctcagggattgcaactgtcttcattttcctaataagaagctattatttttataattaagtcacttaagaatatgaaaccactcaacgggaaacaaaaacacctttatttgcttccttggggatgtaactgagttcctggcagcctcaaaagaaatttagaaaatgatctttctccagttaatattgctaacatccaaaccagataaattcaggataaagagaaatctactttgtcccctgaattgatggtacttggaacagaccatgtactcgccaactcttccctttcctttggactctgaacctgtcctaaggcaatatgtcttccccaaccttccttttttcctaaatcacgtgaactcagtttaatgttttggtttcaaatggaagagtttaaaatatatgcgtaaaatgttatcctgtttgagataggataaagacccacttcagaagttaggaaagtagccataaattcatgcccagtttcatctttcttggagtctttcattaatgttgatgggtttaccttcattttgcttgcctagaaggtgaaagtacaggtagagacagaattgtaatatagttttcatgtctaaactctattgactcaaaattcaaagagctcatggctgttaatgcatcttgaacttgggtcatcaccaagttcactgtaattttttttttttagaccttgactctaatcaattgtggtttcagttttttatagacctttttcatttacaccatgtactgaaaacatgaaaaacagcaaaatccaagggtgaactttgacctagattgataaccaaatctagcaaacccacatgtatatataaaatcagagtgaacactagccggggcggtggctcgcccctgtaatcttagcactttgggaggccaaggcaggtggatcacgaggtcaggagatcaagaccatcctggccaacatggtaaaaccatgtctctactaaaatacaaaaaattagccgggcatggtggtgcatgcctgtagtcccagctactcaggcggctgagacaggggaatcgcttgaatctgcaaggtggaggttgcagtgagctgagattgtgccactgcactccagcctggcaacagaatgagactctatctcaaaaaaaaaaaaaaaaaaaatcttttagaagtgtttttattggtggtattttgtttttatttcttgagttgtggttttgcaatttaacctcatgatctctctcctcatttttgtaaggaattaaatgtgatgtctcaactctgtgaaactgtgtgctgtgggctaatttccagctctttctggaaatgagtgagaaaaactgggtaaggggtggtagagtggtaaatgtctcagttaaatgtttgtaagctctttgcctagtttgaataatactaattagcttcacaccatctttagaagttgaagttctaatacattattgtgatattttacaaagttacctcaccttttttttttgttcctccaacaagaatttcataacagtgactgggcacggtggctcatgcctgtaatcccagcactttgggaggctgaggcagggggatcatgaggtcaggagatcaagaccatcctggctaacacggtgaaaccccatctctactaaaaatacaaaaaattaactgggtgtggtggcaggcgcctgtagtcccagctacttgggaggctgagtgaggcccgggaatggcgtgaacccaggaggcggagcttgcagtgagccgagattgcgccactgcactccagcctgggcgacagagtgagactccgtctcaaaaaaaaagaatttcataacatttctgaccagatttcattaatgtgaaaactatctccatgttaatactgtccgtgaatttctggagctccattaaatgtaattctcagaaactgaactacattcaattctgaattcaaatgaactaagaaatttcctctttagtccgtgaggccattcacatttagagaccttattaaaagctcactagattagactaatttagggaagttctgagtggtagaaaattctgaatgctaggtctattcattccagtaactagaactaggctaattgagccaagctccatataatagatgttttgttttcctgagtaaatagggttttacctggaattactgtatcatgaaacagtctaagcatttctggcttctgcacgtcctatgaacatgtcacttccatcaaactgatacccccagcattttctggggtaaacattcctccgtcaatcatcagtcatgcttctgctgtgagaagctctgccatcctcctggtgctggagggtggaagatcagggacaatgactaggagtccataagtgctcacagtatagcaaaatagatggggaggagaggcaggggccacatgtggttataatcttacctgtagtggtagaaatcaaggtcagagatgctttccttttttaaaaaaattaaatccatttagcagatctattatgtgccagtatttattccagaaacagattatagtttagaaggggagagaaattagtgaacacacagctttcatgcagttgataagtgtagtcaccacagagaaggggcaaatcatcctgacctggggagtctgtgggtttttcaaggagcgtcacctgatctggatcctgagcctgtttaccaaggagagaagagctgaaaaagaccttccactcagagcaaatagagcatgcaaaggcacgaggaaagtgggggtgggaagagcatgctggctacagtgtagctgaagctgagagcttggactggaggctaggagagggcttataaaggatggctgaggtcaggttgaaggacttaggtttttaagacaaggaatttttactttataagaaaatgggaagccattggtagattcagactggtgcatgatgatttatattttagaaatgattgaggtgaccataccaaaggtagattgaatggcctcacagggcagctggttgggaggctatttctggaataaatatcttgatagctataggtactaagtggtgggaaaagagctcattagatatggacagacagggaagaggaacagatttaggaaagaaagcccagcatcagggtttgacccattgagttgatggtgcctgaagtattcttggtgcgcatgcccgaaacacactggaaacatagatctggacgtagagacaggtgggaactggagtgatggagccctcagcatactattaagaaggtcgagatgagtaccttgaggagcagctgtgtctcgtccagagggtccacagagtctgctgatgccggtgtcggtgcaggtgtcctgccttgttctgctatcccggggtccctcctttctctccctcttttgctcttctcgaacatgtacacacacaaatagacactcattcactcaggcagggatcagcagactttttctagaaagggccaatagcaaatactttaggctttgctggccacatgctgtctctgtcacatattcttccccccaacaccccagcctttaaaaatgtaaaaatcatccttcatttgagggccaagcatatatgggcattgggtcacatttggcccatgggctgggttgtagaccccagcccatgttaggcagtctcaggaattgatcctacctattaaagcaaccaacacttgtcttggagaatattcatatcaagagaaaaaaaatctgtgtggtaaccaaatatgttttctttttttttttttttgagatggcgtcttgctttgtcgcccaagttggagtgcagtggcgcgatcttggctcactgcaacctccacctcccaggttcaagtgattctcctgcctcagcctctcgagtagctgggattacaggcgcctgccaccatgcccggctaatttttatatttttagcagagatggggtttcaccatgttggccagtctggtcttgaactcctgacctcgtgatctgcccgcctcagcctcccaaagtgctgggattacaggtgcgagctactgtgcccggctccagatgtgttttctatgaggtaaataacacatgcttccggtcccttttttcccaaggagtgtctgcccatcttgctcgggctgactcaccgtcatccttcagaccacattgataccatgtccttctggaaagcattccaatccccccaacccccacccccaggtgggttcatggcccattccaagtgctcccgtaccaggcagtgatgattgcattcttttgccattgccctttcaccagactcagagtgccagtgggcagtgagcacacagcttttgcaccattgcattttcagcatgtagcatgtggcaggctctgggggaggggaggatcagagtgagtgagaagcagagtatcatggtcaaggtagaaacccccagggccagtcagacctaggctcagataacagcactgtgttatcgtctaactttggacaaatttaacctttctgtgcctcagctgctgcttctggatattgaggatgacagtagtatttacatgaggggttgtgatgataagttcacatgtgtaaagctctgagcgcccacaacgtaatgttgtcctttagctcttgctgttactgtggtggtgttaactaccactgccaccattactgccacagtcgctgttaactatgacgggaagtccatgtggtatagggattaaaggatagtgtcaactcgggagtcagactgcctgggtttcaatcccagttccaccactgactagtgtctgtggtcctgagcaagtttcttaacctctctgtgtctcagtttccccacttgaaaaatgtggctattagttgcacctaactcaaagggatattatggagactagatgagaaaattaacacaaagcatttagaatagttgctggttcctagtagtgtcaaaaagtgttaactactgggtactaggaagtagttatccagtacttcatttattaatgaagtctgactttggtcttagctattaattttactagcctttcctgtgttcactcaatcctatgatacatgctttatgagcacattctgtgtgctgaatctgcgatcttgtgactatgacttattctaccttgactcaaaacaatgcagtttgatttttaaaatcctagaaaatcttggtgccctgtgttgtcctgatggactgaatgacgttgagtaaatcttagcgtataatctgtggttcacagatgttatcaagtgacaccatcttcctcataaaccttggtcctacacacaggagattgtgattctataaggtactgatcctctaagcattgctagttttctgtctcccaacataaagagatgaaaataccagcccagacacattccaggtcagagagatgttataatgaggtcatggatgaggagtatagaaacaagagttctttaaatgtccaggctgctgttgtcatatgaatgtcttgagtctgttcctaagagtcagactttatgattagattagttttaacttcaattcagttcatgttttctgcctaccatagttaaaggcattgtaggaatcacttgaaccaaacaataattactctctttactttcactagttacctctcctattctgcattgtaaatagtcatgaatgaaattcatattatcactcagcaagcaaggagatgcaattccattttgtttcttcatcaccaataaatttgaccactaatatgttaagtctcaaattgtatacatttaatttttctctctgacagggcagacagtttacagaagaatcaagacctggaatttgaaagaaatagagagcgatttgaatttttaaaggtatgggcagggtctggttccattgtttggttttctttgtaggcagggtacgagggagagatgccaaggagatgggctgagtagaagtacttcacgcgttcatagtgttctttccatttgtcaatcccagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgagtgttcttccatatatgctgttttggggcatgcactttaattcactgtgattctattacatctcagtaacatgaatttacatgaccacaagtttccgagaggtatgtttgtcagttttgtcactgctgtttttccagtgcctagagaatcactttgcacctagcaggcactcaataattatgcttggaagaatgaacagaagcaaggggttaggtacatttagcatacacaaaaatcacctggggtgttaaaaatagagactcccaaagcttactcttctttgcatgtggcatcaaggggattttgatacaggtgtttgggggaccatgctttgagaaacatttgttaaaaaattctataaaggaaaatggagaaaaaataactgctctttatagaaacatgactctgcaccaattaaacgttgtaactgggtttattacctgttaatgtcactaaatttatacctgagagatagagtaaggggtaatgaaggcattcttccggtcatgccgttcattgcaggtgtcggtggtattgaagcagaagctgtcatgctgggtcagccaatcagtatggtgcttcctcaggtgattggctacaggctgatggggaagccccaccctctggtaacatccactgacatcgtgctcaccattaccaaggtaacaatgtgcatcctcttctgtggtcttggaaagccacaatgatagctttccaatggagggaatacataatggaatcttgtttggtttccaagtgctctagcaatgcaaggaaacaaggttgatgattttaaaaggagatgaggtaagggaagtgttctatgttaagtttagatcattatgtttgttttcttctagtattgctgcatcgatctttttcttaaaggaaattttttaaactgaaatagttcaatgatacagaaattaagatggcattcatatgcccaccacctagatttaacagatgataccattttgtcatagttgcttcagagctctctgtgtttttaaagaaataatatgtaatatctgtggctaaagccacattccccatttctagaaataatcactatcctgaggttgtaagaatcattcccatgcatgtgtttatgctttcactacatgttttccacatggttcttccttttatgtaaatagcaaggtagttccatgaatagagttttactttttaaattctcttctctgtattataagttacattattgtaacatatatgtcaccaagctggaaagtattaggctttttctgtagctgttagaggagaccatctttttctgtgatttgcttgttttgtaaaaaggccatttcgttttggaagactcttgcaaaagcaatggtttttaatgatcacaaacataattttttttgcttttatagtttggaggctggggtcctttgcatggacatgctatcgttaaagtgcaaaacacatttctctctgatttaatttttgtgaaattttgaattggatttatttgaataccatagcttatcacaaatgtctgtgcactgttcttaagatgtggaatactacaggacttcctcacaaaatttggcagaattccatattaccaaaagagcccatctgtgtggttgtagctagaaactggctttatgcagagctaagtcagtcactgtggcctcactcctggctggtgccttgtgtggaaaagatatgggaatcttttggttacatttgacttatacttgtagcatgaattttgctcattacgcctttgaaaagttattttcttaactagtgcaagtagttatttaggttgaaagaatttaatatgtagcacttccagacgcttccaatgatctcattagagaaagagaatgtttctcatcttgaaatatttttcttaatatcatttgtattttgggcacactttgtctttctttttataaataaaaactatttgacatcatcttagatttatgggagagttagtataaagagtacagagaattcctgttatctttctcccagcttcccataatgttaacatcttaaataaccatggcacatttatcgaaactaagaagttaacattggtgtggtactcttaactacagactttaccagttttttcagtaatgtcccagaattctgctccagaatccaatccaggataccatgttgcatttagttggcattgttttttaagttttgaaagtgatcacaaatgtgttgggctgatttactatttgggtttactgacaagactagtttataagaagtgcaagatggtagttctgcattttgaatgtgggccatcagatctcaaacttttctgttgtttctgctgcttagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtaagtgaagggccctgaaagcatcgggctttttgtaaaagttccatgaaacaccaagaatctgagcactgccttctgcctctacccaacagaaggcactgggttacagttacacaattatttttttctccatggagtcaaaatgggtttttgggatttaaggagttaatatgagatagagatggtatggccaatagaaagagctcagagattacagaagcctggatatttatactggtcctctactactagttttttgacattaaacaagtgatcttagtaatggttactgctgcctatggggtacttgctgtgtaccaggtacctagtatgtatttgctgtcaacctctttacagatctgtagggtagattgattgactagttaattaacattagagaaaactgaggagcagagaagtgttcatacccaaggctaataaacagcagagtcagaatccaaccctgcaactgcctggccccatacaggaacagcactctgcaacacccctctcagggatgtctaaaaaatgaaatgagtccaggcatggtggctcactcctgtaatcccaccactttcagaggccaaggcaggcagatctgacctgaggtcaggagttcgagaccagcctggccaacatggcgaaactcccaggaggtggaggttatggtgggccgatctcgcaccactgcgctccagcctagccaacagagagactgtctcaaaaaaaagaaaaaagaaaagaaatgagagtgtgatgtgataatgagaaagaaaggggaggtggctgaagtaccccagaggtgcttgcacagatctctggatgaagtgaagggacagccatgggaagggtttcatgagaatcttacagactccaaataaatcttagtcttctgctgtagcctgaggaaattcctctagaaatagtaaagattgtcatgaaaaagtttatttaaagaagtttttattaaatataaacacattgaaattgattaatacatctttgttctcccaaaggattttaagtgaaaaagataactaaaagaacagaataaataattgagggaatcaacctaaagaaagagagggatagtgtgctgggtagagggataaaagctgtgagatggatctagagggaaggttagttggttagttcccgtggtgctgcaggtggccattatacttcttggtaatccagtgccaaatttgtaacatctattaaattgaaacaaacatattgcttcagaatagtgtagccctttctcatagtaaaccctaagaaagatttctcctgttcatcttcatgaagagcatggcatgggttgtagtgaacagcgggctcaacaacaggtcaggacaaatacattagtgaagctcatacagctgtcttttatgaggtctgtgctgagagctaatgacgtttacagttcagctaaaacaaatagacaaacaaaagttctgatcagtggtaggatcagccaaaggatcaaaccttctgtttctaaccatcagagaaattgtggactgcatgtccgttgggcatacttcatgagtattatctcctaccccgggatcttgataaaagttaaatagcagagggttcaaggtcatattcctggtgatgcagcatcgtgagttaagactttgaacttttgggtcaagctctggtttggattttggttctaccgtttactggctgtgttacatgagaaagttacttagtcttcttgagccgccatttccttatccataaatgagaataataattgtacttgtatcttaagactatgataaaggattagagattgaggtaatacatttaaaatgtttaggacacagtgcccagaaagtgctcagtagccagtggtttcaggtggggttgggatgcgttttaattttaacggtaatcatgtggaatgctgaatctttgtggccagttgaaggcaaatgcataggtgtgctttcacaattagctcaggtgtaagattctcctaattaaaggctataccccaaaagaggcgggttatctatagatagaaccagaatctttttcagaaaacagtcactttgataggaacagcacattcattaatggcccctaataaaaagcagcatcagtgggagagtcaaaccattagcctggaagcctaaaaattgacagagctgttggtgtgtgtgtaagtgcagcgtatgttgcgtacttacataattgctaatggaagtatcagtttataaacttcaaccaggaaatactaacctatgttacttgttactccttaaaatgccttttaggtcgtgatgaagaaaaattaaagtatattaaaaaatatcttcaggctgtaggaatgtttcgagatttcaatgacccttctcaagacccagacttcacccaggtatgagagtgccttccactgtgcatgtatttcctcttcctcaaggctgcgattttagtggtggtttttcttgggggaatgcgctagtaggaaattagtcactgccaaggcattacaagagaacggagttttagaaggttgaaaaaccaaaaggataaggcaattgtaaacataacagaataatataacttcttacattcctactggcttaataattgtaggttaagtgtgcttccctatttgaactactgattcacacctcttaatgtggaagaccactgaaagactttgctaaaggaataagaatgatacaatggactttggggactcagggcaaagggtgggagggaggtgaaggataaaagattacaaatttgggtacagtgtacactgctcaggtgatggatgcaccaaaacctcagaaatcaccgctaaagaacttattcatgtaaccaaacaccacctgttccccaaaaatctattgaaatataaagaaaaataaagagacttcactagtggaacaagagctgtttaaaggctaaaccatcattattacagacctagaaagaagtgaaggtacaaacatgtcagtaaactgaatccacgtttttctagacaacaaggtaaactagccctgcgacccatgtttggtttcttaatacattgaggaggggaaatgttcagttagactaaggcccgtttcctggtgttgataacttaacggctgcatccctccgaaatcaccttagaagtgtaatggtttatgtatgatttcaatagaaaacccaccttcggcctaacttagccatataaaacgcgatgagctgcctccaaggatgggcgagtggaggacactgagcatctgcagcacccaccctgttctttctgagaggtggcaaggctgcctgcctgtctcctgctacttaagtgcccatgatgatcttgggaaattaatcacttaagattaattaagaggattaagagaaacactggcttccttgttttggaatgtggtagtttatttgcttatttttatggttgtcatgttttaaattctctgacatgctttgggtttcctctttgtgggtataatgtaaattctataatttcttttctttggggtcaacaggttgtggaattagatttgaaaacagtagtgccttgctgtagtggacccaaaaggcctcaggacaaagttgctgtgtccgacatgaaaaaggactttgagagctgccttggagccaaggtaggggcctgcgggaagaggttgaatcctctcaactctacctcttgcctggttactcagcgtccaggctttcatcccacttgacatgaatcttcctgtagcctgaagcttgagggtgtttattcttccttctgaagtccttaatgacttcctccattagtcacgagccaagcggcaagagccatcatagacacaactcaacccacctttttaagcatgtctgcttttcacaggaccctcaccacactgtttactcacccgaggttttctagctgttgcacctttgtgcatgcccctccctgcctgaaagtctcttctccaactcatattactctgttctgtgaactccataagacttggttcagataccagctactctgcattgggttctcagaatctcatagcagaaagtcccctttcccttattggacacttcatggtgcttgggctgaaatacttcgatagcattccatattctttaacttacattgttggtactttatttgcatgtatgatttctgttgctagactgtacgtgtgagaataggatttgtgtctgaatcaccttgggagcccgcaaggtacctagcacagtatcttacatgcggtagattttcaatgaacatttcccaaaagaatgattaagatgtatgatggattttatctgtgagacaccagtattatgccaaatattcagctgtactttgtttgcgttgttgatcatgattaattgagtctggtcaaaatagcgcctttttctaaatttccataaggttagaatccatagtcttaatcagtccatatccattaaactgtacaataatgtcattgagttcaatttagactaactttaaatttgtagttttagcatttacatttttgaggtgggaaggaagtaattgttactaatttcagtgcagagtaagactcagatatcatgactgctttttgtaaagatttcaaacgagtaatttttctgtagcatttcagagtttacttgcagagatacttatgcttttgttaagaattggcctttaaaattatagttaccaaagtattccttcttctcaagtgagaactgttgactatatgtatgtattttcctctagccagatacatgtatatcttatataaatatattcctatataatatacattttttcttcctttagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggtaagtgcatttgactccatcctcatggtcatacatgtgtgtaggtggaaatagcccgagacagggcccagggccttggcggagttgtacatgtagttccctgaacctcgtcttttccagatacagatatttattggcccataaatatctacacaataaatagtatccaaagcaaagtttttaaaatcgaatgcacactgcataatagtctctcttgagaattaacacagaaaataagtagaggaaagcaaaggaagctggatttctgggaaagcctacattcttgtgtcagactttggaagaaaaataaagtgttaccacagactttgttctccgtgaaacccctgagcagcaggattgagttctgacgtgaatgctgggaggtgtttctcagtgagggcacagggcactggctgataaaacctggggccactggcctgtttcgcaattctggttgagttgttaatatttacatatgtggtttccctactataaggtctctttagtttccaagtttttagtcatccccaaagctcctcttatatccatccacagaccagacagtgtcagcagttcctttctatgaagcagacacgggcattaggaaagccttctttgcctgagtccgtgtattgccacctaagctttccttgtctggtctggagcaaaccagtcttctgtagacaagttaccagcttgtctgtggctttttgtcccctcatgtccccacccccactgctcatgtttttgctacttctgtgatacttcctaagacagagcacccagtgttccagtagcagtctctgtatctgccaaagtccagcagatcctccacttcaagatatatctgaacactcgatttttacttcttggctgaccgttccttgccagccagcacacagctgatatagtttcagaaagggctccttcaatgatgattttcatccaaataaaacataattagaaagatgattttccctctaaaaaaaaaattaaaaactcattttgtaatatattcctaaatggttttacatttatctctttaaaaaaaaagtaagcaaatctctttcttcatttccttgcctagctttgagtttactgcatatatctaaatgaccgttggccagggagcctttagatttctgtttggcagcagaaacagcagatagcgccaacatgaagggagcgtggtcaggtggtggcaggaaatgcagactgaagaaaatcaggctcttttctgaagtgtgcctggcacctagagcaggcagcctcccacactgcatctgtgtttaccatttcacaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtgagggagagttttcttttgcaccattgcttttgttgaattgtatccctcatgtatcttgctgtgtcaccttgtaacagatgtgagattatctgatgatatctaattgcatagtcgtttatcagttggtagttagacttaaacccttacattccatctaaagagagccctcttgccctctagggcacctaccatgaatggagtttgcaggactggaagttgctttggttgagtcagtgaatgagtggagagtgaatgtgaaggcctaggacattaccacacactactgttgactttataaacactggacacttaggccacactaacttaataaaaaaaagtttctttcttcaataatgtaaaccgtagcttacttttattttacaaacttttaagtttattgaaactcttgactcttaaaacacttagcttaaaacaaacatattgtatagctgttccaaaatattttctttatatctttatttcataagttttttcctatttttgaagtttttatttttttactttttaaacttttttgttaaaaaccaagacaggctggacccagtagctcacacctgtaatatcagtgctttgggaggccagggcaagaggattgcttcaagccaggagtttgaaactagccagggcaacatagtgggacccctgtttctacaaaaaaaaaaaatgtaaaacaattagccaggcatggtggtgcatgcctgtagtcccagcttctcgggaggctgaggctgcaggatggcttgagcccaggagtttgaggttgcagtgagctatgatcacgccactgtactccagtttgggtgacagcaagaccctgtctcaaaaaaaaaaaaaaaaaacctaagagataaacacacactttaggcctacaccgggtcaggattgtcagtattactgtcttctacctccacatctgtcccactggaaggtcttcaggggcaataacatccatggagctgtcatctcctgtgataataatgcctcctggaatacttcctgaagaaccttcctgaggctgttctacacttaactggtttgcttttttttttaataaacaaaaagagtacactctaaaagaacaataaaaagtcagcatggctgggcgcggtggctcatgcctgtaatcccagcactttgggaggctgaggcaggcagatcacgagatcatgagatcgagaccatcctggctaacacggtgaaaccccgtctctactgaaaatacaaaaaaacaaaattagccgggcgtggtggcgggcacctgtaatcccagctacttggggggctgaggcaggagaatggcatgaacctgggaggtggagcttgcagtgagcagagatagcgccactgcactccagcctgggcaacagagcgagactccgtctcaaaaaaaaaaaagtcagcgtgagtttgtttataccagcatcatcataaacaagaaatgccttgcactgtgacatcacgatggctacaacatcactaggtgataggaatttttcagctatataccacatatacatttgggtatatgtggtctatcactaacagaaacattgtgcagtgcatgaatgtattcgttgccaaatacgctttctccaatttccatattattcctgacttatgacatatattttattcatgtgcctcataaaattcaaatctccttaggattatacaataatagtagttaatgaagatatggcatatatgatttcaacttttttaaattgttgctcattcaatttgattcctttttataagttaaaaatatgaatagtattcttatgttatatatcagaatgctctcaagaatgaaacttttagaaatagcactatactgaacttagttcatgcactgcaattcctttttgaacagtggtctctggaaactgtggccagcagaagggctcactgaaagttattctttttttgtgtgtgtgtgcttctctcttggtgtctaggtttgacgtggtgggctatggctgcatgacctgcattggcaacagtgggcctttacctgaacctgtggtagaagccatcacacaggtaattgcagaggtccctgcaggtcttcagagcagttgtttcttttcatgtaatgtgacaaaaatgctgatattttcaagaaggtccatggaagcaggggatgtggtttagagtatgatcttttgagtttagttaaaattactagctgggtaaccttgggcaagttaattaacctatctgtgcctgggttttcacaactgtatattggagatgataatagtatctattttatagagttgtgagaattaagatgatgataaacataagtcacttagtgcagtgtctggcactcaagtgctcagtactggctggttttcactacaaagggctctacagttgtttgttataggtattgggttagtgcaaaagtaactgtgatttttgccatttcagtgatgaagaccacaattacttttgcaccaacccaaataatttgaaaattggttcaaagtgagacaagtctccacacaaacgaatctaaactaaattgctttggcttgatttttatccccaaaatgctgaaccttgaaagatattatttggtttgctttgcattaattatagaatctacgtattctataattgtgcattgtgacttcctttaacgatcaactgttaggtctttcccacctgttcttgggccccaggcagcaataactagtatgttgccttctaactacctgatattttctcgtgagcagaaatcactaaacatgtctctgcttcctttgacccagagtatctcccatggggacaccccagtgtacccttctcccctctagtgggagagaaccaagtgaaagggcagcttaaaggactgtatccttgcgatgtggaaactcttgccaatggtctgagacaagaagcctagtcagtatcttttagtgacctgatttttctcttgccttactcagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggtaagattttgtttgtgcagccataatttttttccagtgaattcagaaatattactagaagaaactgctttccttaataagaaatgaagcatagagcctccagggataagacaaagaagagaataatttctttattccccaatatacagctaagacttaactgcagtagttaaaacaagaatctactgagggtaaaggataacgaaaggaaaacaggtgccaaaaggaatagacatcttgctattctggtttcttctgtagttcctccctttctagctctcactttaatgataggcattgtttcaatatatactctgtagaaacatactgcagatatttcaacttctcagaattccaaagaaatgatacatcatttcctttccccagatcagcttgcttgctctgcctgcctcaatctattctaagccgaatagataatatgaaaacaatgcctctgaaatttacttttaggaaatcataactttagacgtacagttgatcctcgttatttgtgagttctatgtttgcagatttgcgtagtcactaaaatgtattttaacccccaaatcagtatttgtagtatgttcacggtcattcacagatcagcacaaaggggtgaaaactttatatcattcaacacacacgttctatgctgagatctgataaggcgtcactctgacttcttgtttcagctctcctgcgatatataaggatccttttcttggtctacgtagtgccatgctttttgcatttttgtgctttttgtggtgattttgctgttcaaaatggtccttgagcatagtcctgaagtgcttctggtgttcttgagcacaagccgactgtgatgcgtactgtgtttagataggcttcgctggaagttcaatgtcagtgagtcaacaattgctattaaataaggtgaataataaacctcacatgaagcaaggttatgtattgatgggtgaccagaggcttgcaggaacctaaccctgtatttcctccagtggcagtgattccgtatccagtcattcagtgttcacacgggctttatagaacataactaccgaggagaacgaggcttgactctgtataatcatgaaaattgcatattagaaagttttctcattaataaacattttttccccaggagtaaatgcaaagggacagcaggtatttctgaaagatatctggccgactagagacgagatccaggcagtggagcgtcagtatgtcatcccggggatgtttaaggaagtctatcagaaaatagaggtgaggtcccacactgccctccccgccccagaggatctaagggaaagctgctccctttgtgtcctgtctgcagacctcaaggctaacggaagtataaactatataaagtaacatttatttcttcagatgactggggaggtggttctccgtcatttttctcctgtgactcgcatttttacaaaccccacctcccccagatgttcccagatttggacaagttggtgacagcctagagaagaaaggcctcctcaggttcagctctccaaaaccccacgcctttctcggacacccaggggtgtgtgtcagctgtggcgaggacccctggtggtcactatattgtgtcactaagtggagtccattggtcgaatgcacctctcagaatgcatttttgcacacttaaaaataaagaaattaaggccactcagtaggaagtgccaaactactgaaataaaactttccgtgcattttacaaataggaggaaatgtgtggggctcagcattatattctgagactcttggatattattcctttccccgccttctgcattcagctgacccaagggcttctgactgcggctgatggtttaaatgagggtagaactgtctaggggaaggggtgatgtaggtgtgatgttcacacgctgcactcttcacaaggtgctccttgggagatggtgttagggagcttggcaggcattatgttaaatgccttcctccaaaggccgagttaatggacctgtggacagaattcaaaccaattttaatgcatagcagctgtcatttgctacccagtgtttgtgtgacctggaaggccacttcccaaaacactcagagagtaatttcccctttggtacaatctggattattatttcataagttattgataagcatatgcattagttatctattgctgtgatatagcaatagatatagtgagttgaaacaacaaacatatattgtctcccattttctgtgggtcaagaatccaggcacagcttcactgtgtactttcacagggttccagtaagatgtcatctggggctgcagtctctggaggagggtccacttaggctcactcatgtggctattggcaggatcaagttcctcaagggctgttgcactgaggtcctccgtttctcactggctgttcgctagaagcctccctcagcaccttgctatgagggtctcttcatgactcacacatggtagctggcttccatcagagcaagagagcaagagagtcagaaggcaggtctcaataatctaatctaggagatagtcactagcttcagcccacactcaacaggagggggtcaactaaggatgtgaatcccaggaggcaggatccctcctgccatcctagaagctgcctatcacggtgcatatgtatgttgttgtttgtttttcagagaccaggtcttgctttgtcacccaggctggagtgcagtagtgtcatcatagctcactgccacctcaaattcctgagctcaagcaatcctcccatctcagcctctcgagtagctcggactacaggcacatgccaccacacccagacaattttttttttatttttgtagagacatggttttgccatcttgcccaggctggtcttgagctgctgggctcaagccatcctcccacctcagcctccctaagtaatgggattaatagatgtgagctaccatgcccagcccacagtgtctctggatttttaagttacttagcatgacccactattagtataaaggaactcttgtatgtggctattgagaataaaaatggttcttagtgtaccttttagcttgaatgtatgttttgtgtttgcatattaaattttctctggaatgggatgtgattagatctgcctttcttttcttttttaagactgtgaatgaaagctggaatgccttagcaaccccatcagataagctgtttttctggaattccaaatctacgtatatcaaatcaccaccattctttgaaaacctggtatggctttttattttttaacaaaatgaattctttgaagggtttctttcctaataatatctactttattaccccatgctcttgctttgactacccattttattaaaccctttgcaaacccaagcagatactgctggggaaagttttgggaggctgggatatttggctgccgtgggtctatagtttctctatgcaggggttctgcgtggatgtacacagccaccctagtaatcacctggacttaaacctagtagagtctgagggactgtcccaggagaccatccccagagcccaccatagtgaaccttatacccataaaaaccagggacattgtccctgaaactgatgatctagaagttggtgctctcctgggtgggtcactgtgggaagggatgcagtagaagtgaggattccagttgtccttagcatctgaggagttctagggatgtgaagagagagaatgtcatttgcagctgcgttactgttgcttttgaggggatattgccagtattttaccttttcttcaagagtaagatatgaatgttttgagtaaattcaccttacttttcttggcctctttgataaaaactagaacactagaattttctgtgcattggtgtggaactgtcctctgattcaggtccatgggccaccatcgtagagactgatctggtaacttgtttgggaaaacctgggccaatgctgactttttgtattctttgctagactttggatcttcagccccctaaatctatagtggatgcctatgtgctgctaaatttgggagattcggtaacaactgaccacatctccccagctggaaatattgcaagaaacagtcctgctgctcgctacttaactaacagagggtaagtatgaatgaggcaggaaggactaaaggcaaaaatggaggaatggagttaatgaggccagcatttctcttttcacctggccctttggaatgagactctttggttgtgcactgaggcttaaccctggggtaaaaaccaattgcattttctgtttgctgcttaacagcttccatgggagaaacgatcaacatgtgaatcctaacaaggggaaggggagagggaccttcatttgagcaagtgtatatattaggcccaactgtcatccctgcccccggcttggctgatctttaaagtacaaggctctgctcttaacctggggcagaggcagaacctgacacgcattgccaggtcctggttgagaaacctaacgtttacagagcactgcttggaggatttgcagcttactcatctgtttatcagttcttcagtagtgtgctgatattcataggtatgccagtattatcaactactgtctcatatattaatcgaggtcagtggttccccaatctgagtttccacgagaatcacgtgaggacataaaaattcctggtttctatccccatctgctgaatcagttctttcagtgattccccagagcgaatttgaggaacagaatccaaatgccttttttctattgattgttgagcccttttgaggcatgaacacgtcagagaattgaatgaaagcaaatctaatgccttcccagaaaaatgcacatacccacaacattttggatagtttcagggattccaagacatactcacctgctcctgtaacccattaaactctctcagtccttaaattctatctaaccattgattaaataatattaacacacccaccccctagtattttaaggaacagctcagtgaactggtcacggtgttaattgtaaggtatgtttcctgacactgcaaagtttcctttcactgaggccccacagacaagatttcctctggtttggggaccagaaatagctgttctgcctctttagcactgcctcgatttttctctcatgaaagttgtaagttatgttgccagctgtgtgtctttcctttgcattgagttcctgataattcagggacaaatttgaaactatttctggttactttgtggaacgtattttgtgtttccccctgtttgtggctccatctgatttgcctaccctaattcttccctttgcttccattttctcacttatttttaatttagctctttatcttatatgaagctttataggctaccctactaacaaataaaacattcttttttagacttccttcttatttttctaaccagatttgaaagacaattaacccaggagaatactgacttatgcctctcaccaccccttctcacctctctctcttctccgttgaagctttggggacagcttttctgccatggagaacaatgcttaggagacttagagaaatagccaggtctatgttttgttttgttttgtttttttcttttcttggtgtaagctaaggttaatctttgcttgcttcactaagccagctcctttcttgcttgccttcttagcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatcgtgagtattgtcttctgcttcctgcagacactagcatttgtcagccttggtggaggttggatatttacagttactcgccttttggttttagtttttcttcacagctccatcctaccctaactacagtcctccttgccaggtgtccatatgcatagaatgtatcattgacaaattcaaaccttttcttcttgcttagagattctagaccgtggtttcactgagtctcttttcttaggaattgagctttgagtgacatttcatttaaagtattcgaaggggaaataccaggttaaattaaaggatatttatcaagaagtgctattgtatgactttattggcatgtaatttaattcatctaatccacatgaaaagaaggagtagagaggtgcttggaggcatgttttggttctaatgggagcactgtggtcagtatgttgcagcagggactgtttgttcccagctccacgttatactagctgtggagccttaaagttatttccatctctgagccttgcttttctcacctgtgaagtaaaaatactacttaccttggaagaacgctctgaggcttaaaatgaaatggaatgaaatataaaacctagcatagagtctggtacatgtcataggtccttagtgtcacttcccttcccagtgagtgctgtgaaattgcctgtaaactgtttaacttacttgagaaataaccctgccgacttattttaaaataataatcgctaatatgtctatggcacttaactacattccaggtgttctcctaagctcttggcatatattgatttatgtaatgctcataacaaccccttgaggtaggtaccatgattatctgtgctttaaattgagaagtgaagcataaagaggtcatattactcctttaggtcacacagtggaaaagctgaaattaaaacccagaaagtctggctctgaagtcagtgccctttaccaccacacatactgcctcactcgtaactgattatatttttgtaacacaaactcgttctttagaaataaccagtacctagcccagcagacgcctgttcaatggatagcagaggttacagaatattaaatgtaaaaagatacatgtcgaatgatggaataccttagagaccaaggggaaagacttgtagttatagacattgggggacccctaataaacatcacagtgtaccacacgcatttacaagccctgcatgacatagaacttctagtcagatgtctagaacctcatcttaaatgagacagaatcaaggatgaacagacatttgagtcaagacttgaacagggtgatggggagtgcaaaaagtaaaagaaaaaaattatatacttagagaagagttcattttctgttgctatgaaataacaatcagaagacaagaaagaatgttttaaatttaaaaagaaaattcaaaggagaaggtgattagttgagaacatttcctagaatatgtaacagaaagataagagaaaaaaatgtaagaactgaactcaggaggccctaacaacctgcctaaatagaagtgttaaaaagagaacagaaaaaatgcaagagaggaaattatttcaaaacaaaacaaaaaactacaagcaaaatttctctgagaatccagattgaaaaggcccactgaaggcccatctaaataattttaaaacactccaagttatatcactgtgaaattaagagcaacaaaaggagaaatctcaacatttccagagaaaaacagctcacatgaaacaacaggaaataagacatgttccagacttcttgatgctagaaacttagactgaggaaaatgatttgcatcctaaaatctacacccatcagaccatcagtcaagtgcacttaaagtaatgacacattcagatattcaaaagcttaaaaaagccctcaataccttccttaggaagctacttggcaatgtgttccaccaaaatgagggagtaaatcaaaagggaagacataggatccagatgaagggaatccccaggatgctagtgaaggaagagtcctctgtaacaggaatgcaccaagcccagagagcaagcagtcagcccaagttggaacgggactgagagctccaggaatgatagctccatgacagagattttaaaatggtaaattgcctgatgtgtctgaatatctttaaaggtgatttgtactgtagggtttaattaatgggtaaggacatagaaacaggaaaaacatagaaaaaatgaaaattagtaattttcaaaaaaattcattcaaaacaaatgaaaattactgactccagtgaaacatgtcttaaatcaccaagaaaaggaaatcacagcacattacctggctcagctgtaaatagtatttatgtagtcataatcatgcaaacaccaaatgctgacttaccaaaataactatattgggaggttgggaagaagggagatgtgtggaagaggagagattgttaagagaagtaaatcctcaaagtagaatattgacagataattttaaaaagtggagaaatcaagaactagtagtttaaacataatacctagagatacacaggcacagtaacagaagaaatagctaaatgctatgttctctttagaagagcgtaagagtgcagggagctgttgctttctaagctgtcagtggctctcagcatggcgtgtttaatagaaaagtcaggagacgtgagttctagacctgcttagtccctctgatcttgggtaacatgacgtgctttgccatgagattgtcaactttgcagtactttttaaagcacacactctcacattgttaatacccaaagctacagtctctgaaaatatcagataagttgtttctttctggtctttgaaaggatccagacaattcagttagaagaaggttttcactgtttctatgacagtttctatatttacgagttctgtctagctgaagacatacagaatcctatccgggtttaggtaatgcatgcgaaattaaccacaggttccatcagtacaccaaaatacaaatttgtgaaagtctgtttgagagttttctttagctcctgtctctcttttgaggaattttatcttctgacttacatagcctggaaaaataatggtactgctcaaccaccagagatgatatcatgtctttgtaaagtctcagttcagtgagatattcagattccctgtgagaaacaaatctgtttgtataagatgtttctcatgtactaaaatattaatctttttctaccttttattgggcttccatttgcatttctagcatctcttcccttgacctccatgaagaaaggggactgataaaagtttgcactttatataatttcagaacatgttaccttctttgtgttttgctaattttacaactgacatcaccgagtttctgatattgagccaaaatgtttaggtcacattctgttttttgagttttaaaataatttagtcaatggaaaagaaaaaatctgatctagtttccttttctcccctgatgccttaggattctaatgtttttataaaaccaacaacaattaggcatttctgtcaaaagaatataaaatggtttttaagaatacaaaatttaaggccggatgcagtggcttacgcctgtaatcccagcactttgggaggccgaggtgggaggatcacttgaggtcaggagttcaataccagtttggccaacatggtgaaaccccatctctactaaaaatacaaaaattagctgggtatggtggtgtgcgcctgtaatcccagctacttgggagactggagcaggagaatcaattgaaacccgggaggtggaggttgcagtgagctgagatcgtgccactgcactccagcctagacaatagagtgaaactctatctcaaaaaaaaaaaaaagaatacaaaatttaatttggtagaagtaaaaagatcaagataattgggaatttgtagacaagatgattggacggatttggccatctgcaaacccatccagccccgccctcaccagggctcaggggacctgtgtccattctttgcctctcctgcatctgtaaaacttccttttctcttcctcagcttgatgtgtttgatgctgctgagcggtaccagcaggcaggccttcccctgatcgttctggctggcaaagagtacggtgcaggcagctcccgagactgggcagctaagggccctttcctgctggtgagtatgaagtagacatcctaggaggcagctcccctctgaactgggagggtccccaggcacaaatcctgttgctttactttccaagaagatgtcaaggaagagcaagctcaaaaaagcaggtagtgtttattcctggcctgcttcttggtgcctctggatttattttatttggtgaagggcaatgcagagttgaactggatctatcattcattaatggaccttgggggcatgtctatagaacagttttggggtagggtctgtgaagtctctgaaaacatatccagaagtatacatgtatgtctttcatggggagaggtgtcatggcttttataacattctcagaggctgaggaccccaaatttattcaggtcccttgttccaggtgaatgtcaggaataagccagggccattgtattatctgtcagtttcacagaagagaaaaggagcctggactttttcaggagttactttggcaagaatgggttctaagtctcctggaaaattgggagaatcactttttataattgcacttcactgcctatgaatatctgcttatgggctctcgatgagagtgaaactcactctgcacatacccaggcagctctttagaaccttccgccatctcggggctctacctcttgaggtgtccccatagaaggggccatgcagggagcagagagcttttgcctcttgagcatttgcttgccctaaaagcagagaagaatcatgccacccagcctgaatcttcagggtggggtacacatggcttacctgatgtcaatttaaatcatttgtggctcgcaaattaatgcacctcggaaacactaagttcatatccacaagtacagtaaaaaaatgtggctgtctggcaggcagttctccagacatttaggcttctgataatgtctttgaacatcacacctattattttaattggttattttgctctgaggaaaatagaaatgttctctgattagttgatagtaggtcaaaggcctgtcttttctggaaactattgaaaagaaccagataattgcagaagaaaaggattttaggaagggggttgggagctgtagccaaaatgcaacccaggcagtcagcactcaggtagggaactctaagatctgatagaggataagaagagaactggcccccaggggttctctagagtccagacttttctatagaaccgcttgagttctggctgcccaggaagccatacagtcttctgttctgtagctgtccaggctgggccacgtagccgtgctggactgtacttacagagagcagtggacagctatgatttacagcttctgaagcaaagcagcatggcctttacacagagctagtgacatgaatagggtgtgtttagaaagctttctacctccctagaatacatccatctatccctaaaaccctagaaaagatctaccgccccaaagaatctgccctctctctgtagcagtgcgtctcaagtttggaaacacttatgggattttttttttttaatactttaatacctgtgtttggatctcatctccagagattctggtttaattggtaaggagaaaggcctggacattgggattttaaaagcctcccctgctgattctggtatgcagcagtggttgagaaccattgcgctatagttcacggttctcaaaattgtaagaatcactagccccctcccaccccacgctccctgcaagacattctgatgcagcagatctggggtagtacgcaagtatctatgttttcaacaagctcctaaagtgaccctggtgttgggcatcttaaaagtgtgccctagataccaagagacctcttagggtattttaatattatatgacagttattaattattaataataaactaatggggagttctagttaatggagtaccatcctttattgctgtatattgccaattatagattcccaataaaacatactttaagcttaatatcaagactatattcaacacaatttcatctttgaagcaggaagtgtaaaagcagtacacaagaggtaatcatttactttatctgtggtatgttctgaaagttgcttttttgattgaactttctgtgcctgctgatacacctaaaatagtagaaaaaaatcaagggaaaaattttatgttgttttgtgatgtggattccagatacaatgtaactttgctaaaacatgttatatcatttgtcagacttcatgggtccaattaccagataccagcactgactccctgggtaaagggggacaataagggcatctacatccccgggttagtggatggtggaatgagaggaattatttaagtgcttacatagtgcctctacattatgagcaatcagtgaagactagctattgtgttatttatcactagaggataacattttatgtaaaatattaatatgtacttacaaataatttaggtgtgagaacagttctaacttacaaagtcttttgtttatttttgtttttttaacaatcaccggctcaagaagcttataatttggggtagggcacagaccagtaaatagacaattacaaagcaatataacagaagaaagcacggtgttatgaggcaaaaataaggaccactaactgaaaatttattaagccattttctgtcatcctagatgtattcaagatgtaattcccttagagtacaaagttaatgtaaaaaaaacgcttcattgtgaccttcagtctagaagatgtatggcaaaattaggctgaagcatctttttctcctgtgacattagacatctgatttcactgaaatatagcacacaattactggaaatgagggcctataaaagtccacaaaaccaagtgacttttcaagatataacagaggtaaaaggttactgtcatcactgtctatgaatcatctcattatcgatattctagactttgaagtaaaataataaaaagtttacttaaagcaacagcatcagataattaaacaattctttggtatttaatactaatatttcagaaatagaactccagagtatttccagatgtgcatatgctgatcgatttttaggtttatcatccttcgctttataacggaagtcatttcttatacattgatagaatgtagtatgagtgtagtgatatttttcactctgacattaactaaaaacatggtgtaaatggagaattatagaggtagcaaggcaaaggttacaaaatatatgcaaacatttttgtttatttgtatgctgtatttcattgttgtgtttttattatactttaagttctggggtacatgtgcagaatgtgcaggtatacatgtgccgtggtggtttgctgcacccatcaacccatcatctacattaggtattcctcctaatgctatccctcccctagcccctgacccgccaacaggccccagtgtgtgatgttcccctccctgtgttcatgggttctcattgttcaactcccacttatgggtgagaacatgcagtgtttggttttctgttcttgtgttagtttgctgaggatgatggtttccagcttcatccatgtccctgcaaaggacatgaactcatccttttttatggctgcatagtattccatggtgtatatgtgccacgttttcttaatccagtctatcaatcattgatgggcatttgggttggttccaggtctttgctattgtgaacaatgccacaataaacatacgtgtgcatgcgtctttatagtacaatgatttataatcctttgggtatatacccaggaatgggattgctgggtcaaatggtatttctggttctacatccttaaggaatcgccacaccatcttccacaatggttgaactaatttacactcccaccaacagtgtaaaagcattcctatttctccccatcctctccagcatctgttgttccctgactttttaatgatcgccattctaactggtgtgagatggtatctcattgtggttttgatttgcatttctctaatgaccagtgaggatgagcattttttcatatgtttgttggctgcataaatgtcttttgagaagtgtctgttcatatccttcacccactttttgatggggtgagagagggcatccttctcttgtgccggttttcaaatggaatgcttccagtttttgcccattcagtatgatattgactgtgggtttgtcataatagctcttactattttgagatatgttccatcaatacctggtttattgagagtttttaacatgaagggctgttgaattttgtcaaagtccttttctgcatctattgagataatcatgtggtttttgtctttggttctgtttatgtgatggattacatttattgaattgcatatgttgaaccagccttgcatcccagggatgaagcccacttgatcatggtagataagctttttgatatgctgctggattcggttttccagtattttattgaggatttttgcatcgatgttcatcagggatattggcctcaaattttttttggttgtgtctctgcccggctttggtatcaggatgatgctggcctcataaaatgagttcgggaggattccctctttttctattgattggaatagtttcagaaggaatggtaccagctcctctttgtacctctggtagaattcggctgtgaatccatctggtcctgggctttttttggttggtaggctattaattactgcctcaatttcagaacttgttattggtctattcagggatttgatttcttcctggtttagtcttgggagggtgtatgtgtccaggaatttatccatttcttctagattttctagtttatttgcgtagaggtgtttatagtattatctgatggtattttgtatttccgggggatcactggtgatattccctttatcattttttattgcctctatttgattcttctctctttccttctttattagtctggctagcagtctgttttgttgatcttttcaaaaaaccagctcctggattcattgatttgattttttgaacagtttctggtgtctctgtctccttcagttctgctttgatcttagttatttcttgccttctgctagcttttgagtttgtttgctcttgcttctctagttcttttaactgtgatgttaggatgtcgattttagaactttcctgctttctcttgtgggcatttagtgctgtaaatttccctctacacactgctttaagtgtgtcccagagattctggtacgttgtgtctttgttctcattggtttcaaagaacatctttatttctgccttcatttcattttttaccagtcattcaggagcaggttgttcagtttccatgtagttgtgtggttttgagtgagtttcttaatcctgagttctaatttgattgcactgtggtctgagagacaggttgttatgatttccattcttttgtgtatgctgaggagtgttttacttccaattatgtggtcagtgttagaaaaagtgcagtgtggtgctgagaagaatgtatattctactgatttggggtagagagttctgtagatgtctattaggtcagctttgtccagaggtgagttcaagtcctggatatccttgttaactttctgtcttgttgatctaatattgacagtggggtgttaaagtctcccactattattgtgtgggagtctaagtctctttgtaggtctctaagaacttgctttatgtattgggtgcatatatatttaggatagttagctcttcttgttgcattgatccctttaccattatgtaatggccttgtctcttttgatctttgttggtttaaagtctgttttatcagagactaggattgcaacccctgctttttttttgctttccatttagttggtaaatcttcctccatccctttattttgagcctatgtgtgtctttgcacctgagatgggtcttctgaatgcagcacactgatgggtcttgactctatccaatttgccagtctgtgtcttttaattggggcatttagcccatttacatttaaggttaatactgttatgtgtgaattggatcctgtcattatgctgttagctggttattttgcccattagttgatgcagtttttcatagcatcgatggtctttacaatttggtatgtttctgcagtgactggtatcggtttttcctttccatgttcattgctttcctcaggagctcttgtaaggcagacctggtggtgacagaatctctcagcatttgcttgtctgtaaaggattttatgtctccttaacatatgaagcttagttcggctggatatgaaattttcggttgaaaattctttaagaatgttgaatattggcccccattctcctctggcttgtagggtgtctgtagagagatccattgttagtctgatgggcttccctttgtgggtaacccgacctttctctctggctgcccttaacatttttttcttttgtttcagccttggtgaatctgacaattatgggtcttgttgagtatctttgtggtgttccatgtatttcctgaatttgaatgttggcctgccttgctaggttggggaagttctcctggataatatcctgaagaatgttttccaacttggtttcattctccctgtcactttcaagtacaccattcaaacgtaatttggtcttttcacatagtctcatgtttcttggaggctttctctgtttcttttcactcttttttctctaatcttttcttattgctttatttcattgagttgatcttcaatctctgatatcttttcttccacttgatcaattcagctattgatacttgtatatactcacgaagttctcgtgctgtgtttttcagctctatcaggtcatttatgttcttctctaaattggttattctagttagcaattcgcctaaccttttttcaaggttcttggcttccttacattgggttaaaacatgctcctttagcttgcaggagtttattaccacccaccttctgaagcctgcttctgtcaatttgtcaatctcattcaccgtctagttttgttcccttgatggtgaggagttgtgatcctttggaggagaagagccattctggttttcggaatgttcagcgtttttgtgctggtttctccccatctttgtggatttatttacctttggtctttgacattggtgaccttcggatggggtctctgagtggatgtccttttggttgatgttgatactattactttgtttgttagttttccttctaacaagcagactcctctgctgcaggtctgctggagtttgctagaggcctacttcagaccctgtttgcctgggtatcaccagcggaagctgcagaacagcaacgattgctgcctcttccttcctctggaagctttgtcccagaggcggacccaccagctgccagccagagctctcctgtatgagatgtcttccagtcaggatacatgggggtcggggacccacttgaggaggcaatctggctttatcagagctcaaatgctgtgctgggaggaccactactctattcagagctgtcaagcagggacatttaagtgtgctgaagctgcacctacagccaccccttcccctaggtgctctgtcccagggagatgggggtgttatctataagtacctgactggggctgctgcctttttttcagagatgccctgcccagagaggaggaatctagagaggcagtaggccttgctgagctgcggtgggctccacccagtttaagactttgtttacactgtgagggtaaaaccacctactcaagcctcagcaatggccgatgcccctctgcccaccaagctcgagcatcccaggtcaacctcagactgctgtgctagcagcaagaatttcaagccagtggatcttagctttctgggctccttgtgggtgggacccaccaagccaggcactggagggaatctcctggtctgctggttgtgaaggccatgggaaaagcgcagtatctgggccagagtgcactgttcctcctggtacagtctctcatggcttcccttggctaggagaggaagtttcctgaccctttgtgcttcccaggtgaggtgacgccccaccccacttgagcgcatcctccatgggctgcacccactgtccaaccagtcccaatgagatgaaccgggtacctcagttggaaatgcagaaatcactcgccttctgtgtcagtctcactgggagctgcagactggagctgttcctattcggccatcatgccagctctctcacaaagtcttttgtaaacctgtgtatccaaagaaaagattggaagtatgtctaaactactgtctttattcatcagggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaaggtaagctggagcctctctatgccaggccctgtcgaaaggggccccctcgtttgtaaccagtcttgttagaaggaaattagtgaggtttagaaggcaaaaaatatcactcaggaggactgcattagacttaggaggcctactagcatcttttctacctgccttcatagcataggatgatgcctatggatttaatttctctgtttattcacagagttatcctcagttccattcttacctcccaccccctactgtaccctgttcccggtctctcgtgatgagagctcagggatgtgacatttcacattacctaaaacatttcactataaaaacgtgagcaacagatatactcacccctccctaagcctgcccataggcaccaggctttgattagcccaagagtgaaaatgatagatccctaggcaaggtaaagataaagtgcccagcaccaggtcccaggggtcattcggtgccccagacagaggcagtgcaaaagtctgtgtctcagataagcagatgggccagctgcctaagggacaaccttaatgaaatctctgctgattgaatacttctgtccacagggagcccccagaggtttagaaaataccaccctgatgtcattaatagctactgccctgagaagctatttctagttcttagatggctctcacccccatcatttacagtctgcagtgattctcaaactgtaatgggcaaagcagcctcccagagatcttgctgaaatgcatcttctgatttagtgggtctgggctggggccagcagccttgcatgtcctcatgtgctgctggtgttactgaagtgtggaccacacctgaggggcaggctgggcagaatttcctccgagcagagctgtctcgccacctccctcaatgatgcttctgtttctttgtgccacagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtg

SEQ ID NO: 36897 - DNA, 2715 bp, Homo sapiens
gagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggtaagctcaggccccagggatgggaaaagaggaggaagggaagggcaaaaggaaccgggcccggttcatctctgggtctgttgcagtgaactgtgccggcacggggtcagcgcgatctccagcgtattgcgagttccccgatgggctgctagggccccattgcaggacccttatggactgcatgcagggtcgttgcacaacccccgccgggccagctgagtttcccagcgcattgctaagctcggccgggcggcagggggttccaggccattaaatggctcctgcaggactacctggagtcctaaatcttggatgccccttcctcccctccctgtgtcggactgcgtgcagccccaggtcactgcttgactgtcatgaagctgcttggagcactttcattgcatggcccctactggacaactagacttttcagacccgttgcacttggtgtacatatagactcttatacacatgctcaccagcatcctgattcttgaatcgcatggcaggccctgacctttgtaacctcttgctgccaggctccagtgggcactggtagatctggaatgcctggcccttcactccacctctgtcttcccccaggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggtattggggcctcaggatggagggtagactgtgggttggcagctctagaccttggcctgatatgctgacccctctgctcctcaggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggtgagttccaagtctgaacctaaccccagccccattccctcgaatctagaatgaaaggaccagttttttatcccggatctggagcagagtgtttacctgttctggccttcctttctttgcacctgtgggcaatcctgatcttgacctctttctgccttcccaccaggcttccagctgaccagcgccgtggctacaaaaatgtgtttaacgccctgattcgaatcacccgggaagagggtgtcctcacactgtggcgggtgagtggaggggctggagacttgggggctgtgaggtctggttttaggggtttctgactcttccccgctcccctccctccagggctgcatccctaccatggctcgggccgtcgtcgtcaatgctgcccagctcgcctcctactcccaatccaagcagttcttactggactcaggtgagatccagagctgggcccttagttcccagcctggcctgagccacctctgagctgactgccacccccgcctcacctcccccaggctacttctctgacaacatcttgtgccacttctgtgccagcatgatcagcggtcttgtcaccactgctgcctccatgcctgtggacattgccaagacccggtgagtgtgcagcctgggcctggaggtgggtgggagggtgccctttcggtctctcatgcccctgcgtcctctcctgcagaatccagaacatgcggatgattgatgggaagccggaatacaagaacgggctggtgaggaagccattctgggggcctgggagggggtgtcggatcccctgggaaaggtgtgaaggcagctgggtgagggggatggggacctagagtcctagccccagcgccctgcctgtctgtgtctaggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacaccagc

SEQ ID NO: 36898 - DNA, 65674 bp, Homo sapiens
ctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcaggtgagcggcgggggggaggccaggtgccgggttgggggggtcctcacgtctgtgggtctggtctatcggggggcccgcaggacgtgtgcggggtgtgcggggtgtttgagggtccggatgtgcgtcccgaggtcggagggttggacgcccctgtgtccagttgttgggaggggtgggaggcctcgccctgctgttcagccccttcccctccactgggccgcgttcccagggacgtgcaacagggcgctcaggttaggagacccgaaaccacaggcagacaggacccgccacgcccgctcccagccctgggcacccccacccccgtttccttccagtccattttccgcggcagtttttggtcctggggaccgtcaccgatgcctcccacgcacgctttcttccctgaagggagacgtcgctgcgctgggcctctcggcggtcccccccacccgggtcccgggcccactggccccccgcagacgccgctacacgctgactccagccaggctgcgctgggaccacttcaacctcacctacaggtgcgccctggctgggccccgggggagggggcgcggccggcgcccgctgagctcactctccctgcaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctggcctcctggaggcctctcctctgcagcacagtgggctgccgcggtcgggctttggggcagacggcaggagggaccttccggggtggtggctgccactggagtctagcaggcaaggaggggagcccgtgggagcccccatcccggcagccctgaattccttttcccatccccctgcgcctttggagcgggagctggagctgcattcctgggggccgagctcaccgcctgggcccagaacattcttatctttccgtggctgcggccgagggcggctccgcggctgcgctccagcagatacaccgggcctcggggagctggcccacgggcggcggggctgggcccggggctcccaggcgctgacccccggggcccgcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggccgtgctccccacgctcccgacaggatgcctcgacaggctgttcgtgtgcgcgtcctgggcgcggaggggcttctgcgacgctcgccggcggctcatgaagaggctctgccccagcagctgcgacttctgctacggtgatgcccacggggccgggacagggctgcgtgggagctgggccttggccatggtcggggctgagggggcactgacggggctctttcccccacccggagcagaattccccttccccacggtggccaccaccccaccgccccccaggaccaaaaccaggctggtgcccgagggcaggaacgtgaccttccgctgcggccagaagatcctccacaagaaagggaaagtgtagtgagtgagcgccccgggcggtcctcggggtgggcagcccgcgggcggccttggggcaggggtgcggggcaggcagcggggggggctgtgcctgcaggagacgccccgcccccctgcagctggtacaaggaccaggagcccctggagttctcctaaccccggctacctggccctgggcgaggcgcacctgagcatcatcgccaacgccgtcaagagggcacctacacctgcgtggtgctccgccagcagcgcgtgctgaccacctactcctggcgagtccgtgtgcggggctgagcccggctgataaagcactttctctctgatggctcctggctcattcttgggagggcagcgggcagccagtctgggcaggtggacaccccagcccctggtccaccgagagctgggcgtcctcggggctgggcacccctgcttccccgcacagcggacaacaggtacagcacaggacgggacgggctttgctaaggtggcccctgggaaagtgggataagcggaggccccagtgacaggggcagcacgtggagcagcacctggggtagccccagaagcctgggttctgtctaggacttgctcagagctgggggagggaggcaaagggggcttcctgaaagatgtggctgggatgggcctccaggatcttctgcaaggagatgtgggtgggggctgggaggactggcacagggtgggggaccaccttgccagagtggaggccccccaggaggtaggagctcccctcctgcctggggaagacactggcccacatggggtcagaggccacagccgcccaccccaccctcttcccctagagcccggtggtctgcgactcccctcccacacatggtcccgggtcactcaaaggacgacacggggagccttcctcgaagaatattttaatacattttaaaactcaacaaccttgtataaaaacctgtcgagtctgctggcacagctggggctgggggttgggggccgggggcctgtgtggacagggctggtctggacgagtgggttggggcaagagggcatcgctcatcccaacacagaaacaggtctccagctccgaagattaaacaatccacccggctcccaccagttcctttccaaatcacggcccagccagccccgtgcgtgtcgagagtgggagagggtgtgtggaggtttgtgctgccccacgtgggcacccgaagatgccctggcaagtcacggagaaaacacagctctttcctccacaacaaggaaaatgatttaattctacaaatttacaaaccaaaatacaaaaacaaaacatggagcacaaagtaagacgaggagttccgagtctcatcgcagctccagccgcagtagccacgcctgtggtcccggctgagttctccccatgacggggtccactctgaccttcagaacttgaggctgaagccggggcccgcggcagaggccccctggttcgtggtggtaaggtggaagcccgtctccttcaggtcgtcgtcaccctgggacgagtcggctaccgtgagaaccctgcccaagccagccccacctgtgggcacgccccacccgccaggcccctcaccagctggctgtagcccaggcctccctcagggggcctcgggctggtgccccgcttcacacgctgctgctcgctcttggcgggccacgtggggaacatggaggggtcgatggggaggggggtctcgcggaaatactcatgcttgaggccgtcctcagcgctgatcctcctcccggggaagtaggtcaggaacctggggggagagggccagaggcccaggaggtgctcgtgtgctccactgggtcccccaaagatgggctgtgttgggacggggctcagggcatgggacgccaggcaccagagcagttctggaacgtggtgagccagcaggtaggcctgggactgggaagtcaccgctatggctcgggacctcccgccacccggctgcactgggctcacttgttcatgaggtcgaagccctggtctgagagcagagccccgaagcgcttgcggaggttgttgtaggggtgctcgctgaaggtcatcttcttgactgctgggagctcgctgtagccgggccagattttctcactaggggtccccagatcctgaaagacagaggtgcttcaacagccacaccaagtggcccacagtgttggcacctgtgtcccgtcagagaagacaagccaccaggagggctctcagtggccctggtccccatctcaacccagcacctgtgcgccccgcagccccattcctgcaactcctccacaaccccacagcgcacctgcagcagggccagacccaccttgaacaccttgttgatctgatcgatttctgacttcccggggaacagaggcttctgagtcagcagctccccgaagatgcaacccactgaccacatgtccacggccgtggagtattcctaagaggtcaggagaggtgttcaggagggccagtgcccgcgaagctgtgggaggctgcgtgggggacaggggaggcactcagacgcccaggactcaccttggcaccaagcagcagctctggggcgcggtaccacagggtcaccacgaccggggtgtaggccttcagaggggatccgtactcccgcgccagcccgaagtcacccacctgcaacgacagatgggcggctgtgagtgggccccggcaggtctccctgggatgggccactcggaggggggctcaccttgaggatgccggcgtggctcagcagcaggttggacgtcttgaggtcacggtgcaggatccagttgtcgtgcaggtgtttcaccccacgcagcagctggatcatcagggtcttcacctcccctgggagggagggaagctcccatgtggacctggctgcccccagcccagggcactcagggtggcccactcgcctcggcagcaacagaggcttctcagggctttccctgtggatgcagctggccctccctgcagcactgtcaccgcgggggtgaccaggaccctgcccccacttgtacgcagacaggcccctggggcgcggctgtacctggcaggaagggctgtttcatggtctccatcaggctcttgaggtcgtgctccacatagttcatcacgatgtagatcttgtccatgttgctgcccaccacaatctcctgcagggcacggctctgtgggtgctgggcacctccaggcccccacccacccctgcacccgggtgcagctgctgagggacagtaaggacctccggtgccacccgggaggcaaatgcttgcttctgtgtggtctgtgaagggctccactaagtgcaggagagtgtaggaagcacccggccccaggacagcacggggccctgtcagaaaagccttccacccggggccaggcgtggtggggccatgctcactctaacggtgacgatgttgggatgctgggccttgaggatggtgttgatctccctcagcgacgtgatcgggaagccctccttctccttctccatcttcagccgctttagagccacaatttcatctgtgaagaaaatacagacggcactgagaggcattctcaaagtcacggtaccaacagtggactcgttcagtgaggaccgcaggcagtgcccaaagcgccagcatttcacggaggggggtctcgttctaggtgggggcacgtgggcaccaggagaacgccccagctgaggtctgggcaacacccacggcttcccactcaacacaccacagacactcacagccacctacagccacctgggatcccagcggccacgccgactccacatcgacttccccaacagagccggcctcacctgggatcccagtggccgactcccaacagagttcccggctcacacacctgcttgggtgggacgctgggaacgcaaacctgcacaccagccccggcacagaccactccacgcgctgggcctcggccctgtggggcaggccgcctgctactgcaagggagtggcaaagccccagggccaggctgacctctggcttctagaggtgctgaggggtccaacctccagtagctgctcaggtgaggcgggcccaggtgcagtcgcagctctcgggcagccagcccctgccccacttcccctgcctttgtggggtgaggggaccccacccacctgttttcttgtcttttgctctgtagaccactccataggtgccctcctcgatcctgttcaggcactggaactcctcgacgctccggcagccctgggaaggaagcgcctgtgtgaggtctcagtggccatgccagctggagggagggcggctgcgtccacaggcacggcacacccggcacggggcaggtgcagggcagagccttgggactgggccgggggtggagccgggagcagctcagttctttcaaagtctctttccttgcaaaaccatctgacactttattatgaaacaaaaccagtgtgaacaaaaggccatcccagccaggtgcaagggctcaggcctgtaattccagcactttgggagggcaaggcaggaggactgcttgagcccaggagttcaagaccagcccggccaacatagcaacactctgttttctattttttttttttttttttttgagacggagtctcgctctgtcacccaggctggagtgcaatggtgagatctcggctcactgcaacctccacctcctgggttcaggcgattctcctgcctcagcctccctagtagctgggagtataggtacgcaccaccacgccaggctaatttttgtatttttagtagagacaggatttcaccatattggccaggctggtctcgaactcctgacctctgatccgcccaccgcctcggcctccaaaagtgctgggattacaggtgtgagccactgtgcccggtcaaaactcctttctacaaaataaaaaaattagccaggcatggtggcttgcgcctgtagttccagctactcaggaggctgaaatgggaggattgtttgagcctgggaggtggaggctccagtgagctatgattaagccactccactccggcctgggtgacagagacagacccagtctccaaaaaaaaagccatcccaagagtctctttgtcaaactggatgtgtcccctgcttgtaccaggatgacactgaggacgggccctacctgccaggcgcagcatgatgccccatgccagggcacctacccctccgtgtaccttggggccggtgcccaggccggatgtcatgtactcggggtggcctgtggcccgacgcctacgctcagcagcactaaggggcagaggcgctcacaaggcatagggcagtcgacagaggcctgctgcatgcgccagagagaacctctccgcccacaggcaccaaggagggggccgagtccctgccggtctcccaggccccagaggccactggcaccttctcaggcttgtcccttccaaatcgctcccaacaatatcctgccttattgatagctgcctaagcaaaaggcttctggtcacacatctacactgactcccgtagccgctcccccatccaagccctgcacagatgccggtaacaaggccttggtgcctacataacccgcccacgcaggggtcaagtggaaggcactgctctccagtgcggaggaggacgcaactcgggcagcagtgacagcagcgcggccgcacgcccaggctgcctttcaagccgcagagcagtcctgcgggcagctccctgtccacccagttccgtccagcatgagaaagaggcgggacctagaagcatgaggggccagtggctgtgcccgcccgtcactgccccagtgggcccagcagccctgtgaggcgacagacgccaacacgggggccaggcttcgctcagcccctgtggtaactccgactgccaatgcggacagtggcctggggcgaggggagggcctgacctgcagggccggcaggtacttgggcagctcctgcttgagctcgatgggcgacagggcaggggagtcgggcacatagtcgccctctgtcagggcgctgctctgcggcgttccctcacccacttcttcctctgcttcttcactctccccggaatctcggtcgaaccgtgactctggaactggaaaagttgaacctaattacgaagctaggagtaagcaaggatcatgaacctcctcctgccccgggggcatcaagcgcgtggcagggctgccccgtgtcccgctgggaggtgctggcgctgggctctcgtcccctggacacagggcaccgaggcctaagagtgctggcaggctcggctgagacagagcccggatgctgagctgggaggaggcgtcgggtgtcatgtgggggacaagcccacatccacgtccaccaggctgaggacataacctcactgcctgtcggaggctgggccaggcctctgctctgcagggacaggcccggagccaccatctgacgggcctcccctgtggggaactggtcctgggcttcccagctcctcggccctgctgggcactcaggacgcccttggtcagcactgtgcctcgctgaggaatgcgggccccaccggcacagcctggagcggccaacgaatcaggcggcctcccagaccctggcgtgccccacgctgcgcaggaccggctgtcttaggagagggctgctgcactcggagacagacaaggagggggctctgtctccagggaggttcttaccaaccaagaggtggttttcattttctcgttcttcatcttcactcatttcttcctcacttacttcttctgcaagagaaaggaggcgtctgctcagaccagcaccggggcgagtgctgccacaggcaggatgcgggctccgcttcagctaagcaacaagtgttcccaagaatggatatgcaggccgggcgcggtggctcacgcctgtaatcccagcgctttgggaggccgaggcgggtggatcacctgaggtcaggagttcgagaccatcctggccaacgtggtgaaaccccgtctcgactaaaaataaaaaaattatccgggcgtgctggcgcacacctgtactcccagctacttgggaggctgaggcgggaggatcacttgaacccgggaggcagaggttgcagtgagccgagatcatgccactgcactccagcctgggcaacagatcaagattccatctcaaaaaaacaaacaaaaagaatcgatgtggaggtgtcccgagagagtcctagatagaagggagtttcaactcccccgcccgccagctacttctctgcggtttctaacactatagtgaagtcacaacacctcacacagtcgtcgcggtgcctcaccggcagactgctctgatgcctcctcagagttgctgccggtctcctcctcctcctcttcctcttcctcctcctcctcctctgattcttcactggtgctcccttcctcctcctcctcttcctcctcctcctcttcttcctcagaacctgagcctgattccgctgtagaaagacagcagagcagagggtgaacctgggccttcctgggcagcagtggtcaaggccttggccaggcggttccaggtacctgacgaggactcggccgagctggtcttcctctcgctgtcgctgatgtcctgtaagtcggacagcaggtccctttcttccattttctcttcttttacttatgagataaaccataaaggtgaatttggggaaatgtttttaaacaaacaagctaccaccaccccaaaactagtgcctttcacgtaacgattaactttgcttggtcggaaaccagctcatccagagacgctggaagccacttctctaacggggccagtggcgaatgtcccagcggataaacacacgtcctgtgtcctggccgcacacagacactcacggtccctctcacgacacgagaggacttcagccagcacatctctcactttcttctgaagcggttacttagctgggctttaaatgaatcctacacacttatgccaaacatcccccagaaaagactcacactgtgctggcttctgcgcaggcgccggcctggcctcacctggcttccggccgtctcccaactcgaaccgctcccgcggcggccgaggcgggctgcgactccagtggctggctttcactttgtcgctgtagtcctctctcatcgttcggtgatgtgcagacactggcgcgcagggcagagagggagatggcactagcagcactgccttcctcaaaaggccccacccggcacagctgcctcgtctcccacacccgcacctggcagacacacccacagcgtgcacagggtgctgacagcatcggggtcagaggccagaggtctcccaggaagcccagggagaaaaagctccaacctggaggccgtgagcccgaggacccaggtggaccttctagactgatcttcactggtcaaaaaggaaggggcgggagaagattctggaaagatggagtaggaagcactgggaatcagtctccccaccgagacaacacttgcatcacaggatcaggcctgtgcaactactgaggtgctctggagtctactgaaggtttgcaacttcagggggaatcttggagagtaaactgtgattcattaatcaacgtcaccgcttcgcacattagtggctcccacctcactccccgctggcaggcagcagcctgcatgcagctcgccggacccaggtgggcagacggacacacacacccgaggtcagtgtgatgactgcgtgtcccaccccagaggcatgaagaggcagcagccacggccacccccaagctgaaggtacttccagggcatgagcaccacgtcccccgttgcccccttcatttctctctattccccctttaggaggcagacacttcaggacaagaacattaaaaacatctgtattgacgggaacgttaaaaagtggctgcacgtgaccaggaaaaggctcaggctcagaaaagacccgtgaagaccctgagtttccacaacaggccgaccccacagacacagcccagcacaaccaaaacaacaagtgcacacccttgagtggggaccaggaagaatcacatcatgagaatcaaatgtccatttttttgactaagaaaaacacaagagaaacaaagaaataggacagtatgtcccattcagaggggaaaaaaagaagccaacagacacggttcctgaaaatcacctgacggtagatgtcccaaagactttagggaactgtcttaaccttcagttcctcagagaacgaaaggaagatgtggagaaagtcaagaaaatgacgcgtgaacacgacggaaatatcaacagagacagaagatccaacaagaaaccagagagaaattccagagctaataagtacatgctcacaatagacactaaaaagtaaatattcacaacagaaactcacaggcagatgtgagcaggcagaagaaataatcggtgagcctgaagacaataaaatcacatcgtctgaggaaaagaaagcagaagagactgaagaaaagggagcagtgctgagcggcctcggggaccccaacagatctgtgggagcccaggagggaggagaggagcagagagggtatctgaagaattcctcaaaacccccacattggatgaaaaccgtaaatataaacattagagaggctcagtgaactccaggtagaatgaagtcaagaggcccacaggaaaacccattattaaacagttgaaagcctaaggcaaagagaatcttcaaagcatccaagggatcctcaatcaggtcatcagattaaagcatccaagggatcctctataagatcatcagatttctcatcagaaactttggaggccagaagacaatgggctgaaatagtccaagtgaaaaggaaaaactgtcagctaggcatgagggttccttgagcccaggaattcaagaccagcctgggcaatacagggacaccttgtttctactgaaaaatgagccaggtgtggtggcacacgctacgcctgtaggtcccagctacgcgggaggctgaggtgggaagatcacttgtgcccaggagttcgaggttgcagtgagctatgatcgctccactgcactccagcctgggcaacagaagaagactctgtctcaaaacaacaacaacaaaattgtcaaccaagaaccacgtatccagcaaactttccttcaaagatgagggagaaatgaggatattctcagataaacaaaagcagagggagttcattactactagacctagacctgccttgaagaataagctccagggagttgtgtggggtgtaaggaaaggacgcgagacagaaaccggaagctgggtgaagaaataaagatctccattaaggtgaggacgtgggtgactataaaagctcgtactggccggccgcggtggctcacgcctgtaatcgcagcactttgggaggccgaggtgggtggatcacgaggccaagagatcaagagactattctggctaacacggtgaaaccctgtctctactaaaaatataaaaaaatagctgaacatggtggcgggtgcctgtaatccctgctactccggaggctgaggcaggaggatcacttgaacccgggaggcagagggtgcagtgagccgagatcgcgccaccgcactccagcctgggggacaagagcaaaactctgcctccaaaaaaaaaaaaaaggcaggggcgaaaagcaagcaccggaaccaagcgcccgcctgtgacagcaagtgcccagcaccagggggcagcagacacgcgtcccgccgagcacagctgcccaccgcgccgcctaccttccctgcgggcctcccgctccttgcgccgctcctccgcccgccgctcgcgctccttctgctcccgctgctccttctgctgctcccgcatcttgcgctcccgctcccgcttcctttctaactgctccaagcggtccctgaagaggcacacgccatcattccccctaaacagaagcttgcttatcgcgtttttgtccacatttgtaaactggctttctacgtaattcaatccgtgaagtttttttttcatttttttattttattttctttgagacggagtcttcatctgtcccccaggctggagtgcggtggcgcgatctcggctcactgcaacctccgcctcccgggttcgagcgattctcctgcctcagcctcccgagtagctgggattacaggcgtgcgccctgtactcccagctaatttttgtatttttagtagagacgagggtttcaccatgttagccaggatggtctcaatctcctgacctcgtgatccgcctgcctccgcttttcaaagtgctgggtttacaggcccgagccaccgtgcccagctgccatttccaattctaattaataaatgatccatttctttccattcgatcggtgtttgcttcatggattttgggctctgtggttagatgcattcacacgtatcattgctgtatcttcctgctgtattggcctgtttctggctgtgaagtccttgctccttcttgtttctagcttttttttgagacagggtcttggtttgtcacccaggctggagtgcagtggcgcaatctcggctcactgcaacctccatctcacgagttcaagtgattctcatacctgagcctcccgagtagctgggattacaggtgtgcgccaccacacccaggtgatttttgtagagacagggtttcaccatgttggccaggctggtttctaatatttcttaacatctgttttgtctggtatgagtacagccattcaagctctcctatgacagctgatgtttgtacgctgcgtcttttcctgttctctagcagacagcatacagttagatcttgtttttctatctgataatctgccccgtctgtttggggcacagagacctttcatatgtcatataattacacgtacagttggatttactttccttgctttgttgtgtcttttttattcttccctttttgattttaaattacatatgtttagcataccattttaatttatttgtactttttaaaacactaagaaaacaactttcttagtggttgctctagggatcaccgtatgcctcatgatactagctcaagtccagtacaatataaaactgttgtaacacagctttattccctgtcttctttgtgcagtccatttatgccacataccatgacaacagtgtaattattttatacaatcgtagttccagtaaaacctaagatgtgaggagagatagttacaggatattgacgtcaacctacacttgctatctgcagtgcctgtccttccttcctgaggattcaagttaccgtctggtgtcatttctattcaacttgaaggtcttcctttagtatttcctttaaggcaggtttcgccaacaatgaatcccaccagtctctgcttctcagggaatgttgttcgttccctttcacttgtgtagaacggttttgattcctggctgatggttcttctctctgagcagcttgagtatgccactccactgccttctggcctccattgtttctaagaagtcagtggctggcggtattgaagctcccctttcatgggatgggtcattcttctctgaggcctttcaacattttctctttggcctttgccagtttgactatgatgtgactttgcatttattctagttcaaacttcctgtgctcttgaatgtgcatattttttaattaaaatttggaaagtttttaaccattattgtaacaaatatctttcctctctcctggaacccccattcgacgtgctttggtacagcagatgttgtaccacgggtttctgaggctctgtgcatttttcttgtttttttctctctgttcttcagaatggataatttctactgctccatccacaagttgtttccaagcctttactaaattcaacatctggacactcagacagtttttactgatgatgttcttcctcagtatgggtcacactgtcatacttctttgtattttagataatacatttgtagcaattctggattctaagttttccctttcgttgttaccaccgaggcctgtctggttgtccgtgaaatccatctccctcacagctcgtggccaccccgttccttcccccatgcctattttaattttcaaccttggcttcctaggggtcaccaccatggctgcacagcttagcaattagccagcactggaaaaaggctgggctcaaatacctcgagcacagtaaggcttccttggcccacggctgtgtgtggacagggagcacactgaacgttcaggcgtcattcgcatctgtggcggcttctattttctgccaggtcctttcacgcagctgcatcctcagggctggtcacaagtgggtggcggctcgagctctctccagtctctgctgcacgtctttggcgagatcacagctgctcccaaccacactgtacttcattctagcagacctcttggccttttcttcctccctccactgaggatgctggtgggcaaggccactgcccactgctctaaacggagtaaccccttccaaggcagcaaggaaactgcaggtcctgcagctgccctgtcccagtggaacctccgtgcttcccaagtgcagagtggaagcagtaaagggagcagctctcaggccagaaggtcagattcttactgctttcacccacagctcagcagttttccaagcatcagtgcttctcagattatccttatcagtttcctttttgtcagagacaaggtctccctacgttgcccaggctggcgtcatgcggtcctctggccttagcctcccacgtagcatatgctaccatacccagttctggattggctgatctgaatcggccctacccagaagtctgcccccaacaatttttgctcattcactctcctgtctttaccttctgggaaatcaatatgacagcccaaatttcatctaccaacctccacttctatcccaagctgtactctcgtgggacaagacacaccaatgtctggcacagggtgtggcatacatgaatgtttcacacactaacaggaactaggccaactgaaaccttgctcaccccgcagcggtctcggaccttgacccctgggcctcagtgtctcccacacccttcggcatcaacaagaaccagcgccctctcatcatctttacatgctgtgtacccagccctggctgctggcaaacatcgctgcacacgcccttccgcttcagactcctctcttcctggagcagcttgcaagctttctgtggactcactctgaaggcggagatgggcctgctcccacctggcctacagcctttttcctggttcacagaacagatctggggctacaccgatgttctttcttgggaatctggctcataaaggggaacgaatatataaactaatggccaggagtcctgggagtccagggtcccgaattccagagtgtttcaaggtttttaggatctcccttctcctttttttgagacagtctcactctgtcaaccaggctggagtgcagtagcatggtcatagcttactgcagctttgacgtccaggctcaagggatccaaccacctcagcctcctaaagtgctaggattacaggcatgagccaccgcgcccggccggacatgcagatttctgatcccttcattgtcttccctcaatcaaatcacacccgttcttacttccagatgcagtgaaaactcactccctcaggacagttctcttggtcagcctcgtccagcgttcactgtgctgtttccatgtctaccacttctgcaccaaatgtgacttcttcttttttttttgagacggagtctcgctctgtcgcccaggctggagtgcagtggcgggatctcagctcaatgcaacctccccttccagtcccaggttcaagcaattctcctgcctctgcctcaggagtagctgggattacaggcatgcgccaccacacccggctaatttttttatttttagtagagacggggtttcaccatattggtcaggctggtctcaaacttgtgacatcatgatccacccacctcggcctcccaaagtgctgggattacaggtgtgagccaccgcacccggctttatttttatttttttcagatagaatctcgctctttcccccagcctagagtgcagaggcacaatcttggctcactgcaacctttgcctcccaggttcaagcaattctcctgcctcagcctcctgagtagctgtgactacaggtgtacaccaccatgccaggctaatttttgtatttgtagtagagacgggctttcaccatgttggccaggctgatcttgaactcctgacctcaggtgatccacctgcctcagtctctcaaagtgttgggattacaggcgcgagctactgcacccagccattcacatcatatttaaacaagggcagctcattttatgttatttattccccaataaatctgttaaaagatcctacaattttggctgggtgcagtggctcacgccagtaatcccagcactttgggaggctgaggcaagtagatcacctgaggttaggagttcaagaccagtgtgaccacacagtgaaatccatctctactaaaaatacacacacacacacacacacacacacacacacacacacacacacaaccgagcgtggtggcgcatgcctgtaatcctagctactcaggagtctgaggcaggagactcacttgaacccaggagctggaggtggcagtgagccgagatcatgccagtgcactccagcctgggcgacagggtaagactctgtgtcaaagcaacaacaacaacaacaaaacaatcttcataatctcaaagcgtcatttaacagtatcttcagctgatttctgtatcaccaaaattctgggaaaattcacaccttaagcttctcaggaaaaccattataccataatttctggctgtgtttcctttaattactaatacctgatgacggatacgagctagatatgagaagaaaacaaacgagaaacagttcatggcacaggaagaaacgtcggaacacacaggtctcaacaagaacatttcctttttttccacacagggtcttgctctgttaccccagtctcatccatttccttgtctctattctaggctctgtcaggggtgcttagaagctaggccctgaaaaccctgatgatgaccatgaggggcacctgctatggcaggaaaactcatttagtttttctcatcttcttttttttattttgtgtagagacgaggtctccctgtgttgcccaggctggtcttgaactcctgggctgaagtgatctgcctgcctcggcctcccaaagtgctgggattacaggcgtgagctgccgcgtccggccaatatgaacatttctcatcagcggccctcctcaggtatctttcagcattctactttatttgtgcaaaatcttttttttcccttttttttttttagaggcggggtcttgctctgtcgcccaggctggggtgcagtgacatgatcttgtctcactgcaagctccacctcctgggttcacgccattctcttgcctcagcctcccgagtagctgggactaaaggcgcctgccaccacgcccggctaattttctgtatttttagtagagacggggtttcactgtgttagccaggatggtcttgatcttctgaccttgtgatccgcccacctcggcctcccaaagtgctgggattacaggcgtgagccaccgcgcccggcctttttttccttttaagacggggtttcaccatgttggctagactggtctcgaactcctgacctcagctgatcagcccgccttggcctccgaaagtgctgagattacaagtgtgagccaccacacctggcctgtgcaaaatcctatatagtatattttattaatcagtgtaacacatggcaaagttctttacagaaagaaggggcaagggtctggagggccacagacaacacttgagagtcagtcacaactgtgacataaaaacctcaatagttacgctatgtcacagtaactctaggaaagagtaaaccttaatagttacaacagcacacagttgtcacagtgaccctaggaaggaccggccaggccagggctgtgtacagctgggtcttgcacatctgtacatccgctcacctgtcttccatagagtcttctcttctatacggggagttccttattgtgatctccatgcggtgatctctcagctccccctcctcaagggaatcccgcttggaatcccggtcatcagactaagaagcaaagagaaagttaatcattttctttataagtttttttttcttcatagataaaagtatttttaatgataatcaaacctgggcaacatcccaaaacaaactttcatatatactctgaatgagccagtgttataaaatataaagaacttttggccgggtgtggtggctcacgcttgtaatcccagcactttgggaggcccaggcaggcggatcacgaggtcaggagctcgagaccaccctggacaacacagtgaaaccccatctctactaaaaatacaaaaattagctgggcgtagtgaccggaactgcttgaacccgggaggcggacattgcagtgacccgagatcacaccactgcactccagcctggcaacagagttagactccgtatcagggaaaacaaacaaacaaacaaactttaattcaaatcttatcacattaaaattacaactctctgtaatctgaaacctgagatgagaaatttaaaaatagcatatatgacaagggacattagactctatgccaagtatgttagttgcttatatgagccaaaaatgaatcttaaggcgtatcttgcaaaccaaatactttgtgatacctcatatggtacaggcatcccttggagatattttgggtttggctccaaaacaccacaataaagtgagtcacacagattttttggtttcccaacgcatataaaagtttggtttaggtcaggcatggtggctcacgcctgtaatcccagcactttgggaggctgggtgaggcaggtgaatcacctgaggtcaggagttccagaccagcctgaccaacaaggtgaaagctcgtctctactaaaaatataaaaattagccgagcgtgctggcaggtgcctgtagtcccaggtactcaggaggctgagacaggagaactgcttgaacacaggaggcagaggtggcagttagctgagatcatgccactgcactccagcctgggcaatggagcaagactgtctcaaaaacaaacaaaaaaggccgggcgcggaggctcatgcctgttgtaatcccagcactttgggaggccgaggtgggtggatcatgaggtcaggagattaagatcatcctggctgacaccgtgagaccccatctctactaaaaaatacaaaaaattagcttggcatgttggtgggcccctgtagtcccagctacttgggaggctgaggcaggagaatggcgtgaacccggccctgggcgacagtgcgagactccgtctcaaaaacaaaaaaaaagctaacaaagtgagcacatgctattggaaaaatgctcaatgcagagttgctacaaacctttaatttggaaaaatttcaatatctgtgaagcataataaagtgaagtgcaatacaacaaggtatgcctgtactcactaacatcccaaatgatgctgctaaagatcttagcaaaagaggtactttgccaatgcctcttaccaaattactaaaaaggtttcctgagtacattaccatgcaaaccaagaaagatgtaaaatatttatattaatttcaaggcaagttcccactatattaaaaatacttagagatagtattatgaacatactaatgaaccgagaaaaattagtccagttttgctaatgacttaacattcaacgtattttattctccatgtatgctcaatctagacacagctttagtgtgttaaatctgcctttaatgtcaactgaatatttgaatgtttttgttaatttttagaatagattttgggctcacctgcgacatttggaagtacaaaagaacttcaccgaagaagcgttgttctaatggaaaaatgagggcaaagaaattaaatctcctttaagaaaaccacttacttaaaaaatatggcttacattttttaagcgttttatctctgctttctcctcttgttccttccttcgtttcttttcctgaagaatttcatctaaagttttcactttccaagagtccttttcatcacccatttgagttaaaacactgcaaaaagaaaaataattcagcctacatcaggacacagcaagctatggtgctgaacacttgaacctagtcacttttgagggattcagaataaatcctcattaagaataagaagttgtgcccggcgcagtggctcaagacggtaaccctagcactttgggaggccgaggcgagcagatcgctggagttccggagttcaacaccagcccgggcaacatggcaaaacctcgtctctacaaaaaatacaaaagttagcccagtgtggtggcgcgtgcctgtattcctagctacaggaaggaggctgctagaggcaggaggatcacttgaatcagagaggtcaaggctgcaatgagccaagactgcgccactgcactccagcctacataacaaagtaagacttggttaaaaaaaaaaaaaaaaaaaaaaaggtaagctctaggctgaggcgggtggatcacaaggtcaggaggtcaagaccagcctggccaacacggcgaaaaccctgtctccactaaaaatacaaaacttagctgggcgtggtggcgggtgcctgtaatcccagctactcgggaggccgaggcagcagaatcgcttgaatccgaaaggcggaggttccagtgagccgaggtcgcgtcactgcactccagcaagaccccgtctcaaaaaaaaaaaaaaaaaaaaagaaaaaaaaacaagaatgataagttgtaagccaggcaaggtggcgagcgcctgtagtcccatatactctgcaagctgagatgggagaccgattgagcccaggagttccaggctgaagtgcgcttgtgaacagccactgcgctgcagcatgggcgacaaaaaagagtgatgggttctgaaaaatgaccgcttgaaatcaagtctcgtttctgtcattcttgtatggtcttgggtaacgtaattcacctcagtttagtcttccgtacaaccagaataacaacacctacgtgatagtatcgatcgcggattaaagatcatccgtttaaaggctcttaactcaggacctgccactcatcaaacactgcttttactgtcagaatctgctagaaagaccgcttggactacgtgaagccactagcacactggacagctgcaccttgagaccggggagatgctccgagatgtgctcgcgaacaaggccacctgacccgggcactgggctatttcctcgggttcagtcccacacacttgaggttcagcctggcagacgttggctccagacagcgtttggacccgccgcctccaccacccaaagttccgtgcgggatgagactgtccgcggaagcgagggtgtcgctcgcccccgggcccgggtccgccccgctccgaggcctgctcggaagaaagacctcggtgcacagttctcctcgcgctcccacacctggtccgcccagtcggaactcacccctacgccgccgccgctgccgccgccgccgccgccggtcccggagccagagaagaaacagcaaccggcgcgcgccaaaagtatcgtcacttcctgtattggcgcgtaatgatgatataatagccgacctccggcccagaactcgagacaaggacaggggctcgctctgtgcggcacttcctgtgtctgcgcgggatgatgacgcataaaacagcgcttgctcaggtccaggacgccagaagaaacagcccggtgagcgcacttccgacttcggcgcgggctgtgacgcaggaatcgggactccgggggagcgacgcccacttttggagcagtttgcgcctgcgcggaacgcgtggccggcttccggaatcctaccgggacttttccggtagcgaagcccgcgcctgtgccaaggcttgcgagcagaatgccttcgcgatggacgcccgcattccacccccttgaccgctgggacccctagtggcgggtgggtggagcgcgctccatttacctgctggttacctcgtgaggcgcctcaggtctgtgtgtcttgtaaaggccgatctcggaatttaactctgaaccttactcagaaacaaagcagggagagctcttacgatgtgattttattttatttattcatgtatttacttttgagtcggagccttgctctgccgcccaggttggagtgcagtggcgtggtcttggctcactgcagcctcctcccgggttcaaggaattttcctgcctcagcctcccgagtagctggaaccacaggcccgcgccaccacgcccggctaatttttatatttttggtagagacgaggtttcgccatattggccaggctggtctcgaactcctgacctcaagtgatccgcccgcttcgtcctcctaaagtgctgggattacaggcgtgagccaccgcgcccggccttttacaatgtgattttgaagctgacactggcagtgggtcctcaaagtgcagactcactgggtatggtgcttcccccaactcccagggccccactccaaacccatggattcagagcattgcaggagaagaggataaaacgagcaattaattccctttccatatgtcaggttttcctcttgacttgaaaagtcacagaaaaatgctttagacatctgaatctcaggaaacaaacaatggaagataaacatccgcatttactgggcctgaaatgggaaaatgaaagatgtggcaagaaactgacaagggcccaagaagggcgatgggtatcggaatttttttcatcccggaatgaaatgctgcttgctttgtgtacccaagctctttttttatttttatttttttgagacggagtctcgctctgttgcccaggctggagtgcagtggcgcgatctcgggtcactggaagctccgccacccggattcacgccattctcccgcctccactccattcgcccgcattaggctcctgagtacctgtgactacaggcgcctgccaccacgcccggctaattttttttttattttcggtagagacggggttttaccgtgttagccaggatggtctcaatctcctgacctcgtgatcagcctgcctctgcctcccaaagtgctgggattacaggcgtgagccaccgcgcctggcctcccccaagctcttaatgttgcttcctgagttcttggtaactggggaaatctccctatttttttatttttatttttttttgagacggagtcttgctctgtcgcccaggctggagtgcagtggcgcaatcttggctcactgcaagccccacctcccgggttcaacgccattatcctgcgagcctcagcctcccgagtagctgggactacaggcgtccaccactacgcccggctaatttttttgtgtttttagtttagatggggtttcactgtattagccaggatggtcttgatctcatgaccttgtgatctgcctgccttggcctcccaaagggttgggattacaggcgtgagccacagcacgtttttttctgttttgagaaaaagtctcgctgtgtcacccaggctggagtgcagtggcacaattttgggtaactgcagcctccgcctcctgggtacaagtgattctcctgcctcagcctcccgagtagctgggattataggcgtgcgccaccacacctggctaacttttgtatttttagtagcgacaggattttgccatgttggccaggctggtcttgaactcctgacctaaagtatctgcccaccagcctcccaaagtgctgaaattatagtcatgagccaccgtgcccggccaaaaatctccagtttacccttcctttgtgaaatctgtgagtacccaaatgcagccactcatgtcaaaccctaacaaaatcgaccccagagcccacgaggagggggtggcctcgcacttgcgcttgataggagctgccacaaaggcctttcccaaccagaactttgggttcagccacttctgtgaagagcctctttgctagcaacagccagccacaccggtgaacaaagtagcatgaacaccagagttccacaaggaagaaaacaaagcagtccatatttaacatttattttactttgctgagcaagaatcatagacagctactaccacggctgcttcgtttggacaaaaataacgaggaggcatccacgggattagttacacggtatcaacttaccaccacagcagaatcaacagtgactcgctaattaacagaaccgtttgctagaaagcactaatctagttatataaatactgaaataggtcacatgcaaaacactataaacgttttgtgtgatgtacttttagttctccatagttttgtttggtataaaggaaatataatttggctgtgacgtagactgttgatgtaattttcaagttttcctgtatggggaaagttgccctgactgtggcccttttcaaggtggagcctccaacaccacgttggcagattcagactccgtgaacagtctaaatgagcaagtcagctgaatgccactttcagatggaagggaaatgagatggaaaacaacaaaaaaggactgccaggcggaacagtttccaaccgagttttcgttgagtgaggatccagcagccatcaaactcaaacataggggcccgcagggaaactggaggaaatacttcagagacagcaaagctgaaggtttctgtgctctgagggatccgagagtggatgtcccactcctgtatcctcagccagacacagaactagccagattcattagggaagctcggatgctctcattctataaagtaaggcccccagcagggcacgtacatacattgggaaagaagaaaccccttagtaccatgttggtcaaaggcaagagagagaattctatttccatctggaatgtcattcttgtttacttcttccaacagtgaaatacttccaggccttcgaaaggccatcctttggacacatgtaaaaagctgtcttgttggcctgttattcccactgacccgtctgagtgatcacccaggagcgcggcggcagcaagcagagctcaccggatttgggacaaggattttaaaggcagctacaaagctgagctctatttgctgatgatagtctctgttcagctgtttaaaatgactgtctgactcaccatggtaatttttcacaaattaaagacacattttgggttgtgcaacagtgttctcatctttccaggcaggcagattattttaatgctgttatacagggaattgggactctcggattttcttttttaacctttttatgcctttcagtaggggaagtttccttgaaagagagctgcaaatctctaagtatcaacgtaaagaagccgatgacccaattcgggaggtggttcaagtgttctgttcgtttacaaaagcacagaccacgaccatggacacacccagtggaagtaaccacacccggtgtgttcctagaagctcacctgtgacagttcaacaagaacttactattccagaaaagtattacacaaagttattttaaaaaatgtctgtacaatcgttaacacggccaagccaggccttgggttttgcctcttggtgcccggctgtgctgggaatgccatgaagaccagcggctggaaaccgacttgggcatggagaggagactgagggagagggaggggacagcacgactgagcaagggcacagtgctggctgcctcatgggctccaggctccttctgccaggatgaggaagaggccccagagcagcgttacacaggaaattaccctatttgctaatcctttggaaaaacgtttgtttctggtccacaaacagaaaatccaaacaggatggcagctccttgtgagggtggaggggagggcaccagatgctgtgcggctggaaattccaaggtgctcagaaccaggcgcctgcacctctccttatgccagaccacaatcttcaaagaggccggcagccacattaccaccctgggagttgctttcaatctgtcctcacaaatcaacaactccccgccacctccagggcattttctaatagtgtttgtttttgagacggaatcttgccctgttgcccaggctggagtgcaatggcacgatcttggctcactgcaacctccatctccggggttcaaacaattctcctgcctcagcctcctgagtatctgggattacaggcacccaccatcgcacccagctaatttttgtatttttggtagagacagggtttcatcatgttggccaggctggtctcgaactcctggccttgtgatccgccagctgctgcctcccaaagtgctgcgattagaggcgtgagccaccacacccagtcttctattagtttttgaggaaagcagaaaaaaagaaatggaaatccggggaaagtcacgtgacaaaacatcttcgcagcgcagtgagcacacacctggcctgtcctccacacacaggtcagcggttttatagaagcggctgaagcaggtgtagtagcccacgcctatattctcgacactacaggaggctgagtaggaaggattgcttgagccgaggagttcaagaccagcctgggcaacaaagcgagagcccagctcaacaaaaaaatagccaggcatggtggcacgtgcctgtggttccagccacatgggaggctgaggtgggaggatcatttgagcccaggaagtcgaggctgcagtgagccaagatcatgccactgtactccagcctgggtgacagacagagcaagactgtctcaaaaaaataaaaaggttacttgtgggttaaaaagcctcacttcggtccatcatcatggcagacttttttgagtaggtagaagttaatgagtcagaattattgctctgtttctgaatgattttatcttcaggaggggctatttttgtatttcccaggtgagaagccaaatggaaagccagtgaagtgaccatgggtgccaaaggcctaaagagcaggcagggaaatgagactcaggaccactggcgccccatgctgcctctgacaagccctggagctctgggtctcaaaggctggctggcaacaggctgcaccgggcatgggaatccgccagctgcgagattgggggtaaagagctcagacatggtcagaagcctctgcctaacacacggctccagtagccactcctcaggcctcctgcgccctcgggggtgcgtgacacaggaggatgagttgagctggctggtggccccagtgtgccgtactactgtcccttggggagagtgggacagggtgggcgcctgacacacaccacgcgccccagaaacattcagtgtggacgtttcctttttcagcaaggacggcgcccaggtaaacgccacgtaacccaaaccatcaacactgcagcgtcctgcccaaggctcacgtggggaaccggacaggtgctagatgatgataggaacggtgggctctgagggaggacagacaggctcaccccacggggacctcagaacagcctgcctcatactcagagtccaaaaaagaaaaggaacgtacacatctcctcccaagttaaacacgagaggtttgtcctcaacctcagggctggaaacccccacaggtaggagggcagggtgccctggggttgcggggagctcacgcagcccagggtgtggaagggataggagggcagggtgtggaagaggtagggggccttcctctaaacagaagcgactgaacggcctccgtggtcatagcccttgagtgccgtgcaatgctgcagcttgaggcttgcgatgcctctgggatagtctgaggatgcccacagccctgggtcaggtggggagaagttctgagtgcccaccgtggcagcaggagacccttccttccagggccctctgtcccctcccttcggccctgctctgtggcctcatgcccagggccagtctgccgccggtccagggcctcagggccttcgatggctggtgtgggaagccgagggctctcttggctgtggcagggagcggctctcgttggcactggacccacctctggctcccggtggaccctggggtgtcgcccagagaggaagtgggcacccccagcatgggagcctcagaggctgttttcacactacacggggatgggctcggcggacacagtcagctactggtctggtctctactccaggaagctgatacctggaatccccagtttgagtttctgctggtcttcaccgacaaaccgagaaagccgcaggcaatggccaacttagctccccatgtcctgcaccccagcagggccatggaggagggcgtccctgcccatttctgggggatgcagtgtcacgaggacagcagcagctggcagcttcctgctctcagggatgctgcctggggtcctgtggaagcagcggctccactgtgtcgtctggggcccggccagtggctgcagccaggctctgcagcgcctcctgctggtgttgcctggctttgttgtagagcaggaccccaacggtcaccagggctgtgccaacggccgacaagctggtgatcttgttgccgaaaacgattacgctgagccagatggacaaggcatgtttcacggtgctggcgacgctgcggaggcaaggggaggcagcaggggcgctcagggctatggtctcctcagcccgtggccagcagctcggctgagcctgggtctggaggctgggtggggttgggggactcagcgtcacggtgacatcagccctgcggccagcagctcggctgaccccgggtctggaggccaggatggggcgggggtgctcaacgggacctcggtggtggtgagatcagcccaggggtttgggagctttcagcggggcttgcctgctccctcgtcccttcttttttgaggggtacttttcattattaaaaaaggcagaggaggagaaacctaagtaacggccacgtcctgtgatctagacgcaggaattcatgacatccgcctcatcagcttcatccaatcgaggtgggtctcactatgtagcccaggctggtcttcaaatcctgggctcaagtgatcttcccacctgggcctcccacagagctgggatcataggcgtgagccaccacacccagatgaaatatttttaagtaaattacaggtatcatgacatctcacccctgagtacttcagcctgctctctaaagaacaagaacatcaccgggcgcagcggcttagcctggaatcccagcactgtgggaggctaggcgtgggggctcatgtctgtaaccccagcactgtgggaggctgggtgtgggggctcatgcttgtaaccccagcactgtgggaggctgggcgtgggggctcatgtgtgtaaccccagcactgtgggaggccgggcacgggggctcagcctgtcatcccagcactgtggaggccgggcgccgtggctcacgcctgtaatcccagcactgtgggaggccgaggcgggcggatcgcctgaggtcaggagtttgagaccagcctggccaatatggtgaaccccgtctccactaaaaatacaaaaattagccgggcatggtggcacacgcctgtaatcccagctacttgggaggctgaggcaggagaatcacttcaacccgggaggcggaggttgcagtgagccgagatcaaaccagagaaatccagctctgggtgacagagcaagactctgtttcgggaaaaataaaatacataggcagggcgcggtggctcacgcctgtaatcccagcactttgggaggctgaggcgggcagatcacaaggtcaggagatcgagaccatcctggctaacacggtgaaaccctgtctctactaaaaaatacaaaaaaaaaaaattagccgggcgtggtggcagtcgcctgtagtcccagctactcgggaggcggaggcaggagaatggcgtgaacccgggaggcggagcttgcagtgagccgagactgcgatactgaactccagcctgggtgaaagagtgagactctgtctcaaaaaaataaataaataaaataaaatacataaacaaataaattgcagcttcattcaatctgcccagttacagaagtggaaagaagctgaaggatcctccccgtttctagagctgcaccgcacggcacaggaagcagtggccacaggtgtctgttcaagttcaaactgacagcaatcagcttgaattcctaatctggttcttgttatattctccacatttcaagtgctcagaagctgtatgtggccagtggctcctgcactggacagcccagaagagaccattccattcctgcagacaagactagtcgcaacgcccgactattctagacagaaaagcactcaatttcaaaaaccttcaaacgcagagacttctagtggagatttccctaaatacctatttcacacagtttacggtttattttacagtttctcatttgtttttctgtttttttttttttgagaaggactctcgctcccatcccccaggctggagtgcagtggtgagatctcaactcactgtaacctccggctcctggattcaagtgattctcctgcctcagcctcccgagtagctgggattacaggtgcccagcatcacacccggctaatttttgtatttttagtagagatggggtttcaccatgttagccaggctggtcttgaactactgacctcaagtgatccacttgccttgtcctctcaagtgctgggattacaggcatgagccactgggcccggcctatcgtttgcatttcaaacagcatgggtataaaatagcctagtaattacactgcatagccacactcatccccgtggaagagaatcacatgtgtcccttataaaaatacctagatttctggtctcctttgtaaacaacctggacacactcaactcttgggaagttcctctgctcacctgaaagtcaccggggagattttccccatgagggcgtacgccgtgacgctctgaaggtggaacaggactccgtctgtcagaagcagcagcaccacgtcctggttgtagctgaagctcttcccactcctcccgatcactgggacgtcctatgtggcaaacaaaagggtactctatcggtttccattttccatttactaatcatccaccaaaaacgcccagcgccactcctgcccagaaactgggtaaagctgctgccactgaggacagccctgaaaatgcctcgagcggacagctggactgtgcactcatccattttctgttttttttgtttgtttgtttttattattttttgcactaattaattttcaccatgcagatgcaaatggacaacaagcacatgaaagaggctgaacgtcaccatcatcaggaaaatgcaacagaaaccccaatgcggggccgggcatggccagtctggccaacacggtgaaacctcgtctctgctaaaaacataaaaactagccaggcgtggtggtgggcgcctgtaatcccagctactcgggaggctgaggcaggacaatcacttaaacccgggaggcagaggttgcagtgagctgagatcgcaccactgtaccccagcctgggcaacagagtgagatatcatctccaaaaaaaaaaaaaaaaattaaatatagaattattatataatccagcacttccactgctgggtatacacgcacaagaactgatggccctggccggcaaccacaacttccctgcagggagaatggccaagtcagtcagccttgacagctaatggattaaaatccagaaaaccgcaataagaacttgaaactgcatctcacacagagaaccctctgtgtgggggactctagggaagtctacaaattgcaggtcccagctacttgggaagctgaggcaggagaataacttgagcctggtaggcagactttgcagtgagcagagatcacaccattgcactccagcctgggatacagagcgagactctttataaaaataaaaaaaaaaagtttttctaataaaaaaaagaaattaagctaacctaaaagtcatctcaagttgaatgatgaagaatcaaaacaaaacaaacaaacaataaacaaaataaaagtcttcacacagaaatctgagctgcaaaccccgagtggctcccagggcaactcagctaagcaggacccgcagcggagctgggcccaaccagccagcacacggcctggaaacggaagtcattctgctcctgaatcaccggagaaggcagcccggcaagtaaggacgggacgcctgtgtctgaaacccaccgtaaagaaaacccgggccgggacgagcatggccaccgcagcggcgctggtgtagaactgcagctccggggccctgtgggtgacagaacacgctgggccccccgtgtcgggacaggccgagttcacacgcagctccctcacagcaagaacacccaggcaccccagcccagaagacgttcattctctctagacaggactagggtgctgcagcttcccagaaatgaaaacgcaaacgcacaccaggctggctgaggggctcaagggagtagctgagaaacgggcgggtccctcccgagcttagacagggtacttgtaaaggccacccaagccagacaggaagggagtcaggcctgtggggtgttctgactcttacagtgagcaggaagtcctcttcgtcttatgacttggagatttcactgacgaataatacttacgagaacctgtatttgtccccgctgagcagcttttttgaaaaaacattttgcaaactagaataaagaaaagaggttatgcatcaatactagtcctcggcacggaacatcagggggagaaggtgtctgcgctcacacggagcgatggcgacaatgaccagacctcagtggtgcccgccaccacgcctggttactttttttatttttagtagagatagggtttcaccgtgttggccaggctggtctccaactcctgacctcaagtgatccacccgcctcagcctcccaaagtgctgggattacaagtgtgagccaccacgcccaacagattttttttttttttttgagacagagtctggctctgtcgcccaggctggagtgcagtggcgcaatctcggctcactgcaagctccgcctcccaggttcacgccactctctttcctcggcctccccagtagctgggactacaggcgtccgccactatgcccgactaatcttttgtatttttagtagagacggggtttcaccatgttagccaggatggtctcgatctcctgacctcgtgatccacccgccttggcctcccaaagtgctgggattacaggcgtgagccactgtgcccaacatatttttatttttacttctgtattattcaaaatctcaccacaaacctgttttgattatcagtaataatgataaactctcagacaccagtggtggtgtcttttcctttctttcctcaaaagcaggaaaagcctagaagccggtcattctcaaagggcaggttttgccggggctggagtgtggccattaacagcacggcagggaggtggacgcccaattctgggtgaatctgaacggcccccgaagtgcagcgtccaccgctcttctctaccgagtgacaaagacgtaaataacagggccctctcctctgggagcctgccacgcgctgtcctcgctgtgggagtcggcctctcatccttcctgccatcgtgacaccaggacacagatggccacaaggaagcagaggatccgcccgacctggaggccgcgcagctcccaaacaggcagaacctgccgctgggggactgtccctgctctggcagccgcatgaagacacaccgagcgagacacactgctgagcgtatctgcgtatttcagcatttgtcagctaaccgtgtctccatggttagcattttaagtaccaagaccgtccatcctgaaatttcggcttatttttgagaaacttacctgccggggatacctgttgttttgctctttaggaaagggcagcattggacgcacctgctttggctcacgggaggaattctcagctcacctgagaatctgcacacccagatgcaggtgagcaccgggtctcgtccccctcacgcccaccttctctgtgactcaccagtccatgatgttggtggacagtgcggccgagaaccccaggacattgaagctgatctcagtggccgtgcacagcgccagcccgcccatgactgggatgagggagaggttgaccagcagccctggcgagaggacagcccctgtgagtggctgacccgccgggcggacgctccctcccgagggccaggctgtttccatcccctcttatgaaaggaacggatgcttccttcaattcaaaaacaatacttgtcagtttcttcacattgtgagataaagcaaatcaaagtccgtgtctgcaaataagtcccgtccccacggcaaaggtggcgcctttcactctacatgagatgcgtcccccagagactgagccccagccatgggcaggtgagccacagaaaccttcctgattctgtgaacgctcctgtgaaacggtgagtgtgaaggagatggtccccagggaactgcagagaaagaggccctgtgggccgggagggggatgcccacattgaatttatgcttttctgtttccttctgaaatgtaacaaaaaacttttacgtgaaggatttttaaaaaatctatggaacaccgctcacacctgtaatcccagcactttgggaggctgaggcaggaggatcacttgagcccaggggttcaagaacagggctgagcaaaggtgagaccccgcctctacaaacaatacaaaaattagctgggtgtgtgtcccggctactggggaggctgaggtgggaagatcacctgcacgggggaggccgaggctgcagtgggctgtgaccatgccactgcgctccagcctggacgatagagtgagaccttgtctcaaaagaagaaagagaaacctgagacaagttaacgtgggaaacccacagatactgcccagtcgagaccctggcgtagcagagggacccgagtctgtgcggggaggctccagccagaggggcgtcctctcgtctgccgtcacctggtctcggcctctgctggaaactctggttgaatcacggacaacatttatgaaaattgtagagaaaactggagactgtgaatgccgtttcacccttcaaggagggcttgctgctgctgttgacatgcagctggggtgccatagacgcctatatccagcaccagattcctatctcagttgaaggtctggcatctgggggtccccatggtggggcgcccattccagcttgtgcccctccagccccaggagactgctctgctcagaaaccatcagcaaatgcaccggggagggtggtgccttaagacagacagagtcacttctctgggctgccagaggcaccggaagccgggtgcctcaggccctggcagttccgtcactctccaacgcctcccccacagacttctttttgctaaatggtatcaagattttctcattgttgtcagcaagagagttggttttctaacatctcatcgaccatggctggaggtcaaatcgatgtttaaacttgctggaaataaacggctcctttcttgcatggctcgatgcgcaataaggttcctctgtgtcattttgtttacgatttttaggattgctttttaaagccggacacggcggctgatggctgtaatcccagcactttaggaggccgaggcaggaggatcacttgagataaggagttcaggaccagcatgggcaacacagcgagaccccatctctatagaaaacacaaaaatgaggctgggggtgctcatacacgcactgagggttgaccctggtgttcttgccttcttagattcttctggagctggagatgaactcggacctcaaggcccagctcagggagctgaatattacagcagtgagggaaactgaagttggtggtggtgagaaagttattatgggcaggtgcagcagctcacgcctggaatcccagcactgtgggaggctgaggcgggcagatcacgaggtcaggagctcaagaccagcatggccaacatggtgaaaccccatctctactaaaaatacaaaaattagctgggtgtggggccacatgcctgtaatcccagctactcagaggaggccgaagcaggagaatcacttgaacccgggaggcagaggctgcagtgagccaagattgcgccactgcactccagcctgggcaacaaagcgagactccatctcaaaaaaaagagggccggctgtggtggctaacacctgtaatcccagcactttgggaggctgaggcgtgcggatcaacgaggtcaggagatcgagaccatcctggctaacacggtgaaacccagtctctactaaaaatacaaaaaattagacggacgcagtggtgggcgcctgtagtcccagctactcaggaggctgaagcaggagaatggcgagaacccgggagatggagcttgcagtgagccaagatcgtgccactgcactccagcctgggcgagagagcaagactcctctcaaaaaagaaaaaaaaaaaaaagaaaaaaaaaaggaagttatcataatctttgttcctgttctgccactgaaataattccagaacatccaagtctggctagtacgtgaattggagaaaaagttcactggtaagtatgtcgtctattgcttagaggaaaattctgcctaaaccaactcaaaaaaggtgtacaaaaaataagcaaaagcgtcccaggatccacgctccgacagctgcgcacgtcgcaatcctcgaggactcggtcttcccaggtgaaattgtgggcaggagaatcggcgtgaaatggacacagcagctcacaagggttcattcggacaaagcccagcagaataacgtggaacgcaaggtccaaactttttctggtatcgataagctcacagccaaggctgttaattctgaatccccagagttccaagtttcaattgttaagaaaaatgactaacgtatattcacagtgaaaaaacaaaaagacacacaaaatacaaaaattagctgggcatggtggcacatgcctgaggtcccagctacccaacaggctgaggtgggaggattgcctaagcctgggaggccgaggttgcagtgagtcgtgacctcgccactgcactgcagcctgggcgacagagcaagaccctgtctcaaaaacataaaaaaaacaaaaaaaaaaaaacaaaaaaaaaccagagttgacttttaggctttgattttgttataatcacctaaacgtgtgtgcgggtctcaagtgcatgtggggcaagcccaaccccatcctggaccctcggcctcctcccgtccccaaaggcagacagacacttccctcggccttaagatcttgtagtttcttaaataagcgaacacgtgtgcaccccccgactccgttcaagacgccgcgctctgtgggcgcctctgctcctcgctggttttcatgcagccacactgggtacgcgacatggggctgacatgtcgctggaaatcgcctgtgagtcattaagaggtgggagaggcaggagcctgggttgcagctgaggtcaggggctggggcccaggacaggcctgtggtggcgggtgctggagaggctgtggggtgctggcacaggagggcccacggaccaggagccacggccgcctgtgtggtgctggccgaaggcggcccccacccgtcctcttcggatcagtgattggcacctgcagtaatcttgcttgccaggaatctgcccagcccccacctgtctccccacccagttagggccacagacacaaccctgccctgacctccgcatgccagtgtgagaatacctggcagacgccaggctccaagacacccccgcacatgtgaccgtgagagaagtgaaggcactgccagtgtgggcaccactctgagtggtcctcgcggcagagccccatggcaggcagcagagacgggcaccacggatggaggcctgggatggtggggcgcaggcggaggggcggggcccgggggcctcacctgtgtactcccccagaatcatccgagacatgatcaccgtgaagatgggggcggagctcttcaccgtctcagcaaacgaaaccgccacatttttcaggctgaccaaacccaaaaccacagttgcaaacctaaaaatgagccaaaagcaccatcaccttagaacgagtctgtctgcctgcacccaccgggcaggctctccaaggggctcgctcgctcggttggcacgtcggcccctctccgcccacctcctcatcaccaacatggtgcctggacccgcttctgtgacgctttaggtcgagcccccaggaaacggcactgcgtccaatgggaagtgacttctgccaccccttgaaaacgtcccagagacaaggaggcaccctgtcctgagaccaccagcccggaaagaagctgactgaacacacgtggcagtgagagccacgaagccacattcatttggtgtcctgaaatctggacagccctggtgcttttataaagtctgcactgaaaactcaccagccagcagagtccccgctctagtaacgagagggactttacatttaaagaaaaagagacactcaaccaaaaccaggagattctttacctcatcagacccacaaacagcatcgtcataaggaagttgggtgggtaggaaagccgggccttgtgctgatacaaacagcaaggaacgagggttttcacacacccgataaccgtggtggacagcatctgcaccgcacctgcgggagggagggggccgaagacaagagggagaatcacccctcccatgcctgcagtgggctccacccccggcctcccatcctgacctgggctcccccggccctcccgggtggttgctggctgctccctgtggggtggcaggtggccggcttccaccctgcccgagccgccgcctacctagcatgctgggctcgcctcccagcagggacaggatgtacttgttgaggaagagcgtgcagaagctgaagaagaaccacagcgtgaggtagagcagcgcccgcgagctccacacacccaagtctgactcgatgaccgtggtctccgtgatggtgacggtcagtacgttctcatctgtgccgccgtcgctcttggcaaaaacaatcttctcacttcggtgaccaaacagagagccccagctgagaggcgacctgcctttcggcttctcttcggagccaggaaccagctcttccagtgctggggttttcaccgaggacgacatgctgaagccacagccacgaacgattttacctccaggctgggcagcatgggtcaccgtgaccgcccgggggtggggccgcagcagggactccgggcgccaggaacgaggccaccagggcctctcccaggcaaagcgcagaagcagacgctaaaatattaagaaaaggaaacacatcacccgttttgaacatttaatgtcctcaaaggtttcaaccaccaatttaaaatcactttgaaaatgcaattgggccgggcacggtggctcacacctgtaatcccagcactttgggaggccgaggcaggtggatcaccttaggtcaggagttcgagaccaccctggccaacatgacgaaaccccgtctctactaaaaatataaaaactagcagggcatggtggccggcgcctgtaatcccagctactcgggaggctgaggcagaagaattgcttgaacccaggagacggaggttgcagtgagccgacatgataccactgcactccagcctcagtgacagagtgagactctgtctcaagaaaagaaaaaaagaaaatgcaatcgttcactgtccaaagatttttagcaattgaatcccgtttttctctgcgcgtgttggcggatccttgctcttgagagacggtctcctggcacacttgactgtcgtcctggcagacctggggctgtgggtccttcacgccctgcctggcagctgcaccttctcgatgggctttgtggctgccgctgtcgggtgcccaggactaattccatgctactttctttttcctttttttttttttttttgagacggagtattgctctgtcgcccaggctgaagtgcagaggcgtgatctgggctcactgcaagctccgcctcccgggttctcgccattctcctgcctcaggctcccgagtagctgggacgacaggcgtccgccaccacgtccggctaattttttgtaatttttttttttttagtagagacgggttttcaccgtgttagccaggatggtctcgatctcctgacctcgtgaaccgcccacctcggcctcctaaagttccatgctactttctagacagactccgtggtataaaaccacacttacacccgcttcacgctcaggcgactgtggcttcggggcgagacaccccctcccttcccacgagctccaggaaggtcagaacagccgtttcctcctgaggtccagtgggaatcatccccccagctggggctttgcacagacgccactgtgactccgcagcaccgagaccccacctcccccaggtctcaatcccagcgctcaggcagcccgatttcctgtttctcacacctgggtttctcttcctgcttcgggggaggctgtgcatctgaaggggcgcccatcctgtctcaccaaggcgctctgggagcgtgtggtgccggccgtgctgcccgacccagtacccctcctcgtctcacttctcccccgggaaactggggttcccacctcattcgtgacctccttctgtgtttatgtttatgcacttgcgtgcgtgccatatgtatacataaatattctgtgttcacactgagggacgcacgccaccccctcccccatgaagacctcgcctgggtgctcaggccggcctctcccccagctcacctgcccagcagtgctcagaggtgcctgaaacttggcctccccatacccgggaacaggcgcttctgccctctccccagtggcggcaatgccagggcctctgcagccttcctctctctcctcccctccccctgctgtgtgtgtctgtgcacccaggtctccccgtctgcccatcacaccgccagctcagtgccacccagacgctcccaggccacccatgtgtgccctgacccctcggtgcaccaggacagctgcctccaagggcaccccaggcctcagtgaggagaaggccgacccctccaccagttcccacagcctcggaataacaaaggactcatccactcctcgggccactgacagtgccagatctccacaaagacaccattcccttcttcctgttcagcagcacagtcccactgcttagcctggggtgacaacaagctgggagctaaacctccatgggctgcagcctccctggagctaggactggctgggccctgagccagggagctaggagactttgtgccagtttcccggactgatgggccctggctgggggtggagcagctacctggctttcctgaggtgaaaatccaacaacaaagggtgcggcagagcaaaaggacagagcactcgcgacagggctccgcaaggcaggggtggagctcatggcaggcgtggatctcactccccacctcactaggcctcacggcccttgacctctccctcccacctcgaaggctgccccctggctggggacgctgtcacagcacccgctacacaggctctgccaccaccagcgagtttctaaaaccaaattcatttacatggcaaggaggccacgctcaagaaacccctccaggagcaaggaacagcacgtgggctcgggcgtgtgcagacgacgccagtcacgtcccacctgacgtcgaggcaaacctggaattcaaaaggcaagcatctccctcttgccagaacagtctgtccacttagcttccctctgagaaactcacagcatcccaggcaaaactgctccccgcaatgaggacccccattccccttctctgctgacactgtgctccaagaagcctgtgggacccacacaagcagcccagtccccaccctaatgtttgctcacaattagtggaaacaaaaaaacagaaatcacacttcactgacgctgccgttctctgtacatcaagaacttaaggttctgggccaggcgccgtggctcacacctggaatcccagcactttgggaggccaaggtgggcggatcacctgagctcaggagttcatgaccagcctggcaaacacagcaaaaccccgtctctactaaaagtacaaaaaaaaaatcagccgggtgtggtggctggcacctgtaatcccagctactcgggaggctgaggcaggagaatcacttgaacctggaaggcagagcttgcagtgagctgagatcgcgccattgcaccccagcctgagcaacagagcgagactcccgtcaaaaaaaaaaaaaaaaaaaatgctgggcgcgatggctcacacctgtaatcccagcactttgggaggccgaggagggtggatcatgaggtcaggagttcaagaccagcctgaccaacgtggagaaaccccgtctctactaaaaatacaaaattagccgggcgtagtggatgcctgtaatcccagctactcaggaggctgaggcaggagaatcgcttgaacccgggaggcggaggttgcggtgagccgagatcacaccgttgtactccagcctgggcaacaagagtgaaactccgtctcaaaaaaaaaaaatttttttttaatgtagccgggcatggtggtgcatgtctgtagtcctaactacttaggaggctggggtgggaggattgcttgaacaagagaggtcaaggctgcagtgagccgtgattgtgccactgaactccagcctgggcaacagagcaagaccctgactctaaaaattaaaaaaaagttaaaaaaaattaaaagagcttaaacaagaagccgactgcaaacaaaggcctctccatgcagctgcgctgggacgcgggttctctgtccgatcactgcacagcagcccactggacaaatggacccattctggcaagaagcacttgggacgggctactaggagcatcctcgtctgtgtctacgtgcaggagtggaactgcccagccctgggacacgcatgctgagccccagccaacgtcacaccgacctgtgctcccacagccctgccccggctctgtgtgggtgactgtcccgtccctgcagttgagcccacgtggtcccggggtctccattcccctcccaatctgcaggacttcactaccatgaaccgtcctcacccccagcatccctgtccccacagctccaaggccgcaggaggaggcgatatctaatcttccccccacgtaaacacctgtccctgcgtaaatgcctgaggctggctgcttattcttttttttttttttttagatggaatctcgatctgtcgcccaggctggagtttagtggcataatctcggctcactgcaacctccacctcccaggttcaagggattctcctgcctcagcctcccgagtaactgggattacaggcgcctgccaccacgcccagccgcttcttattcaaacactgggagctccacgtcagaccagtgaagtcagagaatcctgaagtccaagttctcagctcctcagccaactcaagggcagccaggcaggagccacccctgcagaggcacccacggttcgttcctgtcactgactgttcccaggctggaaattcctgacggtacaaatgcaaacagattccggcctgaaactgtctagtgagacctttctttccttttccttttctttttttcgagatagagtctcgctctgtcagccagactggagtgcaatggcatgatcttggctcactgcaagctctgcctcctgggttcacaccattctcctgcctcagcctctgaagtagctgggactacaggcgcccgccaccacgcctggctaattttgtttttttttgtatttttttagtagagacagggtttcaccatgttacccaggatggtctcgatctcctgacctcgtgatccacccacctaggcctcccaaagtgctgggactacaggcgtgagccaccgcgcccggcctcttttcttttcttttttgagagggactcttactctgtcgcccaggctagagtgcagtggcacaatctcagctcaccgtagcccccacttcttggattcaagggattcgcatgcctcagcctctcgggcagctggaattataggcatgcgccaccaagcctggctaatttttgtacttttagaagagataggatttaggccgggcgtggtggctcacgcctgtaatcccagcactttgggaggctgaggcagagggatcccgaggtcaggagatggagactatcctgactaacactgtgaaattctgtctctactaaaaatacaaaaaattagccaggcgtggtggcgggcgcctgtagtcccagctactcaggaggctgaggcaggagaacggtgtgaacccgggaggtggagcttgcagcgagccgagatcgcgccactgcactcactccagcctgggcgacagagcaacactctgtctcaaaaaaaaaaaaaaaaaaaaaaaaaaaaaaaaaaaaaaaaaaaaaaaaaaaagaagagacagggtttcaccatgttgcccaggttggtctcaatctcctgacctcatgtgattcgcccgccttggcctcccatagaactgggattacaggcatgagtgaccgtgcccggctgggtgcaacctttcagaggtcatgcgggtgacagggagcgacaaaaaacaagaaaataaagcacttcgccgaggctgacttgggtcacagagggccaaacggtcccgggaaaatgggtgggctcttcacaccttctcatagaagtcttggaggtgggtgtttaatgagcattttttgttagtagcaaaacaagacaaagcaaacaccaaaagaatgccaacctacgtgcctgtcaacagtagaaacaaacaccttattgatggagctgaagctacgatggaaatgaggggctcagtcccagtgtcaaagggacggaccccaagcccaaacccaccggagcgggggaagactgagggacgaatcacagacagaaacgcacgactcggctccaccatgcgctgtcagctgtgcgggaagcaccacgtgtagaaataaaagcatgaaagtgcctgaaagagggaattccagcacgtgctcctctcatctcggggacgggccccaggggaaagcaacagcaccttcaggtgctggaacccagctgagcagccagggggttccggggtcctccctaagtagttgtgagagatcacagcccggggtccttcctaagtagttccgagagttcaaggtttacatgggggaggccgggcttggtggctcacgcctgtaatcccagcactttggaggcaggtggatcacttgaggtcaggagttcgagaccaatctggccaacaaggtgaaaccccgtctctactaaaaatataaaaattagccaggtgtggttgtgggcacctgtaatcccacctactcaagaggttgaggcaggagaattgcttgaaccctggaggtggaaatcgcagtgagccgacatcgagacattgcactccagcctgggggacagagcgagactctgtctccaaaaacaaacaaataaataaacaagcaaataaataaagtcctgtgaggaatgcacagtttctctgcactcccacacaacacttcccacaggagatgcaggttatttccacgttgagcaattctccacagacactagctgtgtgtcctctggttcaattccctcccgaagccgtccccctggggagagtgccaggtcccctgcggcgagggctggatcccacaagactgccccctcctcagatgctggtcagcctgtgggccgtgcttctgaccggcagctatacatcggggttcccacgacaccctcctgaggatcaatgagtttgacaggactgccctacagaactgcagaaagcacttacgttaaaagaaaacagaggagcagccggccgcagagacgcgcaggcaaggcctgggcaggtgctgggtttcaggccctctctgggcgccaccccctgcccccagcaccacaatccgaagaccatcccactctttcatctctcattcacgggtttttacagcgtttaatctccaccttcgctcgctgcgtccctgaggttggcgggtggggctcaaagctcccagcctccaatcctggggtcacctggtgttctggcgaccagtcccccctacccccgctctccagggccccaccccctgcctcatcagcataagctcaggtgtgatcagcataagctccggggtgatctgaaccactcctgtcactcaggaaattccaaggcttcgaggagcttctgtgccaggaaccaggaacaaagaccaaacacatttcatatcagagcacaagtgcaaaacatcatggttggaaacagggtctcagagtcctccaggtgcaggtgcctgttcagaccagagaccacaaagttgtaagtcaaaccttcatgtttggccagcggcggtggcccacacctagaaccccagtactttggaaggccgaggagggaggatcgcttgctgtccactcacgtctggggcacagcccaggagacccgtgggccgcagggtagacactcagcagtcgtgagacgcttgccccagtgcactgtcttttcaaggccactgacatctccacagacagcccccagcccgtcctttggctcttaatgtgcctcatccacctccgcgtgctgacacccacatcagtgacatttgggctaagccgcctaatgcagagtggctataagcgcgctgagccgctcgtgaaattcagacaaccccaccggaagtgagagagaggacggctgtgagctcagggcagcgtttctgctgaaggcgtttgctttcccaccatcataaagtcagaaaatcacaactcagaccatggtaagtggggaccacccacaacccaagtgggccttggaaattaagaataggaggccgggcgcgggggctcacgcctgtcatcccaggaggctgggcacagtggctcacgcctgtcatcccagcactgtgggaggccgaggcgggtggatcacaaggtcaggagattgagaccatcctggcctacatggtgaaaccccgtctccactaaaaatacaaaaattagctgggcgtggtggtgggtgcctgcagtcccagctacttggcaggctgaggcagaagaatggcgtgaacctgggagacagagcttgcagtgagccgagatcgcgccattgcactccagcctgggcaacagagcgagactccatctcaaaaaaaaaaaaaaaaaaaaaaaaacaggacagccagcgggtgcagtggttcccacctgtaatcccagcactttgggagcccaaggcgggcagatcacctgaggttgggagttcgagaccagcctgatcaacatgaagaaaccctgtctctactaaaaaaatacaaaattagccgggcgtggtggcgcatgcctgtagtcccagctacttgggaggcttaggcaggagaatcacttgaacctgggaggtggaggttgcagtgagccaagattgcgccattgcactccagcctgggcaacaagagcaaaaactccgtctcaaaaaaaaaaaaaaaagttggagcattttttgcccaggtgtgttggttcatgcttgtaatcctagcactttgggagaccgaggcaggaggattgcttgagcccaggagttcaataccagcctgggtaatatgacgaaacctcatctctaccaaaaaagtacaaaaattaggcctgggcacggtggtgtgcgcctgtgtgcccagctgaggtggggggactgcttgagtctgggaggatgagcctgcagtgaccgtgatctcaccactgcactccagcctgggcgacacagtgaaacgttttctcagaaaaaaaaaaaaaaaaaagaaaaggaaaaagaaatacaggaaggatatacccaagaataaggagactcttcagtgacagggcaggcaggagtgcagtgcagtgaggtgggggcggctccaggtctgactttcagaaccatgaaaatatgtcgcttgcttaaaaagcaaaaataattaaatcaacaagggtaggggaaaagggtctctgaaatggaacacgaacacgaatgcatgaaccacaccacagatcaaacaaacgacacaatcaccctgaggggagaagcagaacaagccctgggaactcgggtgcatggacgctggatgtgggtacgcaggtgatggacacaagggctccagacacacaagtagctccagacacaggagctccaaacaaataccgagttctaaacatgcttttttcccttttcttttcttgagacggagtctcgctctgtcgcccaggctggagtgcaatggcgcgatctcagctcactgcaacctctacctcccgggttcaagtgattctcctgcctcagcctcctgagtagctgggattacaggcacccgccaccacgcccagtgaatttttgtattttcatttcatttttagatggagtttcactcttgttgcccaggctggagtgcaatggcacgatcttggctcaccacaaccttcgcctcccaggttcaagcgattctcctgcctcagcctcccgggtagtggggattacatgcacgtgccaccaaaccctgctgattttgtatttttagtagagacgggttttcaccatgttggccaggctggtctcgaactcctgacctcgtgatctgcctgcctcggcctcccaaagtgctgggatttacaggcatcagccactgcgcccagcctcccttttctttttttttcttttttttttttttttttgctgactcatgggttagaattccggattgggcaaatacataaatattttgtacatgacgggaggcagatttcatcatgtgagtgaagcgagatgcaaacacgaaaggaagtccttcagggcagtcttgtagtgaaaaaataaaaataaaaatgaaaaaaagaggctgggcacggtgactcacgcctgtgatcccagcactttgggaggccgaggcgggtggatcacctgaggtcaggagttcatggtgaaaccccatccctagtaaaaatacaaaagttagctgggtgcagtggcatgcgcctgtaatcccagctactcgggaggctgaggcagaagaatcacttgaacctagaagacggaggtcgcagtgagccgagatcatgccaccacactccagcctgggcgacagagactctgtctcaaaaaaataaaaaggccaggcacggaggctcacgcctgtaatcccagcactttgggagtccaagggggtcggatcatgaggtcaggagatcgagatcatcctggctagcactgtgaaaccttgtctctactaaaaatacaaaaaattagccgggcgtggtgacgggcacctgtactcccagctactcaggagcctgaggcaggagaagggcgagaacccaggaggcggagcttgcagtgagctgagatcgtgccactgcactccagcctgggccacagagtgagactccgtctcaaaaacaaataaataaataaataaaaagaagaaagaagatggatggaatgacccccgcggtgtcggcctgtgagggtgctgtcgggcccgagcgcacaggcttgaacggatgggcggacgggcgacacgcacgcacacacacaccccaacacagcacatctgcccagagacagtcacacctgcacagcgcgctcccagcgccctaaccttggtttctaaatatcattctccactaaaggggctgggcgcaatggctcacgcctgtaatcctagcactttgggaggctgaggcaggcggattacccgagctcaggagttctagacgagcctgggcaatgtggcgaaaccctgtctctactaaaaatacaaaaaattagtctctactaaaaaaacaaaaaattaggccgggcgtggtggctcacgcctgtaatcccagcactttgggaggccgagacgggcagatcatgaggtcaggagaccagcctggccaacataatgaaaccccatctctactaaaaatacaaaaaaaattagccagacatggtggcaggcgcctgtagtcccagctacttggcatgctgaggcaggagaatctcttgaacccgggaggcggaggttgcagtgagcctagatcgggccactgcactccagcctgggtgatggagggagactccatctcaaaaaaaaaaaaaaaagattaatcctggcgggtgcctgtagtcccagccacttaggaggctgaggcatgagaatcgcttgaacccggaggcggaggttgcagggaaccaagattgcaccactgtactacaggctgggcaaagagcgagactgtctaaaaaacacaacataacaaaacaaaaaataataataacatatatcattctccacaaagccaaccaggcttctttgaaaaatgactgactctcgggctgtggtgggaaagacaccagaggagcggtcatgttggctgcgccgaaagtttgtgatctaggaatgaactcagggttggccgagggagggcgcagggggcttgaaaggcagagtacgtaacacagtaaaggatcagaacccccagtaaaacaacagcccacaaggccatgctgatgaacgaatggcaaaggaggggaagtctttcttcccagcacaaagtcaatccatgatcatcagagtgacagaatgagaagccaccatctggccaccatcacgatcatcatcacaatcacgacgagtcaccaagagactaaaactactgagtaaaagcttagaaacggccgggcgcgctggctcacacctgccatcccagcactttgggaggctgaggtgggcggatcacaaggtcaggacatcgagatcctcctggccaacacagtcaaaccccatttctactacaaaaaattagccgggcatgatggcgcgtgcctgtaatcccagctactcaggaggctgagccaggagaatcgcttgaacccaggaggtggaggctgcagtgagcggagatcgcgccattgcactccagcctgggcggcagagcgaaactctgtcccagaaaaaaataaagcttagaaacaagaggctatgtagtctcgagatagatccagccctatgaggcacatgtcaatcacagagggaaagctatgcacgcacaaagcatgtgtgaatcagagagaaagctatgcacgcacgatgagtagaagacaaacacgtcctgcaaggagacggaggcgcagggagggggcggcagccgtcctcccaagacatgaggacttctagttcagtctgagaccttggtgcagggctgggcgagtaaacaaatgcaaaagaataaggacctcgaggtcgggcgcggtggctcaagcctgtaatcccagcactttgggaggccgaggtgggcgcatcacgaggtcaggagattgagaccatcctggctaacacagtgaaaccccgtctctaccaaaaatacaaaaaacttagctggacgtggtggtgggtgccagtagtcccaactacacaggaggctgaggcacgaggatcacttgaacctgggagacggaggctttagtgagctgagattgcaccactacactccaacctggctgacagagcgagactgtctcaaaaaaaaacaaacaaacaggtctggtgtacccagaatggaggcaccacgagttgctgaagaaggaaactttattcagtctatgataccaggacagttgtccatgctgccaggcaaaaagaaaaactggattctgatctcattatcagtacacaaacagcgacaattagtaacactgacacagccctgactgtgctgctggagggtccgaagcactctctgcacagcggtgaatccccacaatagccctctggggaaggtgctgttatcacccacgtgagacacacgaaggaaagacacggctttgcagcagcagggtcacgattcgaacccaggtggcctgctcttatgataaacttaaatgtgtaaaactttatgctcaggaaaatataagagaatgtcttcctgaccctttttggggtaggacaataatttctctaaccaaaccccaaaagcatgacccattaaaaaaagggtcaggtggactaacttggctaaatgaagaattctgtttcaccaaagtacaccacaaagtgggccgggcgcagtggctcatgcctgtaatcctagcactttgggaggccaaggtgggcggatcacttgaggtcgggagctcgagaccagcctgaccaacatggtgaaaccctgtttctactaaaaatacaaaaattaaccaggtgtggtggtatgcacctgtaatcccagctactcgggagggtgaggcaggagaattgcttgaacccaggacggggaggttgcagtgagcccagactgcgccgctgcactccagcctgggcaacagggtgagaccctgtctcaaaaaaaaaaaaaaaaggccagacttggctcacgcctgtaatcccagcactttgggaggctgaggtgggtggatcacctgaggttgggagttccagatcagtctgaccaacatggagaaaccccatctctactaaaaatacaaagttggccggcatggtggcacatgcctttaaccccagctgctcaggaggctgaggcaggagaatcacttgaacacgggaggcagaggttgtgatgagccaagatcgcgccattgcacaacagcctgggcaataagaacaaaactctgtctcaaaaaaaaaaaaaagaaacaaaaaaaaaatatatatatatatacataccataaagtgaaatcaacagccacaacctgggaaaaaatacttgcaacatggcaaaggattaatatccagaaagtataaagaattcctacaaaccaagtagaaaaacaggcaaaaaaaaaaaaatgttggcggggcatggtggctcatgcttgtaatcccagcactttgggaggccaaggcgggcagatcacctgaggtcaggagttcgagaccagcctggccaacatgatgaaactccgtctctaccaaaaatacaaaaattagccaggcgtggtggcaggcgcctgtaatcccagccacgcaggaggctgaggcagcagaatcacttgaacctgggaggcggaggttgcagtgagctgagactgcgcctgctccagcctgggtgacacagcaagactccgtctcaaaaagaaaagaaaaaaaaaaaacaaaacaacatatttcacagagagaatttatgtttttggaggagtttcgctcctgtcgctcaggctggagtgcagtggtgagatctcagctcactgcaacctcaacctcccaggttcaagcgattcacagaggacaatttctaaaaggcaaataagaagcaggaagggtgcatgctccttctctactgccctgtaacagtcattccacacttaccacctcaaaacaacaaatgcttttgatgttggctcctgtggggcagcaatctgcgggaagcttagccaggcacctctggcttaaggtccctcctgaagctgcagtcacaccatggaccagggctgtgacctcatccgaaggctcaactggggctgaggcccacctctgagctcactcaggtggacgctggctgggttcagttccttgctggctataggtggaaagggcccccaccagtttcttgccagcttctccacaggacgccccacagcctgacaggagctttcatccagcaagctcatcagggagtgggagagagcagccaggacaggagcccaggcctttctgaacctcatctcagaagtgacatccttcccttctgctgtctgggcacagctccctgggtggagcccgaggactagaaggaaaagaaaacttggacttaaaatgggataaagccataggagctgctcgtcccaccacaggaatctcaacgccgggttactgacaaagcgtcactttgcacctcgtccaactgtgcagacctctcctagccaggcccctgcaccagaggttaagaatccgtgcccctggtcaggaagtacaggtgggttcaaacggccagcagggaatttcaggcaaaatgtgtcccaaatcttcaaaccatgccccagaactcagacctccccctgggagttcgtcccaaggaaaccacctgcaagaggctcaggctgcaggggacactccgcttccaaaacccggaagctggagaccacacaagtgcccaacgccaaaggcaccccgtggagggacgccctgtgccctcccccgaccaggtgacccgctgcgccctacacatcttcaccaggaaacatctgttatcgatgtggacgaagcgcagcctgcactcccagatccgctcattttcgttctgccctccgttttacgattcgcctacactgaaaatgcgtgagtggagtggaaagccttcctactcctgcctcagcgaccccttctaaaatactgcctcgtttggcctgaaaatgtgatttgcaggcttcctgagcaaagtagatttcactccattaaagaaaaaaaaaaagaaaaggcaccgaacggggctcggctgtcgggagttttgctttagtgttttgcgtgttttgttttgtgtttttctgttgttgttgttctttttgcggccacgcacaccgcgttcccaggcttcagggcgtgggggtcgccgtggactcccggacgtgaaaacgcttaaagccagctgggaaaaccccaccagcgttttccgcgcacagcgccagccataggaaaggacccccaggagcgaatccgggcagggaaaccccggacgcccgcacactcagcatcagtaccggcacccagcacccagcaccgagcaccgagcacgcagcacccagcaccgatcaccgagcagagcaccccgcacgcagaacccaccgagagcctgatgcagtctccgccgcaggcatagcgctaggccccggcgccttcacaacaaagggacgctggcgggcggggcctgagaggcgcgcggtggaggggccgggcgcgaggccgcggagacagctcggagctcggcactggggagtggcacagcgctggcggatccaggtgggcttcacggggcgcccgcgggaccggaaatgacgcgcagaaccctgcatcgggctcctcgctgccccgcgggcgccgctcctcagtgccccagagccacggagccggggaaacgcgccgcggcccacaacgcccccgcggctgcccgttggttccgcccgggccgttctactccaggcagacgggaggagaaacacggcgcgctcagcgtcccctcccccgttggttctgctcgggcccttccactgcaggccgacgggggtggaaacacgcagttttttttttttttttttaaggtctagggtaacacggggcttttaagtgcctctccgcggccgcctggtggtccagcccgggccgttgcagtgcagccacacggggagggacacggcgcgccgagtgctccgggcggccgcacgttggttccgcccgggccgttccactgcaggcagagggagaggacgacggtgcgcgtagtgcatccccgtggcccgttggttccgccggggccgttccactgaaggcagaaggggggggaccgtggccccaccccccgcggcagcccgttggttccgcccgggcggttccgcccgggctgttccaccagcggcacttcagggcgggatcggccaggctgtggaggcagcggcctctaagccccggagggtttactgcccaggtttgggttccaggaataagaaatccactgaataggcttaacttagaagacacaaaggcgcctcctggcggaagtggccacgctccgcccagcctgagggaaagctgctctgacagctgggcccggagctgcggggggcggggccgccgcgcggggtgaggactcgcctcagggcgctgattggctggtggcgcgctccggggcggggccttcgtatccaggctggcgtcggggctgccgcgggacatccggagcagacacccgcgggcgcgccctgcggccccgaggacccccggctccggagcttcgtcgagcgttttcctagcgttactttcccaaataattttcaggaatgaagttacggctaaagggctctttagagattacttttgggccgggcccggtggctcacgcctgtaatctcaacactttgggaggccgaggccggcgcatcacgaggtcaggagcttgagaccagcctggtatggccaacgtggtaaaacgtcgtctctactaaaaatacaaaaattggccgggcgtggtggcgggcgcctgtaatcccagctactccggaggctgaggaaggaggatcacctgaacccgggaggcggaggttgcagtgagccgagatggcgccactgcactccagcctggcgacagagcgagactccctgtcaaaagaaaaaagaaaagattacttttggccgggcgaggtggctcacgtctgtaatcccagcattttgagaggctgaggcgggcggatcgcctgaggtcaggagttcgagaccagcctggccaacatagtgaacgcccccccccatctctactaaaaatacaaaaaaaaattacccgggtctcgtggcgcgtacctgtggtccccgctactcgggaggttgaggcaggagaatcgcttgaaccttggagttgaaggttgcagtgaggcgagatagcgccgctgctctccgacctgggcgacagtgggagacttcatctcataaataaataaataaataaatattacttttacgttttgttaaacttccacttgtttttgtttccgttgcatgaaccttcgtaaagcttcaggaggctgatggcagcctccttccccaggcttccccgtggcgcccgcagccgggttgggccagaggctgggactgtttcctcccgtggggtctttggtggggatgtccccagaggagtggggcaggaggaggggcacggagcgcccccgggagccggtcagagcgcagcgatggtgtctgtggttccaaccactcgggaggctgaggtgggaggatggcttgagcctgggagcttgaggctgcagtgagctagaatcacagcaccacactccagcctgggcgacagagtgagacccttgtctcacaaaaaaaaaaaaaaaaaaaaaaaaaaaaggctgggtgcgttggctcgcgcctgtaatcccagcactttgggtggccgaggcgggcggatcacgaggtcaggagatcgagaccatcctggctaacacgatgaaaccccgtctctacaaaaaatacgaaaaaaaattagccgggcatggtggcacgtgcctgtaatcccagctacttgggaggctgaggcaggagaatcacttgaactcaggaggcagagcttgcagtgagccaagattgggccactgcactccagcctggcgacagagtgagactccgtcaaaaaaaaaaaaaaaaaaaaggaagaaagaaaattataaaatgaagtgaaattaacgcagtggagtgccacctgcctgctgcctgagttcactatccacacggagttcataaatttgagagcagtttacaaagtagattctcctactttccaggaaacccagaaatgtctggtgatttgcccaacagtctcagctgttgtggtcagcagggccgctgtggtatccaaatgatttcaaaagcagatttataaaaagtactccttttttttttgagatggaatttcgctctcatcgcccaggttggagtgcagtggcacgatctcagctcactgcaacctccgcctcccgggttcaagtgattctcctgcctcagcctcctgagtagctgggattacagatgtgtgccctcacgcccagctaatttttatatttttagtagagacagggtttcgccatgttggccaagatgttctccatctcctgaccttgtgatctgcccgcttcagcctcccaaagtgctgggattacaggcgtgagctaccccacgcccggcctttatttttttttgagacggagtctcactctgtcgcccaggctggagtgcagtggcgcgatctcggctcactgcaagctccacctcccaggttcaagagattcttctgcctcagcctcccgaggagttgggatcacaggcacccgccaccatgcccagctaattgttttgtatttttagtagagatggggtttcaccgttgttagccaggatgctcttgaactcctgacctcatgatccacccaccttggcctcccaaagtgctgggattacaggtgtgagccaccacgcctggcctctcaaagtttttatagcaaagccttacatttcatgaggaaccatgcattttattttatttttgagatgggggatctcgctactttgcccaggctgggctcaaactcagggctctctggcctcagcctcccgagtagctgggtctgcaggtggctgtcaccgtgctgggcctggggtgtgcgtattaatgattttggaatagtgtctggaagcctgtgtgctttcctctcttcctctccccagaaggacctcccacctcatcctcccaaagtgttgggattacaggtgtgagccaccatgtcccctctctttgctattttgcctgggaggagtgtattaataattttaattttaaagttctttgattatgttctagtttgattattgatcatttacttcttagctatttatattcttccttgagtcatcggtttctgccctttgacaatttttctgtgaatgttttgtgtcgattatatgagctttgtctgtattgagaacatccacgcattgtattattgcatctgttttgctagttgagaacatcgacctgctgtattattgcaaatgttttcctgcttgcatgtagtcatttgttgtgcatattaatgaatttctatccacatgacgccggaaggggatagagtgggtggggaggaagagggaagggtccccacctggagacccagcctgcaggccactcggccacctgcgcagaggtaggggagcagcagccgctcatgcccctgcaatttgtcctcatcagcaggtggggaaactgaggccggggagttctccaggccaaggtcactcacgggcaagttcccgcagcctttggaccctccatacatgtcagggccgctcatgctttcctgggcccttcactggtttggaggaaccgtcctgtttcccagagcgcactgcctgtctctgagtgtatgtgtctcagtggcgtccatgtgtatttttctgtgtgtgtatctgtgtgagtctgtgtgtgtggtgtgtttgtgtctgagtgtgtggtgttagcgtgtgtctcagtggcgtccatgcatatttttctgtgtgatgtgtctgtgtgtgtgtctctgagtgtgtggtgcctgcgtgtgtctcagtggtgtccatgcatatttttctgtgtggtgtgtctgtttgtgtgtgtgtgaatctacgtgggtgtttgtccatctttttgtctggcctcctgtcccctctgcacagagcagctgggtggggatgctggtcctgggggcttgtcagcaggatgtgggcgtggggcagccctgggtgaggcctgagtacaggccccaggtgcctcctgcacaggggtggctgagccggctcctctgtggctcccgggtccccaccgccggtcactgggcaccacctgtcctggccacccactcctacccaccctgctctccgcaggggcctccttcctctttcagctgtgcgccctggttgtggaggctcctaaggaggttgtggcctcggtttaccacctgccttggctccttggtgttgccagaccctgaaggcagcccatgccctggctgagatccttctggggcaggatgtgctggaagcagctgaaacatgtggtaatgtaccagctcctgctgtcccctacatccccagcaccgccagccttccctgggctcctccagctggcttctctaccctgtacctgccccaccctgctttcccccgaccctactaccccccaaccagacttccagctccaggcagggtcgcagcctcctgggctcccagcaggacaggcctcacccagaccccgcaggagccgtgggacttgggctgggtctttgggcctggctgcagcccctttggacctgacctgaggagacaccctggctgtgggaggcagggtgggggtgccgggcccagcacagaggtgcccagggtgcaggctggcactggcccggcagggaccgtggatgccgccgtttcaggctcgaaaaggtttccatgccccagagcctgagcccggcagcccccgaggatgtcttggggcctctgtgctccccaaagccaagaaggttaggcttgacccacagcctcttccaggccggggaggcagaggcgctccaggtcggtagggcggggcccacagcccagggtttcacgtccccaaaacggggcagggtgctggaggcgcaggtgtccacagggtggtcgttttggtctctcctggacttgcacgcgtgtagtgcagactggctgccggcaaagccctgagccacattcatctgggccttgttaggacaacagggacggtgcggggtgggggggttgcggggcgcaggaccacgtcagtggagggagggaggccgatatcggtgcccaggctgggcccaggggccagcgggtcctcacctggcttgtggctgcccctgttaggcagccaagaggggctcttccagccctgctggccccgggaatgcagggactcaactccccctggtctcagtggctcttccgggagcaacacagcctgcccgagtcgacaccacccctcgggtttgagtcccttctgtctacccctacccccgccagggcactgcccccttgcccggaagaggcagcggcacccccagccccttggggaggatgccctgccggccccacactcggtggatgggcattttggggctaggatttaatgggggtgaccctgcccgacccctctatgttggttccacggcgtcagaagaaagctgttattaacccagcttattttctacaagtcttgtttattgaaaggatctgaaaagcgtaataaggctttcaatgacatttaatacattttcaagaaattaatatgaaacattaaaatttacttcaaaaatccaaagttttctagatcattgcccatctcacgctgctttagaggtcagttcacaccttctgtgttcgatgatccctggattctgaaactgccgtcttccagccctaacgctgggcgctggtccctctctcctaagcccacggctgggcttcccctgtgcccagggtcatggcggacttcaagccaggccggctgcccagaatcacactcagggtttttggacgctcaagtccacagatgctgaggtgcccagacgagggtgagcagggagacacatgcctcggagaacgtgcccaggctgggccaggcggctgcgggaagctcctcacgggcagaggagaacgtcttgtgccttccttatcgatctccagcagatgagggcaacttcgtgtgcaaaactcagagagcagttactcaaaaaaaagacacccgggcagcagtaaccaggacaccagggtccgaccacggcctccacacacctgtgcccgtggaagacgcgggcgccggggtaggcagcatccacgtgctccacagctgctggtgctgggcaggctggagactcacgggagaggcaggaggagaatcagcgtgttgagtccctcgctgtgttagtgtgaaaaattctcattactgttgcaaataaaagggatcacgatcactagccccggaaaccctcatctcccggaccatcaggatcgcactgaacagaatggtcccctaatggtccctgaggacagcgtcttgcagaacataaatgtaaacattgaatggcagacgactcccttccccttgaaatcttcacaaaagtgtgtacgagaaagtatgtacatcagcacttcagaaaaggggcccacaggacgtgtgcggggtgtgcagggtgtgcggggtgtgcggggtgtttgagggtccggatgtgcgtcccgaggtcggagggttggacgcccctgtgtccagttgttgggaggggtgggaggcctcgccctgctgttcagccccttcccctccactgggccgcgttcccagggacgtgcaacagggcgctcaggttaggagacccgaaaccacaggcagacaggacccgccacgcccgctcccagccctgggcacccccacccccgtttccttccagtccattttccgcggcagtttttggtcctggggaccgtcaccgatgcctcccacgcacgctttcttccctgaagggagacgtcgctgcgctgggcctctcggcggtcccccccacccgggtcccgggcccactggccccccgcagacgccgctacacgctgactccagccaggctgcgctgggaccacttcaacctcacctacaggtgcgccctggctgggccccgggggagggggcgcggccggcgcccgctgagctcactctccctgcaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctggcctcctggaggcctctcctctgcagcacagtgggctgccgcggtcgggctttggggcagacggcaggagggaccttccggggtggtggctgccactggagtctagcaggcaaggaggggagcccgtgggagcccccatcccggcagccctgaactccctttcccatccccctgcgcctctggagcgggagctggagctgcattcctgggggccgagctcaccgcctgggcccagaacattcttatctttccgtggctgcggccgagggcggctccgcggctgcgctccagcagatacaccgggcctcggggagctggcccacgggcggcggggctgggcccggggctcccaggcgctgacccccggggcccgcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggccgtgctccccacgctcccgacaggatgcctcgacaggctgttcgtgtgcgcgtcctgggcgcggaggggcttctgcgacgctcgccggcggctcatgaagaggctctgccccagcagctgcgacttctgctacggtgatgcccacggggccgggacagggctgcgtgggagctgggccttggccatggtcggggctgagggggcactgacggggctctttcccccacccggagcagaattccccttccccacggtggccaccaccccaccgccccccaggaccaaaaccaggctggtgcccgagggcaggaacgtgaccttccgctgcggccagaagatcctccacaagaaagggaaagtgtagtgagtgagcgccccgggcggtcctcggggtgggcagcccgcgggcggccttggggcaggggtgcggggcaggcagcgggggggggctgtgcctgcaggagacgccccgcccccctgcagctggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctg

SEQ ID NO: 36899 - DNA, 47015 bp, Homo sapiens
catggcggcgactgcggcaaagcgagagcctcggagacgccgctgccgccagcacagccggagacctgagccgacactgggggcagtccgcgagccccgcactctctcgatgagtcggagaagtcccgtgagtgtgtgtgtgtacgtgtgcggggtgcgccggcggggcggctcgggagggcgccgcggcgggcccggcggcggcggcggcggcggcgacggcggagccggctccctcctccattgtgtgtgaccctccggcggctgccgctcaacaaaggcgtttttgttcggtctgccgcccgccccctgctcgcccgcctgcccgcccgctcgggcctggccggcgcgtccccgcgcgggcgggcgggcggcgggctggggtccccgcgtggggccggccaggcggccagcgcgcccctcccacccggcacgcccctcgccggtcgccctgccaggccgcgcccgctccctggccccgcacgcctgctgccgtcccgccgcctgcgcctggctccgcgggttcgaaacccagccggaccggaccggagggcgggcgagcgaggggcggcggcccggggaacatgaggtggcgtggagtctcgccttactggcacgctgcctttcgaaatgctcccgcgtctcctcccccatcccacccggtgactcggcctcagctgactccggccgggcaaagtctccagtggcgtagcgcgcagcgctcacccggctcgtctcagagccctgaagtccgcccaagttttgagtcttgccatgaatgaggtactgaaaactcggagacgaaattcctaatttcctccctcggccctacagtctttccttagcttctttcgggaccttaagtggtggtctgtaaaagtgcccaaatgaaagcttgttttgtcggttcaccaaaaagggccttgtcactttgctgtgcattttagtccgccttgtgagttgtgtcgaaaagtaaaggtgttttggcatccttttgtttcttggcgagtgtaggacccaaccggtttaggtgttagggggatctctgtgcagcgggagcttcttgattcctttcctgttttattttttcttttgcttgttcattggaaaaggtccagtgaaagggactggtgagttggaattagaagcctacttgtattaacggcagaattcgtgttcattgctaaagatgcagtctcagtaatgacttttttttttttaacggatacagatgatttgtcaaggggaaaaattaacacgccatacaatgaagagcaagcagcttcagagtaattttctgatggctgattcttctagcctgtctcttacagttccaattgcacatgtcctccctctttaacgctggaaaactgagatggaaagaatgatctgaccagaagaatgtagggtccaaacagggcctggccctgaaatcaggaatttcttcatagaaatatcagattttaatgtttaaaaaataattttgaattgggtgaaaggaactttgtctttagatagtagttgttcaaacatgtttatgaagtgtttgctatgtgccagggattgtaaagtcatttcacatatgttacatcatttattaagaattgccttaagcttgtaaaattattcattgatgtcctgaattcagtaattgcagttaatctagaaaatatgccagatttgagcagaacatatttgatcacctaggtattactgttgagaagaaaacactggaaaatggagactattttagaaaaaacttcgtatatgaggatattctggaattcatttatttgcaaaagaggattagaagtagtcgttggctactttctgttattaaaaaatccagagaagagtgatttgaagtcagttaattttgtaataaaaaaatgcacacattctaaagactaatgttagcactaaaagtgttgcagtgctttacataaattcatttaaagcatcgtgagaatcataactgacaaaatagtaaggtttgctgactcagggtactttgctgaaggggatgggggtcgggtaggaggaagcttacaagtgctgctgcaagttttgagttggatgatgactcatgctgcccacggactgctacgtggctttttttttttttttttttaaatacactgtatttttttctaaatgataggctaaaatgttcctgtccacattgaaattctctctcattttttctgaagaggaacagcagtttctctaaaaaagtaatggcttcttaaattgcattttaaaaggatatcatataccctacaggtggaattgtgtaacatttgctgagaggaaaggtaaaaccaatttctggtcaggtgctgaaattaaatgtttgatactagcagttttttggctactgctgagagagatttgttacaggttgtttataaaggacagatagtacttttatggtgtcggtagaaattgaccttatgtttttattggttatgtgaaagttatctttatatttaatatttaatcagatatggctctgaatatgaaagtttcactcagaattattaaaacataattatatattgtgctttgtgatttatgtgaattttctgttttaataaagacaatttgaaataggtattagtcactatttttcatggtttttttttaaagataagctgaatgtacagttctaagttgaaacttggtaataagataaatcttttgactgattttaaaacagccaacgtttagcaaggtggcttaaaataagattgagagggggaaaaagattgagaatggcagtttaagagtggggctgggtgcgttggctcacacctgtaatcccggcactttgggagcctgaggtggaaggatcgcttgaggccaggagttcaagaccagtctgggcaacataacgagaccctgtctcaatttttaaaataaaagaaaaaaaatttcccaccccatcctctggtttttctgtgtatactgtttatttttccaaagggatttgaggagtttgtggacagtaaagtgtttgttgtttttgtgagacagggtcttgctctgtcaccctggctggagtgtagtggtgcgatcactgttcactgcaacctctacttcccgggctcaggtgatcttcctgcctcagcctccggaggagctgggactacagctgtgtgcgaccatgcctggctagtttttcgtattttttgtagagatgaatgttcacagtgttgcccaggctgttcttgaactcctgggctcaagcaatctgcctgcctcagccttccagagtgttgggattacaggtgtgagcccctgctcccagcccataaaatgtattgttaatgtgaattaaatttttggaactattttggaagagtattgcatgatttatacctagaggttttttttttacaaagtttaattcaaacttaaaaaaaatttcctactagaggaaacataaaaatacaaatataaaagtattgaaaattttcagagcatcacattacttagaggtttaacgtattttcggcattgttttcaaatataggtaattagctgtagtgcataattcagagtttaaaaacaaactgaggccgggggcagtggctaacgcttgtaatcccagcactttgggaggctgaggaggcagatcacgaggtcaggaaatcgagaccatcctggccaacatggtgaaaccccgtctctaataaaatacaaaaattagctgggtgtggtggcacgtgcctgtaatcccagctactcaggaggctgaggcaggagaatcgcttgaacccgggaggcagaggttgcagtgagccgagattgtgccagtgcactccagcctgggtgacagagcgagactccgtctcaaaaaaaaaaaaaaaaaaaaaaccgaaaaacaaacaaaataactggatatcttagcctgcttcctgtctccaaggtactgctttatgaaatgctgagccttcttaccactgctatccagttctttgttacatttgaaccttgtgttactctaggtcccctgttaaaatggaaagaagatgcctcagaagtaaattctgtgtggcattgttggctgccttcattagttccttcagcctgttttgtgggctgttgaacattacactacaacctgccagtggtgtgggaattttgctcatttttattgctgagagccttgactgagacttcacaaaaacaactccaatgttactgtagttaatggcattttccaggggttgctttcatgtgaagctgatgcttttaaggtgacagtgatttgggcctagtccagcattgattggttttttcacctccatgaactgcgtatttggaaaataatgtgtgtctctctaagagtttttttgtttgtttgttttttgtttttgagacgctgtctccctctgttgccaggctggagcgcagtcgcgccatctcggctcactgcaacctccacctcctaggttcaagcgattcttcagcttcagcctcccgagtagctgggactacaggtgcgcaccaccatgaccagctaatttttgtattttttttagtacagacagggtttcattatgttggccaggatggtctcatctcctgaccttgtgatccgcctgcctgggcctcccaaagtgctgggattacgggcatgagccaccgcgcccagccaatagagttctaaaagttttgtcttttatacatgtcagtcttctaagtccatttctaaaaaattgttcagagattgaatgtttgtatagcaaatacaatttcccattgattttcgttaaatttggtatttttttcacagaaaaaaatggtatcataaaacttgttttttagaatcctagcatttacctcagaaaagtctgcctctgcagaaagtgcaaatctgtatgcatttaattctgtacaatcataaaactttaaaatattagtgttttggaggggtcatgggcattatcttgcttcattcatgtacatcgtttgacagctaaggaaaccaaggcctgaagagatctaagatcttggtactgaaagtgtgatttctggaccaacagtattagcatcacctgggaacttgatagacgttagaatcttgacttcatctcagtcctacggtcctactgaattagaatcttagaatctactttttctttttctttttttttttttttggagacggagtctcactctgtcacccaggctagagtgcagtggcacgatcttggctcactgcaagctccgcctcctgggttcacgccattctcttgcctcagcctcctgagtagctgggactacagctgctgccaccgcgcctggctaattttttgtgtttttagtagagacggggtttcaccgtgttagccaggatggtctcgatttcctgaccttgtgatccgcccgcctcggatccgcccgcccgcccagcactcccaaagtgctgggattacaggtatgagccaccgcgcccggccttctttttttgtaaataagaggcacaatcttgccctgttgcccagtttggattggagtgtagtggtgtgatcataacgcactgccacctggaactcctggactcaagtaatcctctcacctcagtagctgggactacaggcatgtgccatcatacactgccttttttttttttttttttttttttaagaattggagtctcactgtgttgcccatgctcgtctcaaactcctggcctcctaacgtgctgggaagaacctgcattttaacaagattttcaagtcattcagtgcgcattcagtttgagaagcactgctaaacgatgcatacacctgggcaacatagtgagaccctgtctctacaaaataaaataaaattagcctgttgtagtggtgcacacctttagtcccagctacttatgaggctgagatgagaggattgcttgagcccaggaggttgaggctgcagtgagccgtgatcgcaccgcagcgttccagcctgggcaacagcaagagaccctgtctcaaaaaatacgtaaataaataaaaattaaaatgatgcatacatggttgctcagctcgttagtcttctgagttgctctttccactggcccttctgaaaaaagtcaaatggaaaatttggaagctaatcactgcccagttgaactttctatgatgatagaagtgttctgtgctatccagtgaggtagccattggccatgtgtgactgttgaatacttgacgagcaagtagtgcacttgaggaattgaattttttatttaattttaattcctttaaatagttggggctgggcgccgtggctcacgcctgtaatgccagcactttgggaggctgaggcgggcggatcacgaggtcaggagatcgagaccatcctagctaacatggtgaaaccctgtctctactaaaaatacaaaaaattagccgggtggcgggcgcctgtagtcccagctgcttgggaggctgaggcaggagaatggcatgaacccaggaggcggagcttgcagtgagcgccactgcactccagtctgggtgacagagcaagactacgtctcaaaaaaaaataaaaatagttggatgtagctggtggttacatggacagcacagatctagatgatctttgcccactctaaaatctaagctgtaatttaataactggttagactcagtttaataattgtcctttcttaatgtacaaattggagagagagtatgttgacttagtttttctaatatgcccagatattatttcagtatgtattataaaacagtgctgattttctaattgatacatctgtgttcaataaagtagataatctaagttgtaagcaagtcagtttctttccatcttaacaggtattttcacttgaatttttaaaaagtagctattaagttttccttagttatcctgtggaaagcattggcaggatagtttttgcctctggcctagtccctctaggcttgttggcacttgttgattacttccagattgatctgctgtttatgttaattccaggtaccgaaacagtggttcttaacctcctacctttttttgttttgttgttgtcgttgttttgagacggagttttgctcttattgttcaggttggagtgcaatggtgtgatcttcgctcactgcagcctccgcctcctgggttcaagtgattctcctgctgcagcctcccaagtagctgggattacaggcatgcaccaccacgcccagctaattttatgtttttagtagagatggggtttcaaccatgttggccaggctggtcttgaactcctgacctcaagtgatccacccgtctcggcctcccaaagtgcagggattacaggcgtgagccaccgtgcctggccttaacctcccaccttatgcagtgggaagattctaaccctatagtcacaggcctatgtccaaatcttggcatttactgtgtgtgtaaagagcatcagtgctcttgtttgtaaaatgacatttacaagactgtagtttgagatgagagaaataatttgtcatttagaaaatgcctgtcatggctgggcgcgatggctcatgcctgtaatctcagcactttgggaggccgaggcaggcggatcacaaagtcaggagttctagactagcctggccaacatgatgaaaacccgtctttactaaaatacaaaaaattagctgagtatggtggtgcatacctgtactcccagctactctgaaggcccaggcaggagaatcgcttgaacccaggaggcggaggttgcagtgagccgagatcacaccattgcactccagcctgggcgacagagcaatactctgtcttgaaaaaagaaaatgcctgtcacagccgggcgcggtggctaatgcctgtaatcccaggactttgggaggccgaggcgggcggatcacaaggtcaggagttcaagaccagcctggccagcgtggtgaaaccccatctctactaaaaatacgaaaaaactggccatggtagcgtatgcctgtaatcccagctactcgggaggctgagacagaaaaattgcttgaacccagcaggcggagcttgcagtgagccgagatcgtgccactgtactccaggctgggtgacagagcgagactccctctcaaaaaaaaaaaaaaaaaaagaaaatgcctgtcacataataggtccttagtagatgtaagttacctaccctccccctcctgcttggattttatagccctctgtaattgagttttatgcttaagattccaatcaggcttaatacatattctgagtcttcatctctacccgttactgtaatttcatgccttgctttgttcatgttgtatcccatgtagattgtgccatttgtgctctggatgtcttctcttgactttttttttaatcttaatttttttttttttttttataggcggggtctccctgtgttgcccaggctgggctcaagcaatcatcctgactcggcctcaaaaagtgctgggattacaggcatgagccactctgctcagcctgttgatttctctttatttatttatttatttatttatttatttactgttttttgagatggagtctcactctgttggccaggttggagtgcagtggcacgatcttggctcactgcagcctctgcgtcccagattcaggtgattcttctgcctcagcctcttgagtagttgggactgcaggtgcccaccaccacgcccggctaatttttgtattttttttttttttttttttttttgagacggagtctcgctctgttgcccaggcggagtgcagtggtgcgatctcagctcactgcaagctctgcctcccaggttcacgccattcttctgcctcagctttccgagtagctgggactacaggcgcctgccaccacgcccggctaattttttgtatttttagtagagacagggtttcaccgtgttagccaggatggtctcgatctcctgaccttgtgatccgcccgcctcggcctcccaaagtgctgggattacaggtgtgaaccaccgcgcccggcaatttttgtatttttagtagagacggattcgtctctgtgttgaccaggctggtcttgaactactgacctcaagtgattcatctgccttggcctcccaaagtgctgggattacaggagtgagccatcgcaccctgccagcctgttgacttcttaaggacttacctcgttcttgcctacatcatgaatttttccctttctggattatctttattaatatgcagatgtgctttagggctgtactgtccagtatggtagctactaatcaatagtgctttctgcaatgaaatgtgtggctgttaaaagaaaaatttaaaaaatttaggtcctcagtgatgctagtcatatttcagttgttcagtagccatatatggtgctaatggctgctctattggacagtgcagatatagaacatccctatcattgcagacaacactattggacagcactaagtgtggcttccttgtttataagccctctcgccattccacattattctctagctacagcctcatttctctgattctcttccaagccagttttcaaaagttgtctttttgtgctctctccacttccctttgcttctcagcctactacagattggcctccattcttaccactaaaactactctagtcaaggttgccagtggtttctatttactaaattagtcttacaggctcttgtaggagcattcaatatagttgaccactgttttcggcctattcatctacttctcattttatgagacatatgttcttgttttccttctactttacaccttgttatactgtatgcttttttttgtttctgagacggagtctcgctgtcgtccaggttggagtgcagtggcgcaatattggctcactgcaacctccatctactgggttcaagtgattatcctgcctcagcctccccagtagctgggattacaggcgcacaccaccacgcctggctaatttttgtatttttagtagagatggggtttcaccatgttggtcaggctggtctcggaactcctgacctcagcctccttattacaggcataagccactgcacctagctttgtttttttttaattattaaacaggcttctctcctttacctgcctctaagtattggcatacctaagacaggataaaactcctgggtttttttttcaccctctttttctaaattcttccctagatggtctcattcaactcattgttttaaatgccatctgtatgtgaataattctcatatttatgtttctggtttagacttcttgcctgagctccagacatattatccaactgccttgctagacattaccacttagtaacctagtaggcagttgtctaaatatacctaacatgtccaaaatagaactctcttccataatattcttccagtctttctctcttctgtaactggcacctaggatttatccttgaatcctgtttttcccttatccccatagctaatccatcatcaagttcttttggtctccaaaatatcacttaaatctgtttattcaattatctgttttacatctttatttctgccaccttagtctcagccaccattatgtcacctggcttactgaaatagctcttaactggtctttgcttttactcagctaccttcttcagacattcttctcccagtaacaagaatcttctttcagaaatgtaaatgaaataatgtagattgcctgcttaaaatggtttcatagtttttctttggtcttagttatgagattcagaatcctgcctcatgtgttccttccttcctcattgctacctcctttcctttgccctttgctgtggatgctgtggctacactggcatttcttttgctccaaaatgccaagttttatcctgccttaggtttgttcaatttgttgtttcctctgttaggaatgcccttctcccatctcttagcagtgctggtagcttcttattcaggtttcagctcctcagagggccatttcccagctactaggccaaatctgaatttgttaattagctaacatgtttgttggtctttccttactagaatgcgagctcttcggaagcagaagaaccttgtctgtcttattctctactatattgtcaaacagtgcctggcacatgctaagtgctcagtaaatttttgtggactgtataaaatgtttgattcctttaaatctcagaagggaaaaactgcataataattgcattgtacccagtgtaacgtgattctggactgggtcctttacctcccaagtacatgattgagataattgcagaaacttaaatggggcctgattatcagatggtagtactataccagcgttaatttcttgattttgatggttgtgttttagttatgcagaagaaggcttttttttttttttttttttttttttttttgaggcagagtctcactctgttgcccaggatgaaggagtacagcggtgcaatcttggctcagtgcaacctgcgcttcccaggttcaagggattctcctgcctcagcctcccgagtagctgggactacaggcgtgtgccaccatgcccagctaattttttttttttttttgagacaggctctcagtctgttacccaggctggaatgcagtggcgtgatctcggctgactgcagtctctgcctcctgggttcaagcaattctcgtgcctcagcctcctgagtggctgggattacaggcatgtgccaccatgcctggctcatttttttgtatttttagtagagacagggtttcaccatgttggtcagtttggtcttaaactcttgacctcaaaggatccacccgccttggcctcccaaagtgctgggattacaggtgtgagccaccatgcctggccttaatttttgtatttttagtagagagacagggtttccccctgttggccaggctggtctcaaactcctcacttgaagtgatccgcccaccttgtcctcccaatgtgccgggactacaggtgtgagccactgcccccagccagaagaaggtctttgtctataggaaatatactctactcaaaaggttggggagtgaagggagatatgtactatacttgtcaataaaaaaataagttacagtgagagataatggaatttggtttacaaacctggttcaaatcctggctctctcattcatgtgtgatcttgaatgtgttttttaagttctctaaaataaagattatattttgcctattttgcctattgggaggatttagtgtaagggtatatgtccaacacaatgcttcacacataatacagtctcaataaaaccttgcttatattcttgtaaaatgttgaccaggcgtggtggctcacacctgtaatcccagcactttgggtggccaaggtgggaggatcgctggagcccaggagttcaagactagcataggcaacattgggaaaccttgtctctaccaagataataaaaaattgagccgggtgtggcaccttgcacggtggtcatagctactcagaaggctgagatggtccacccaccttgagcaatggaggtggaggttgcaatgagtcatgttcatgccactgcacttcagcttgggcaagcgagatcctgtctcaagataaataaaataaaaatttcaccattttattttcatgttcagtgctgtgactttctttataatatgaacaaataattttttttttttgaggcggagtctcgctctgttgcccaggttggagtacagtgacacgatctcggctcactgcaagccctgcctcccgggttcatgccattcttctgcagcgcccaccaccacgtctggctaattttttttgtatttttagtagagatagggtttcaccatgttagccaggatggtctcgatctcctgacctcatgatccgcctgcctcggcctcccaaagtgctgggattacaggcgtgagccaccgtgcccagcccaacaatttttaatttttttttttttttttttttttgagacagagtcttgctctgttgccaggctggagtgcagtggtgcaatctcggctcactgcaacctccgactccctggtttaagcgattctcctgcctcagcctcccgaatagctgggattacagtcatgtgccaccatgctcagctaattttgtatttttcatagagatggggtttctccattttggccaggctggtcttgaactcccagcctcaggtgatccatctgccttggcctcccaaagtgctgggattacaggcgtgagccactgtgcctggccgtggatagatatttttaatagactttttatattttcgagatatttaccctttctgagttttttattcctctctgtagatctggggttagttacatttggtgtatttttctttcatcctaaaagacttcttttagcatttcttgaagtgaaagtctgctggagacagatttctatccagtttttttaaatactttttttctttttttgtttttgacacggactttcgctcttgttgcccaggctggagtgcagtggcacaatctcggctcactgcaacctccgcctcccaagttcaagtgattctcctgcctcaacctccctagcagctgggattacaggcatgcgccaccacacccagctaattctgtatttttagtagagataggggtttctccatgttggtcaggctggtctcaaactcctgacttcaggtgatctgcccgcttcagcctcccaaagtgctggggttacaggcgtgagccaccgcgcccggcctccttttttttaatggagacagggtctcactatgttggtcaggctggtcttgaactcaagtgattatcccacctcacttcctgagaagtaactgggattacaggcataagccacggcacctggcatctttctacttttgtcttttctttgaaaaggtcttttgaaggttatttctcttagatacagaattctggtgtgatggttagtattaagtgtcaacttgattggattgaaggatgcctaggtagctggtaaagtattgtttttgggtgtgtctgtcagggtgttgccagaggagactgacctttgagtcagtggactgggagaggaaaacccaccctcatcagtgtgggtgggcaccatccaattggctgccaccgaggctagaacaaagcaggtggaagaagatgggataagctggcttgctaagtcttttggctttcatttttcatccgtcctggatgcttccttctgttcctcctgcccttgaacatcagactccagattgtttgggctttggactcttgacttagaccagtggtctgtcgggggttctccagccttcagccacagattgaaggctgcactgttagcctccctgcttttgagacttttggactcagattgagccactactggcttatttcttccccagcttgcagacggcttgacgtgggacttcttcgccttgttattgtgtgagccagttctccctaataagctccctttcatatatacataaaacttattatttctgtccctgtggagaagtgtgactaatacatctgggttaataggctttgttttttattttattttttccttattttctttttgggttgatagttttttttttcttttggtacttaaaacatattctattgtcttctgtttttcattgtttctagtgataaatcagctatcattcttattattcttctccagtatatactttatctcttttccctggttgcttttttgttttttgtttctttttttcctggttgctttttttttggatattgagttttgctcttgttgcccaggctagagtacagtggtgtgatctcggctcactgcaacctctgcctcccgggttcaagcgattctcccgcctcagcctcctgagtagctgggattaaaggcatgcaccaccacgcccaactaattttgtatttttggtagagacagagtttcaccatgttcgccaggctggtttcaaactcctcacctcaggtgatccgcccgcctcagcctcccaaagtgctgggattataggcgtgagccaccatgcccggactcctggttgcttttaagaatcattcttttttgtcgttcgttttttttttgagacagtctcgctctgttacccatactggagcacgatggctgatctcggctcatggcaacctctgcctcccgggttcaagcagtcctcccacctcaaccccccaagtagctgggacaggcgcatgccaccatgcctggctcatttttgtgttttttgtagagacggggtttcaccatgttgcccaggctggtctcaaactcttgagctcaggctgcctgcctcggccccccaaagtgctaggattacaggcatgagccactgtgccctggcgaagagttgttctttctcttccttccttcacttttcttcacttttctttttgttttcaacaatttcactctgtgcgtaggtatttttgtttgtttgtctgtttgtttattgagatggaatcttcctctgttgcccaggctggagtgcagtggtgtgatctcagctcactacaacctcctcctcccgggttcaagtgattctcctgcttcagcctcccaagtacctgggagtacaggtgtgcaccaccacgcccggctaatgtttgtgtttttagtagaaacgcggtttcaccatgttggtcaggctggtcttgaactcccagactcaagtgatctgcttgctggcctcagcctcccaaagtgctggaattgcaggcatgagccactgcgcctggccttgttatctcttcatatgctcctgctttactgaacctttgagctctgctttttagtctagattctggttctttggactgctgggaaattctctttgctttctagtctcatccaagattttccttatctcttgattttgccctaattctttgactcggccttaggaggaatatctgtcttacattctttgaagactcagaatgtctcagaggtgtttattccatgcttcctgtcttgatccccttctacagagagggccgctgccttgaacatggtagaggctcttttcttcatgggattctctctgcttttctgccttgccctcagacttggacacattcaaaacccatagggggccgggcagtggctcacgcctgtaatcccaccgctttgggaggccgaggcgggtggatctcgtgaggtcaggagtttgagaccagcctggccaatatggtgaaactaaaaatacaaaaattagccaggtgtggcggtacacgcctgtagtcccagctactttggaggctgaggcagaagaatcgcttgaacccgggaagcggaggttgcagagagccgaggtcacaccactgcactccagcctgggtgacagagcgagacaccatcttaaaaaaaaaaaaaaaagaaaagaaaaaatccatagggaagagttggcagttggggcttatagttgggcctcctccagattctctaatattttatctgagtccacatgcaaccattaaaattaagttcgttatttggctggtttctccttaatcctgtcagtggattcctggttctgccactttgccaggaatgagaatagccatggtctcttcccttctaaagggtttgactttttctctgatttagcttatttattatttagatttctttacatgcttagctctctgattttttttttccttaaactatgatttttgtagcttatccagcttgttgcagtttatagagtgaggcttggtatcttgcaactttgagcattctagtcagaagtggaaatcctgagccttttgttagaattacaaaatttgagagctggaagagaccatagaaatcaagtagtttaagccaggtggggtggtgtgcgcctgtactcctaactactacctggctctgcctgggtgacagggcaagaccttgtctcttaaaaaagaagaaatcctgtagcttagccactttgttttcctgatgaggaactgagacataaaaatgtgaaattctttgactacacagctgatgtagccacagatcctggagtagaccccagatctttaaacttatggtttatttcctttaatataagctgtccctcttggtttcatgttgctaaaacaacacctgagactgggtaatttataaagaagagaaatttatttcttacagttctggaggcttggcagtctgataccatggtgccggcatctggtgagggtctcctttctgcatcagcccatggtataagagaaagagagggccaaatttgcttttataataggcccactcccacaataatgacattaacccatctgcttcttactagtgattaataatcaccacttattaggccccacctcctaacacttgcattgaggattaagcttccaacccatgaactttgggggacacattcaaagcatggcacgggcctagtgaaagactggactctttcagtagggccaaattcttgtatggatctgatagcaaaccaacttaaaattttgtttttaaatctcgcaagctttctttttttcttcctttctttccttccttcctttttctttcctttctttccctcccctcctctcccctcccctcccctttttttgtgaaagcaggtttattaagaaagtaaaggaataaaagaatggctactccataggcagggcagccaaatcttgtaagccttcttcagtttggagaaaatgagaaataaagaggaaggatattccaaaaaaataacatgccattctgaattgtttttaaaaattagggaattggccagatgcggggctgatctgtaattccagcactttggaagacttaggtgggaggatcacttgaggccgggagttcaagaccagcctgggtaacatagtgagaccccatttctacaaaaagaaaaagaaaaaaaagttgaacgtggtgtgtgcctatagtcccagctactcaggaggcttagtgggagaattgtttgaggcaacagagtgagaccctgtctcttaaagagaatctccaagtaagcatatggttctctccatttgagagtccagagatgttttatatggccttgcataatgtgaccttcttcagaccctcaccagagttagctcaaaaacaacagcagtcacgtttgatctgtagtctgaaaagctgtggtgctaaaccctgctaggatggactgaagaatagtgtcaaggtcttgcatatcttcattataccttctttggtattacatgggctgataggactttttagagtcctgcttgactgattatataggatgctatttcagtggcacagtccctccccatcacctcaacaagataagatgagagctgtaacaaagctgaagtgtttcatttcttcattctgagtgggttgaaaccagctgccttcttcatgttgttggcagacctgtgcattcgcatagagtgagggtcctggtggaatgcctggaaaggaaaataccatatctgggaatcttcactgatgttttctagtggtagatcagaatgtgatcagattctgaaaaattcgaggataggacttcccttctccaaagctttctactcacgtagaatatgctatttacattgattcattcagtacatattttagggtacctactaattaccaggtactatgcttaggaaatgtccccaaagctacttagtcccaaaccttttatcatagacaaagccacagaaaaaaggaggggaatggtgccctggaaaatgaagagtagaggttctgaagaatcacattagattaggttgggggaggatggcaaaagaaaagggagtgaaaatgttattagaaagaggagaaagaaaagtgaaatgttagatagggaggaatccactacatgcccctgtgctccaggagtaataatgtgttcctttgagctcaagattgaaaaaaaaaaaaaaattgacctctgctatagcttaatgcctaaaacaatgcctggcacatggtaagcattcagtaaaatgttgaatgaaacgtaatggatggatgggagggttgaatctgtttagtctgtttaaaagatgttttaaaaacatcttggttcattctgcttctgggcccatgttgggattgcatttacccactcccttgggtatacgtatgaccatgtgacctactttagtcagtaaaatgtgagaagtgaatggtgtcacttttggatggaagcttttttgccagtgagatagtcttacttttctctgctacattgcatgtaattggtagagatggtgggtactttagcagcttggctgacagctacgttgaacttgtggcatgagcaagacttagatttttgggggccatctattatcctgactgctttgaaaatttatattttcatctagttagaatcctcaggtgtccaaaggtgcttgaagaaagaggctgtgcacatgtctcctgtcctatatttgctccaatatttctttaatgttagttaggttaggaatcttagaataaagcctcctgccgggaggaagataagaaatgggatcaagcgttattataattatttaaaaatttccagccgtaagtttgtagaagggattatatttgtttagtatacagcaatttgaataacatctctcccattctgagcataccaccacagggcttgggaataaaactaaagaaatataagacttgtaaatcatagacttaaaattggaagagtctatagggatgttattactagtttatctggtctatgaatttttgaatttctaatatgaatgggttacagtaaatctgtaactaggagatggagtctccctctgtccctcaggctgaagtgcagtggcacgatcttggctcactgcaacctccacctcccaggttcaagcgattctcctgcctcagctcctgagtagctgattacagcagtgcaccaccatgccaagctaatttttgtatttttagtagagatggagtttgaccatgttggtcaggctggtcgcaggtgatccacccgccttggcctcccaaagtgcatgagccaccacgcctggctgtaactagacttactagttgtaatctggttacagatttactgtaagtcatccatactggaaaataacaactagagataagcaacaaaataaacataatggcatgtgctttacaatggctttttaaatggccaaaggcaaatgaaagcccctaatgttaaaatgcatgtaggcaagggcttaaacaatttaagaacacaaattggtagtagtaggtgagtgttttgtctttttttttttttttttttttttgaagacagggtctcactctgttgcccaagctggagtgcagtggtgtgatctcagctcactgcagcgtccgcctcccaggttcaagcgattctccaacctcagcctcctgagtagctgggattacaggtgtgagccacgacacctggctagtttttgtattgttagtagagacaggggttttaccatgttggccaggctggtctccaactcctggcctcaggtgttctgcccaccttggactcccaaagtgctaggattacaagtgtgagccaccacgcccagcctgttttgtctttaaattggatactttgttactgtcttctctgactttgaaagtttgtctctgtagataagcatagttactgatactacccaaagcctttcagactttggcattttagatttaaggtcccatgtcttttcccaggttcctaagattatttgttgttaatagtttatactcccagcctccttgatgtccaaatcctgaaagggcccctgataactcttatggccgcccaccatacattaggagcaagggctttgtcaaaaatgcagtgagcaagcagctaagctgtagcacttggccttctctgcccgaaaatcttagtagctttgatgagagcttgagacatgatctcagggaagggtgaatttgctacagctacatttatctgtgccagggttaggagatagccctaggtgaatataagaaaagctcaacctttcccttctgtccaaaagcaactgggttttggctgaggagatgtgaggctggctaggttcctgttaactcaaattactcacttgactatggagaagagcaaaataagagcctttgtggagaggggatgggggaagtgctgtgctgtcagtgaatgtgaacaggccagatgacccatgtcagcatttatcctgagaagcagcagagcagaaggttgaggagaaaaccagaaaaagtaacctttatgtttatggcccttacttcaaactttctttgcacatctagacttcctttttgacataagtaggccaagttgctccttgataagaaaaaaagaaaattctggcgagataggacaaagtaaagttacttcttttgtttgcatttcattactttatacacttaggcttgactcccagtaccagcattactcttggtgtgggggtagaccagctgacagggagcaggaggtaatgtagcaaagagagcagtgcttgagcagacagttgtggctaatgcagtttcagggaactgccttataaacttaggaagctggtatccagcctgcattataaagagcttttaattccatgacatggtagatcactgaaagaaagccaaagaaaaagcaaaaagccaacttttattcttataaattattctctttacttcattttattcaccaaatttttaaaaacaaaacaatatcgaaccagctaattaaacttaatgatcactccccaaacaacccagaatcagcaatggttggtaggaatgggtaacatttatttggaagcagagaaattggaaagatgctggaaagggtccctttatgttaccttcctttttactgccttgttgaagtgtgtagaacgtgtaaaaagaatatggagccccagttttttcctgggtctaagctttaaactttgtttttttgtttttttgtttttttgttttgagatggaattttgctcttgttgctcaggctagagtgcaatggcgcgatctcggctcacagcgacctccacctcctgggttcaagccattctcctgcctcagcctctggagtagctgggattacagacatgcgccaccacgcccagctaattttgtatttttagtagagatggggtttctccacgttgatcaggctggtctcgaactctggacctcaggtgatctgcccgcctcagcctcccaaaatgctgggattacaggcgtgagccaccgcgcccggccttaactttgcctttatgaaattaagcatgaaagatggtggagataatggcaattaatagtacactgatgtggatagaggatgcagtgaccatctgctggtccaactgagttttatatatgctttagtcaggccaaggagctccgtgattgatgtgaaagttggaggtagttagagagatcagaatttggaatatacctgccctaagagttaaggtgataaggagggaacagttttctttctaaggtcactaggagagcatgagaggcctctgccttttttatggctaccaggcacacacatcttgactttcttaattaggtcagacccccagtgtgcagattctcagtagtatcttgtagcattccttggtaccacttgtcctttcttcatttctttgtttacttttctttttaaaaaaattgtttgtctctagtcacatgataaactccatgagggcagagcccaagtctctctttactcaccattttatccccattgccaagagattgactgacacaaatacttatcaaataccaaataatggaacgtgactgaattggaaacacttattggatccactgtatgatatagaggtacagcattactcgcagcttactaattaaggtgggtctgctttccaagatcctggctgaaaaggcactctagcagcatttggtctaatggatagtgaaggatcttgaagactactactcacagagcagtgacgcagaatcactgaacaagcactgccattgtaaatctttttctcccccagatgtttaactggtataatcctcattgtctagtggaattacagtttgttttataaatactaccttctcttgttacaatgtatagtcttcatcatctgagcacatagtgatgactctgcagttctcagtgtaggcaaagctcctaccttccctagtatcactttttacccactcttacctcgttaagtgctgaccagtcactgagaattctgaaaaggcactcgcatccttgaagtttctagtttgtgaggcttggtctcaataaaatttaaggggggcagatgtggatgggggtcttgagtaaggatctctcattttcatggctttcctaatctggctacaactcctactatagtgctattctgtcagataacagtggtgtaatttttgacaaagcattatttgtgcttgactagattgctgtgaactagaagtttgagagagaacttggagatcttactgttctcatttcatttgtctatagaactgactttacagtgtacatttatcagaaatgtaaaacatgactgagctttaaggaattgtctacgttaaggcaagaaggtaagcgtgaacaagcattctatttcaggtagagactagagatgtaaaatttaggaaataatggagcctttgagaaatactggttttcttgaccagcctgggaaacatagtgaaaccccgtctcttcaaaaaatacaaaaattagccaggtgtggtgactcctgcctgtagtcccagctacttggggggctgaggggctgaggtgggaggattgcttgagcccagaatgcagaggttgcagtgagtggtgatcacgccactacactctggcctggatgacagagcaataccctgtctcaaaaaacaaacaaactggttttcctagggtatttagtggggagcgagcaggaagaatcaagatgtgtacaaacagaaaaaacttggtgggagggagacatgcagtattaaagccctttttaaaaatctgaaacttttttaccaatacaaaaattatttttattttttatttattcattttttttgagacggaatcttgctcttttgcccaggctggagtgcagtggcgtgatctcacctcactgcaacctccacctcccaggtccaagcgattctcttgcctcagcctcccgagtagctgggattacaggcacctatcaccacgctgggctgatttttgtatttttagtagagacggggtttctccatgttggtaggctgatctcgaactcacgacctgaggagatccacctgccttggcctcccaaagtgctgggattacaggcgtgagccaccgcgcctggccacaaaaatttatttttattacttatttccactatcacatgagctagatcatataacaacattgaaaatccactggctaaagaccaaagacagactaatggctcagctagataatagcaaatgatatgttggacttaagttgtttgattttttttttttttttttttttttttttttttttgaggcagagtctcgctgtgtcccccaggctggagtgcaatggcaggatctcggctcactgcaacctctacctccctgcaacctctacctacctggttcaagcgattatccagccttaccctcctgagtagctgggactacaggcatgcgccaccacgcctggctactttttgtatttttagtagagacggggtttcaccatattggccaggctggtcttgaactcctgacttcgtgatctgcctgcctcggcttcccaaagtgttgggattacaggcgtgagccaccgtgtccggccttgagatatttttttaattcaaaagtttattcacaaacttcaacttttaagtgttttattacagatagactggtaagctacagaatttttaggactttttttttgggggggcgggctaggagggctgatttctgagaagcagagaaaaacttgtagacaggagaagccgtttctgttacagtaaaataaagctattatactattagtatccttcatgatattaagcagatacaagacccgttcttatttattaaaagaactgagggatatagtaagtatcagtttttattaaagctgtctttctcctattggacaatgagttgcgtttactgagggccagaatccttttgctcatatcaggtttgctcctgcctagcatatagtagttgctcaatatatgtttatatattaaacgaataaattggtggctttattctttctgcctaaaatattgtctggtcttatttgttaggaattctgaccacctgattttccataatgcctcatatctggtattctgggtactctgcaattaggccattaagaaactgaaagaaccaagttgcatttttttttttccaggctggctagggaaccatctactggagttgaggctattttttcctgcccttttataggatattttttaaagtatgaaatattttaagtgtacagagatcaatataatgaaccttcatatacataccacccagctctataagattctagtaatctgccatgtttgttattttaaaataaataacacattaaaacgcagataaatgattctggtctctttccttaatctccgggtaatcattatgaatttggtatttgtctcatttttttttccttttttttttttttttagttttgcaatatacatatgtacttaccaaaaaaaactattttgcatgcatataactacttatctgttctcctattttatgaagttgaggttgtttctaattttctttaccaaaaaaaaatgagcatttctctagggagtttactgtgaagaaaaatggccgggtcatagagtacgctatttatttattcatttatatgtttatgccaaattgctctgaagtttttactaatttaaactccaaccactattgtgtgaaagtttgtttttctacactcctcagacttgacattaacagagatgcatgttttttcaatctgaaatgttctcttaaggtaatcttttcctatcagtcacattaaataccttttcataggtattattcattgttcaagtttactcttataagttgaagaacattatttgcatatttgtgctgttagatttttgttcattggatattgataggcatagttaataagtaaacatgctttttaacaaactaacacattgcaggcttcttctatattcttttagatatttagatagatgttactaacgttttacccctcacaaaactcaagttctataaaaatattatgaaccttcccatacttgttggcatttcagaaatggtacaacctaatgagcctgttaccaagaatctagtgtagtgaaatctggagcccgggccaacgtgtgtgaattgctgataacatttttgtaagctatttttgattaagggtaatttgtcacttaatgaccataattaagtttaatgtaccagtagtagtttattgctaaatgcctactttgtgtcatactacaaatttgaagaaaagagtatttcctgcaatggtgactctcttctttttctcatccccccaggttgtatcagagtaagatggacggtagctttgattgtgattgtggtgagctggagccacctgatcactaacaaaagacatcttctgttaaccaacagccgccagggcttcctgttgaaataaatatatagcaacaaaggaaaaaaagaagcaaaacggaaatagtgcttaccagcaccttagaatgatgctgctcaggaccagtccaacactgaatgtatctgcactgtgaggagaatgttcatagaagcctgttgtgtgcatatttattcacatttttgttaaatgttaaatcgtttagcacggtaatctgagtgcacagtatgtcatttcattccgtttgagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataaggtatgtatagaaagccagctgagacagatctttaaactgatacacctaatcaggaataggtacttatattttctttgtatattgtggcagaatttttaatcttattaaactttacatagtgccttttttctgaaacaagtctctctgtttgaaatgaaggtggagtgggataattaaatacaaatttctaaaaatacatggttattataatgaaattttaaagtgtatggttatttattataaatgaaattctcccttagttatttaaaagtggaatatactcttctttctttgggacagaattgtggtaagaggggatgctatttcaactttaggtcttttgtttttgagacagagtctcactctgtcacaaagggtagagtgctgtggcgccatctcggctcactgcaaccttcatcccctggattcaagcgattcttgtacctcagcctcccaagtagctgggattacaggtgcgtgccatcatgcccagctaatttttttgtatttttagtagacagggtttcaccgtgttggccaggctggtcttgaactcctagcctccagtgatctgcctgcgtcagcctcccaaaatgctaggattacaggtgtgagcccccatgcccagcctttttttttttttttttaagtttttagtgacaagatcttgctgtgttgctcaggctggtgtcaaacttctgggctcaagtgatcctctggcctcagcctcctgaatagctgaggctaaaggtgcatgccagcacacccaagcttatgtcttcttttgtctctttgagcctgtactattcagttctgctttgtttaaactaaatttagcttgaaatctaaattcacataaacaattggtaataagtatagccaaaaagatctcacagcaacttcgtcttagatagcaaattgccttcatacaagaatttaatatttttcaagctgaaccttggtcttttagtttggaaatgaaatcttatgtgggaccctgatgtttaaattagagaggtggagctgctttggttgtaaagaacccctgggagccctgctttgttagctttccacagtacatgcctaagacaaatcttcatacatgttgtttcacgttaagattatttttatttttatttatttatttttttgagactgagttgtgctcttgtcaccaaggctggagtgcaatagtgtgatctcagctcattgcaacctccgcctcctgggttcaagcagttctcctgcctcagcctcccaagtagctgggattacaggcgcccgccaccacgcccagcccacattaaggtatttttacttgggccaggtacagtggctcacacctgtaatctcagcactttgggaggctgaggcaggcggatcacctgaggtcaggagtttgagaccagcctgacaacatggtgaaaccctgtctctcctaaaaatacaaaattagctgtgcctggtggtgcatgtctgtaattccagctactcgggaggctgaagcaggagaatccaggaggtggaggttgcaaagagctgagattgcgccaatgcactccagcctgggcaacaggagcaaaactccatttccaaacaaaaaagatattttgtagaaaatgagttctaggctggaagcgcggtggcccctgcctgtaatctcagcactttaggaggccggggcaggaggatcacttgaggccaggagtttgagaccaacctgcgcagtggctcctgcctgtaatctcagcactttaggaggccggggcaggaggatcacttgaggccaggagtttgagaccaacctgggcaacacagacaacttttttttcctagagaaaaagaaaaagagatgagtattacactgacgacgtccacagtgaaatattgtgggtagagcactgtatccacagtgaagtattgtggatagagcactgaactaataagacttatactatataaaattgactccatttctacatccaactagctatatgacttgaagcagatctcactctctcagtcatcacacctataaaatggagttaatatctaccatcacaatctctcagggtagttttgaggatgaaataaggcaatatatgtgtaaggttttgtaaggtgctttgtaattgtaaagtagttgaataggtgatgaataggatttatagtagaggtcattaaggaggtagacattggtttataagtagcacctctggtgctcttccctactgttctgacttgaagcatacttgctctttgattatctcaagactgagtgtaaaccagctcgtcttctgaaaaatgctttgaatgtgtggcctagagttatataatttttttttttttttttttttttttaaagacagggtcttgctctttgctcactgcaacctctgtctcctgcgcttaagtgatcctcccacctcagcctcccaagtaactgggactacaggcgtgtgccaccatgccaggctaattcttgtatttttagtagaggcagagttttaccatgttgcccaggctggtctcaaattcctgacctcaagtgatccacctacctcggcctcccaaagtgctggggttaaagattaggatttttttttttttttttttgagatggagtttagctcttgttgcccagggcggagtgcagtggcacaatctcggctcaccgcaacctctacctcccgggttcgagcgattctcctggctcagcctcccaagtagctgggtttacaggcatgcaccaccacacctggctaattttgtatttttagtagagatggggtttctccggttggtcagactggtctcgaactcccgaccttgggtgatccgcccaccttggtttcccaaaatgctgggattacaggcatgagccaccacgcctggcaaattaaggattctttaatcaagttgtaagtactgttcttcagctaaagtaaaaaaagtatgttttttgtttcttttatagggtcatctttctgaaggattggttactaaatggtacagatctccacgtcttttactttctcctaataattatactaaagccattgacatgtgggctgcaggctgcatctttgctgaaatgctgactggtaaaaccctttttgcaggttagtattttgtggggggaaaaattttcccaaagagaagtaattttgcattttatctctgaagcaagattcatataagatttaaaataatttgttatgatctgtaatactaaaatgaacagataaattggcgtttttaataaaaaaattgagaaaacttattcacatattcactaaattggtcacttcataaattatcagaactcctgtttaaatataatttcatattttgtggacccataatacttgttggtaatttgtgttgatacttaagttgcataattctgtcagtatcatcacttcctggtgaaaattttaagccattgttgaaaatccaacaaatttttcttggtcccctccccctataaacaaccaaacaagtaattttttgttaagtttggtgctatttagaagtctaaagaagtgtgtgagagaggactttgtcaagatgagatgagtaatccatgaaaaatgtcttgtgtcataaagcaaagcataggtctgtataaaattatttagtatagactagagctgtaaacttagagaagctatgcatcagtgattgctggaatggaaggcattatggagtcaaacagatttttcactatttagaagtagcgaagaattttaattggggaagagagaaaatgtgttatttaagggtacccatataaataagagtataagcctggtgcattcatgaatctgagatttgtgcaagttgtcaaataataataaacatatttatgactagttaagatggggtcggaatactagaaagtatttagaaagtaggcagaggactttccatatggaaaagtaaggaatagtaggggtactgaagattttttagttggggaagtggtgtgatagtgattaaggcctttttctgtcttttgacataactttttccccctctatacccattttttttttctgagacggagtcttgctctgtcacccaggctggagtgcagtggtgcgatttctgctcactgcaagctccgcctcccaggttcacaccattctcctgcctcagcctcccgagtagctgggactacaggcgcccgccccgtcgcccggctaattttttgtatttttagtggagatagggttttaccatgttagccaggatggtctcgatctcctgacctcgtgatccacccgcctcggcctcccaaagtactgggattacaggcgtgagccaccccaccaggccctccatacccatttttagagtggttccccccaacccccagacggtgctaagagcagaaggaaaggaataggccagagtctatttacataagaaagattagtgtacataggagagcactggtgaagaaaggacagcgtgcataaatgtcttttaagtatgttaatgccagtacttagtttatataacagcaagccagctctttataatttttttctaatatttatctaaaatttctgtctgggctcagtgtctcacgcctgtaatcccagcactttgggaggctgcagcgggcagatcacttgaggtcaggagtttgagaccaggcttgccaacatggtgaaaccctgtctctactaaaaatacaaaaattagctgggcatggtggcgcacgcctgtaatcccagctactggggaggctgaggcacgataatcgcttgaacctgggaggcagaggttgcagtgagctgggatcgcgccattgcactccagcctgggcgacagagactctgtctcaaaaaaaaaaaaaaaaaatttctaagatgtatgatagttttctaaattggaattcggagggattcctggaaactaaattattaaatggattgatttttgcttaggaacaatactgtgattagaggttatgttcctgatatcaagtgccttccagcatatataaacaattctgtttgttgcggtgtgacaaattactccaaaacttagtagcttaaacaacaaacatttattaacgttttacagtttctgtgtgtcaaaatatgggagtggtttagctgggtggttctagcttatgttttctcagtcaagatgttggtaagggcagcagttaccctgaagtcttgaccaaggcaggaggatccacttctagatagcttacttacatgacagttaccaagaggcttcggttcctcaccatgtgggcttctccataggactgcttgagtgtcttcataatatggtggctggcttcctctagaaccagtgatccaaaagacagcaaggagaaagccagtatatctttctttaaaaagttgtattgttatataattcacatatcatacaatttatttaaataatatagttccatattttttagtatatttacagagttgtgtaaccattaccacaatctaattttggaacactgtcttggctcctgaaagatcctgcaaaccattagcagtcacttctcatttcctctttcccccagcccctggcatccactaatctactttatgtctctatggatttgcctactctggttgtttcagataacatttggactttgtgacaggcttctttcatgtagcaatattttggaggtttacccatgttgtggcatatgttagtacttttttcctttttacgggcaaatagtattctgctatatggatataccacatgctgtttatccattcctcagttgatggacatttgggtttccacttcttggttatgaattatgctgttgtaaatatttgcgtacaagtttttgtgtgaaaatatgttttcagttctcttgggtatatatacctaggagtggaattgctgagctgtgtggtaactgtttaactttttgaagaacagtttcccagcgcagctgtaccattttacattcccaccaccaatgcatgagagttaaattttgtctttttgagtatagccatcctatcgggtatgaagtagtatctcattgtggttttttttttttttttttttgagacagagtcttgctttgtcatccaggctggaatgcagtggtgtgatcttggctcactgcaaccactgccacccaggttcaaacagttctcctgctctcagcctcccgagtagctgggattacaaaggcttgtgccaccacgcccagctaatttttgtgtttttagtagagacggggtttcaccatgttggccaggctggtctcgaactcctaacctgaagtgatctgcccgccttggcctcccaaagtgcaaggattacaggtgggagccattgcacccggcctcattgtggttttgatttgcatttccctaataactaatggatgattgaatgtctgtccagatctattgcccattttttaaattgggttgtctttttattattgagttgtaagaattctttacataattctgaatacaaatattttgtgatttacatgtattttctcctattctgcagttttttttccctttctttatagtgtcttttgaaacaagattgattgattggttgattgattgattgattgattggttgattgattgattgattgattgattttttaagacagagtcttgctctcttgcctgggctggagtacagtggcatgatctcggctcactgcagtctctccctcctgggttcaagcaattctcctccctcagcctcctgagtagctgggattacaggcacataccactatgcccagctgatttttgtatttttagtagagacggggttcaccacgttggtcaggctgatctcgaactcctgacctcatgatccactcgcctcagcctcccaaagtgctgggattacaggtgtgagccactatgccaggcctgaaacaagattttaattctgaagtccagttacctttttcttttgtctcttttgtttttggtgtcatgtctgaggaataattgcctgacccaaggtcatggatgttttctcctgtgttgtcttctgagagttttataggattcttatacagctgggcgcggtggctcacacctgtaatcccagcgctttgggatgcggaggcaagtggatcacctgagatcaggagtttgagaacagcctggccaacatggtgaaaccctgtctctactaaaaatacaaaaattagctgggcatggtggcgcgcacctacaatcccagctactcgggaggctgaggcaggagaattgcttgaacctgggaggtggaggttgcagtgagccgagatcttgccactgcactccagcctggccaacagagcgagactctgtattgggggtgggtgggacgggaagggattaacttttacacattcttttgcatgtggacatcctcttgtcctggcaccatttgttgaaaagattctttccccactgaattatcttgacactttcataaagaatcagttgaccacacatgtaaaatatctttttgtgaccaagtctcaaaagttacatactgtcaactttagctttatgtgttagaagtgagtcactaagtacgcttcatggtcaatgggagcggagttcagttccaccctttaaagggaggagtatcaaaagaatttttggacctttttttttcattttttaccttctcgaatgaacaagggtaaagtgtacatacatatatctatacacacacacacacacacacatatacacatacatagatacacacatacatatatatataattttttttttccgagactgagtcttcctcttgttgcctagccaacaatcgtacaatggtgcgatcttggctcactgcaacctccgcctcccaggttcaagcgactctcctgcctcagcctctcaagtagctgggattacaggcatctgccaccacacccagctaacttttgtatttttagtagtttcacccttttggccaggccggtctcaaattcctgacctcaggtgatctgtgtgccttggcctcccacagtgctgggattacaggcaagagccaccgtgtccggccaagtggacacattttaaagccaccacagtaacgagtcagaaaaacaagccaggtgtggtggctaatacatgtaatcccagcacttttggaggctgagaccagaggatcacttgagcccaggagttagagaccagcctgggcagcatagtgagaccctgtctcgacaaaaaacaaaaatgtagctgggtgtggtggcacacacctgtggtcccagctattcaaggggctcaggtgggaggattgcttgagcccggcaggtcaaggctacagtgagctgtgatcatgccacttactccagcctgagcaacagagcaagactttgtcttagaacaaaaacaaatttaagtctatataatgaaaaatcatttggtcatgctccaagtcatagaagtgagtcagtacctactgctgctgcatggattatacaaagggtttttttgtttgtttgtttgttttggaggagtctcgctctgtcgcctaggctggagtgcagttgcatgagctcagctaactgaaacctcctcctcccgggttcaagcgattctcctgcctcagcctcccgagtagctgggactataggtgcatgcctccatgcccggctaatttttgaaattttagtagagacaggatttcaccatattggtcaggttggtgttgaactcctgacctcaggtcattacctgcctcagccttccaaagtgctgggattacaggtgtgagccactgctctcggctgtatttgtgtatttttaaatgtttgtttttaaatgttcaatgcacattcggacattaaatataggaataaaaataattggatttgttttaaaactcttaagtagcatagttttacatttaataggaatagtttgcaatgaaatgattggaaagatctagattgtagtttgtttctagttgccaggtgctttattgatttttgtcagtgacccattcaataaaaacacgaagggaaatctgagtggttattaattaggtataagttgcaaatgaacagagcaacaaaaggtaaggaccaagcactcattggaaatcagtgtgtttttagcctgtgtgtcttattttttggtgcatttctcttgtgtgtccagattgtctctctataggtgttcctgtcccaggttaacacttgtacttgggcagtagatattttccctctttcctgctgtagcacttctatctcttgcatcttcactttacctcttctgctagatcacttttatcagtattcattcaaacattgatagaatttttccagtcttacaaaataatctgtcctgaccccacagtccctcagctactgccacatactactgtactcgttggatgtaaaacttctcaaaagatgcgtgcatccttgctgctcttaattcctctgcttacattctgtctttcaccctgtccagtcaggctttgtcctccaccagaaaccactctccacaggtcaccagtgatctccataatgctaaatcccttgtcaattctaagtcctcattttgagccatctccagcatttgttgcaattgatcttcacctcttcaggtgctttttcacctgtctttgggcacgccactcttgaattcttccctggcctctttccagtcacccttgccagttctctttctcctcgtgttggaagtatcccagattcagtccttgggctccctgcttctctagcttcacttagtccctgggtagtctcattctttttcattcctttaagaattatctatatctgatgatgactcctgaatttatgatgactcctgaatttatatcttcagccctgacctctcgtctgaattccaggttccttaactcaatatctccactcagatgtctaataacaaagttaacctacccagaactgggcccctgatatttcttcctcatacgttgtttttactcatgttagcaaaccagtacctccatttttcagttgcttagacaaaaatcttgtcattgtccttcatttctgttagcacagatcctgtgggctctttcttcaaactatatccagactcttaacggcttgttactgtcactcttactatccctcccccggtccagtcagccattatgtctctcctgttagaaggaccttctctttcctgcttcagtatttgctgtctttagttaccacatcgcagccagggtggtcctgttgaaagacaaggtagatcatgtcatctctgctcaaactgcatgatggctttccatcaaactcagggtaaagcaaaccctttgttctagtaccactctgacttatctcccattatctgccccaagctactctccttttgctacacttgtctaattgttgtttctttgacataccaacctgcctctgtcttctgggcttctctccatcttcctagaactcctttctttcttccatatgaatgtttggtgtattcctgacttccttaattttccacttcttagtgaggccttcctttgtctcaaaaaaaaaaaaatgtcttattgttgcccaggctagagtgcagtgacatgatcttggcttactgcaacctcctcctccagggtccaagcaattcttgtgcttcagcctcccaagtagctggaactataggcatgcgccttgcctggctaatttttgtatttttggtagagatggggttttaccatgttggccaggctggtctcgaactcttgactttaaaaaagtattaacaaccctattcttcccaacagtgccatcacccttagcttactctctttttctttatagcatatgtcaccataagacctactttacagaattatctgtctttatccacaagattgtaagatccatgaaggcaggcacttggtctgttttgtttcataactgtattctcaagtgtcctgcgcatagtaggaactaaaaggaattttgaatgttcaatgaatttatagacattaaaggaaaggcaagtggaatttttattttttgtttttgagacagggtctcactctgtcatccatgctggagtacagcaaatggaatttttaaaagtcaccacctatttagcctaaagtttccccctttatttctttcattgcctaacaacctagaaatgctaactgagccctaacatagaactataaaacttcctgttttacaagtctagtccaacccttcatttcattgatgttgaaataaagtcctaagagatgttagctattgtctctgaagttatagccagtaaattagtggtacagttaagaccagaatccagatctcttgaatctcagttgctttttttttcactagtttgtgataaccttaatatgagaccaaacttaaagagtcagttccctatggaaacaaagcagcaaaaactaaatacatcagtaagcagaaattgaaatagataagtagattggtgatagtcaaagcaatgaaacctgctgatgatacaattcaaacttttccccccactggtcattataatatttaaattagtttagtatgtttattgtgaaataagtaaacattgaggaatgtgtttttttgtttgttttttaacctcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaaggtattgtgactcgagagtaaccctcacgttaatgcctgtgtgtgaggcagaatctgtgtagggaagctggagctttttatccttagatatggggctttctccaaaatagtctttagacacttaaggtgtacgtaaaacttcaactctcattttccctttttttgtcctgttacttgggctacgatctgtttttttggttcctctgaatcactttccagagcaagtagcaagtattttgaatataggcactggggacaaaatcatgatggcattttttccctcagatatacttggaactcctgtaaatgcctggataaaaagaaagctgctgtatttaatttcagccggttttgcaggcttttcagtagttccacattcttaatcagtctttgagtctgtctgcacaaattccattgctagctcccttgctcgtaaccctgtagccactgtcacaacatccctgttcatatctaaatgagtcctctgtgggaacactttatttttattttttattgaaaaatagagacagagtcttccctgggctggtcttgaactcctgagctcaagcagcctttctgcctcagcctcccacagtggtagtattacaggtgtaagccaccacacctggccaaggagcacttttaaaatgctgaactagtaattctgaattgggaggtggagtggggaacagggtgggtgtctgcataccctctctaaggtgtgactctgctcagccaggtgaagacactgtgtgcagtgataacctggatccacttcagagtagttgtcactaatcaagaggacggtgctgttgaagcatttgtaaccttgctgtataatgctatttgaatctttttcgtaccctcattagggtggggaccatgttttaatctttgaattaaactgaatatttggccactgactggggtttattaaccattgagcaaagatccttggtggtcacatgtggcagcactgtgcttgcaagcaagtgaatgcagagtggatggagtttctgagactaaagatttatcaattgtatgctccatactactttcttcttaacagtggagttttattttgggacagagcacattctgaggcagtggcaacttggtaaaaagaatacatgttctcaccccacattctttatgatctttgaaggaaaaaagcaaacaggattaagtacatctgagtgaacgtataagactcctaggagccctactctggttaatttccctctatacttacctctcatcctttctgtagtataccatatatttctctaagcatggttcagcaccattgtagcattcctgtagtcctagctgttcaggaggctgaggcaggaagattccttgagcccaggagttcaaggctacaatgagctatgatcatgctattgcactccagcctgggcaaccgcaaagatgctgtgtcttaaaattatctttctaaagaaaagaaaagggttctttctagagtacaggttggcttgagagagaaaggccatctttctcacttagaaggcaaggataagaggatgtgtgagtgaccatagtgaagaggtagggattgagacaaatgtgaagtgggtttatctgttgagaatgataaagaagaccgagagcataaagagaaggccagatagcaaaggtcacaatgaaattgtttagtatgaatttgtaatgagccagatatgggatattgcagctagttttcatcagttttgtgtggccagggagcagagagagtagatggtggtggtgatccagggttgaaggttgatatcataaggcatagaagtgtgtggctggtgtaaatatagctttcaggctgcgtgaggaactaaggaaggcctactagactattttatgggaagaactggatttgtggttaaccagagtcctaagatgtgcaaggtcagtgtgtgaactatgctggagtgtgatgtgaagcagagatcaagaaattagtacaacagagatgttttactgttgtacttcccatcagtgaaggatgggaaagggcttttattacataccagacactatgattacatctcatttttgtaccttatgaaatatctatgtctactttatgcatgaagaaactgatgttcatcaagttttagtagcctatccagcactacagtgctagtaattgagttaagccagtgacttgcagagctaggattaaaacctatatattaggccgggattacaggcgtgagccaccacactcagccagaaaatcgtttttaagttgtaaatcaggtaagttttatttctgacaaattaactttttaattgtgtagtccatttttcccttttataagatggggacctattagtacaattaagatgctcatttcctgttgtgtagtatgtagtgctaaggtaatcacttagctagtcattgaaataaatgagatcaacatttactgtttttctaaaggtaagcaattcttttctgaaaaacttttaccttttcctctgcagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtaaattgatcctaaattagaaaaataatatttactgaactttcagtggaccatatgtagtgagtttttttaaaattatgtataagacattgtagaagtcttaaaaatttagtaatgtaaagatacaaaaattagtcaggtgtggtggcaggcgcctgtagtcctagctacttggaggctgaggcaggaaaatcacttgaacccaagtggccgaggctgccgagattatgccactgcattccagtctgggcaatagagcaagactccatctcaaagaaaaatttagtaatggtccttaatatttatatctataaatagccgttaattaaaacatttaataaagtaattactggttagatgatatatgggaaaagttaaatgctactttgaaacattttcaaagtcattaaggcatatttataaagtcctttaactgtgattttatgaatgtcaaaaatttaagatgttagatgacaagactcagtcatatccaataaagtatctccagtgtctcagtggtagttatatcttaacataaaaagtatttgattcatattagatgcaggattttttttttttttttttgagatggaatctcactctgtcacccaggctagagtgcaggctggagtgcagtgatgcaagctcagctcactgtcctgcctcagcctcccgagtagctgggattacaggtacccagctaatttttagtagaggtgggattttatgttggccaggctggtctcgaactcctgacctcaggtgatctgcctgccttggcctcccacagtgctgaaattataggcgtgaaccaccgtactcagccagtatttgaatctgttttcctaatgacacaattaatttggggacacttaacataggttcagtaaaagagacttttttaggtctaaacattagtgtataatgttatccatattttgatgtttcataaagtgaaataattggatttctaggaaagtttggctgggcgcggtggctcatgcctgtaatcccagcactttgcgaggctgaggcaggccaattacctgtggtcaggagttcgagaccagcctggctaacgtggtgaaacccggtctctactaaaaatacaaacataagccaggcttgatggcgggctcttgtagtcccagctactcaggaggctgaggcaggagaatcacttgaacctgggaggcagcagttgcagtgagccgagattgcaccactgcactccagcctgggcgacagagcaagactccgtttcaaataaataaataaatacatttctggggaagtttagatataattctgcttcagagtaggatggtagcttatagagtcatcaggtgattttgatgcttcagagtaggatggtagcttatagagtcatcaggtgattttgatgtatggccaagtttgggaaccactaatgccaatctttttaatcttaagattttaagaagaaatttttttccccctcctcaaatgttgatgtattggtatggtatgtttacacaaatctgcaaactactttttttctccatgtgtccatttctaccccctaaataatggttcttttcttttttgagacggagtctcactctgttgccaggctggagtgcaatggtgcccatctctctgctcactgcaacctcctgagttcaagcagttctcctgcctcagcctccctactagctgggactataggcacccgccaccatgttcagctaatttttgtatttttagtagtgggggtttcaccatgttggccaggctggtttcaaactcctgacctcaagtgatccatccaccttggccttcttgaagtgctagcattgcaggcctgagccactgcacctgacctgcattttctattttacctagctaagttatctaatctcttttcttttccctcaatgattatacatgtcagtaataggatagcgcattcagcagcacgtatacacagggagatttttgctattcatggtgatgagttttccagcaaacctcctcctcttctagttgcccttactgtagagtaaacatttagcaaacctcctcctcttctagttgcccttactgtagagtaaacatttgtaaggtacctgattgagatttgagatctgcattttgtggctatgaagtcttttgtttgcatggaactggtggacaaaaaacaaattggaaatgaagttacatactgcattggcaattaccaaatatattaacagagctttcctatcaagactaagttctggtagggcaaggcaggcatatttactctcctataattatcccctcatagacctagcacagtgctgtcacatagaaggtactcggtgaatttgaaaatgaaatcatatacgtagaataacgctagtgtattgatttttttcaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatac

SEQ ID NO: 36900 - DNA, 70429 bp, Homo sapiens; identical to SEQ ID NO: 36515

SEQ ID NO: 36901 - DNA, 1877 bp, Homo sapiens; identical to SEQ ID NO: 36788
